United States Patent
Doucette-Stamm et al.

(10) Patent No.: US 7,060,458 B1
(45) Date of Patent: Jun. 13, 2006

(54) **NUCLEIC ACID AND AMINO ACID SEQUENCES RELATING TO *STAPHYLOCOCCUS EPIDERMIDIS* FOR DIAGNOSTICS AND THERAPEUTICS**

(75) Inventors: Lynn Doucette-Stamm, Framingham, MA (US); David Bush, Somerville, MA (US)

(73) Assignee: Wyeth, Madison, NJ (US)

( * ) Notice: Subject to any disclaimer, the term of this patent is extended or adjusted under 35 U.S.C. 154(b) by 0 days.

(21) Appl. No.: 09/450,969

(22) Filed: Nov. 29, 1999

Related U.S. Application Data

(63) Continuation-in-part of application No. 09/134,001, filed on Aug. 13, 1998, now Pat. No. 6,380,370.

(60) Provisional application No. 60/064,964, filed on Nov. 8, 1997, provisional application No. 60/055,779, filed on Aug. 14, 1997.

(51) Int. Cl.
 *C07H 21/04* (2006.01)

(52) U.S. Cl. .............. 435/69.1; 435/252.3; 435/320.1; 435/325; 536/23.7; 536/24.32

(58) Field of Classification Search .................... 435/6, 435/91.2, 69.1; 536/22.1, 23.1, 24.3
See application file for complete search history.

(56) References Cited

U.S. PATENT DOCUMENTS

| | | | |
|---|---|---|---|
| 5,587,307 A | 12/1996 | Alborn, Jr. et al. | 435/240.1 |
| 5,635,348 A | 6/1997 | Leong | 435/6 |
| 5,679,520 A | 10/1997 | Hogan et al. | 435/6 |
| 5,770,375 A | 6/1998 | Ohno et al. | 435/6 |
| 5,807,673 A | 9/1998 | Ohno et al. | 435/6 |
| 5,994,066 A | 11/1999 | Bergeron et al. | 435/6 |
| 6,001,564 A | 12/1999 | Bergeron et al. | 435/6 |
| 6,025,132 A | 2/2000 | Jannes et al. | 435/6 |
| 6,228,588 B1 * | 5/2001 | Benton et al. | 435/6 |
| 6,287,820 B1 * | 9/2001 | Umansky et al. | 435/91.1 |
| 6,468,765 B1 * | 10/2002 | Fleischmann et al. | 435/69.1 |

OTHER PUBLICATIONS

Zilhao, R., and Courvalin, P., "Nucleotide sequence of the fosB gene conferring fosfomycin resistance in *Staphylococus epidermidis*," FEMS Microbiol. Lett., 68:267-272 (1990).

McKevitt, A.I., et al., "Amino acid sequence of a deltalike toxin from *Staphylococcus epidermidis*," Infect. Immun., 58(5):1473-5 (1990).

Sreedharan, S., et al., "Ciprofloxacin resistance in coagulase-positive and -negative *Staphylococci*: role of mutations at serine 84 in the DNA gyrase A protein of *Staphylococcus aureus* and *Staphylococcus epidermidis*," Antimicrob. Agents & Chemother., 35(10):2151-4 (1991).

Roberts, R.J., "Staphylococcal transfer ribonucleic acids. II. Sequence analysis of isoaccepting glycine transfer ribonucleic acids IA and IB from *Staphylococcus epidermidis* Texas 26," J. Biol. Chem., 249(15): 4787-96 (1974).

Kupke, T., and Gotz, F., "Expression, purification, and characterization of EpiC, an enzyme involved in the biosynthesis of the lantibiotic epidermin, and sequence analysis of *Staphylococcus epidermidis* epiC mutants," J. Bacteriol., 178(5): 1335-40 (1996).

Martineau, F., et al., "Species-specific and ubiquitous DNA-based assays for rapid identification of *Staphylococcus epidermidis*," J. Clin. Microbiol., 34(12):2888-93 (1996).

* cited by examiner

*Primary Examiner*—Kenneth R. Horlick

(57) ABSTRACT

The invention provides isolated polypeptide and nucleic acid sequences derived from *Staphylococcus epidermidis* that are useful in diagnosis and therapy of pathological conditions; antibodies against the polypeptides; and methods for the production of the polypeptides. The invention also provides methods for the detection, prevention and treatment of pathological conditions resulting from bacterial infection.

9 Claims, No Drawings

NUCLEIC ACID AND AMINO ACID SEQUENCES RELATING TO *STAPHYLOCOCCUS EPIDERMIDIS* FOR DIAGNOSTICS AND THERAPEUTICS

RELATED APPLICATIONS

This application is a Continuation-in-Part which claims priority to U.S. Application No. 09/134,001, filed Aug. 13, 1998, now U.S. Pat. No. 6,380,370, issued Apr. 30, 2002, which claims the benefit of both U.S. Provisional Application No. 60/064,964, filed Nov. 8, 1997 and U.S. Provisional Application No. 60/055,779, filed Aug. 14, 1997, the contents of all of which are incorporated in their entirety.

BACKGROUND OF THE INVENTION

*Staphylococcus epidermidis* (*S. epidermidis*) is a species of staphylococcal bacteria that are Gram-positive, nonmotile, nonpigmented and coagulase-negative cocci, which are mainly found on the skin and mucous membrane of warm-blooded animals. Their large numbers and ubiquitous distribution result in frequent contamination of specimens collected from or through the skin, making these organisms amongst the most frequently isolated in the clinical laboratory. In the past, *S. epidermidis* was rarely the cause of significant infections, but with the increasing use of implanted catheters and prosthetic devices, it has emerged as an important agent of hospital-acquired infections and has been recognized as a true pathogen (Lowy and Hammer, 1983, Ann Intern Med, 99: 834–9; Blum and Rodvold, 1987, Clin Pharm, 6: 464–75; Hamory, Parisi et al., 1987, Am J Infect Control, 15: 59–74). *S. epidermidis* is a major cause of infection of indwelling foreign devices such as, orthopedic devices, intravenous catheters, prosthetic heart valves, central nervous system shunts, and peritoneal dialysis catheters (Blum and Rodvold, 1987, Clin Pharm, 6: 464–75; Archer, 1988, J Antimicrob Chemother, 21 Suppl C: 133–8) (Lowy and Hammer, 1983, Ann Intern Med, 99: 834–9; Hamory, Parisi et al., *Staphylococcus* 1987, Am J Infect Control, 15: 59–74). In addition *S. epidermidis* is a common cause of postoperative wound infections, bacteremia of immunosuppressed patients, intensive-care unit patients and premature newborns (MacLowry, 1983, Am J Med, 75: 2–6)(Eykyn, 1988, Lancet, 1: 100–4). According to a national survey (Centers for Disease Control, 1981:7) *S. epidermidis* caused 8.9% of primary nosocomial bacteremias.

Treatment of *S. epidermidis* infections remains difficult because of the occult nature, association with foreign bodies, and frequent resistance to antimicrobial agents. Ordinarily, *S. epidermidis* is an organism with low virulence, however breaks in host defense caused by surgery, catheter placement, prosthesis insertion or immuno-suppression is prerequisite for infection. The presence of foreign bodies itself facilitates infection by protecting the organism from elimination by host defenses or antimicrobial therapy (Lowy and Hammer, 1983, Ann Intern Med, 99: 834–9). Furthermore, *S. epidermidis* due to its ability to produce extracellular polysaccharide material or slime, may be uniquely adapted to adhere to smooth surfaces such as plastics or metal. Slime producing strains of *S. epidermidis* appear to be more pathogenic than non-slime producing strains (Christensen, Simpson et al., 1983, Infect Immun, 40: 407–10; Peters and Pulverer, 1984, J Antimicrob Chemother, 14 Suppl D: 67–71; Gallimore, Gagnon et al., 1991, J Infect Dis, 164: 1220–3). This property and many factors are involved in the pathogenesis of device associated infections. Despite the increased recognition as a pathogen, *S. epidermidis* infections are difficult to diagnose. Differentiating clinically important from clinically unimportant bacterial isolates of *S. epidermidis* is difficult because of the high rate of contamination.

Although laboratory isolates of *S. epidermidis* have generally been susceptible to semisynthetic penicillins (methicillin, nafcillin, oxacillin), cephalosporins, amino-glycosides, vancomycin and rafampin, recent clinical isolates have had an increased resistance. Recent reports (Karchmer, 1985, Am J Med, 78: 116–27; Karchmer, 1991, J Hosp Infect, 18 Suppl A: 355–66) show that 83% of *S. epidermidis* isolates from patients with prosthetic valve endocarditis are methicillin resistant and 32% are gentamicin resistant as well. Multi-drug resistant staphylococci have emerged in the midst of high level use of penicillin and aminoglycosides (Centers for Disease Control and Prevention, 1993 *MMWR* 42:597; and S. Handwerger et al., 1993, *Clin Infect Dis* 16:750).

The use of antibiotics for therapeutics and prophylactic purposes, promotes the selection of resistant organisms and the spread of antibiotic resistance genes among bacteria. Previous studies have shown that virtually all staphylococci carry some antibiotic resistance genes on naturally occurring extrachromosomal mobile genetic elements, such as the plasmids. Survey and analysis of plasmids in clinical isolates of *S. epidermidis* have shown that more that 80% of isolates carry plasmids and in several cases more than one plasmid (Archer et al., 1982, Infect Immun, 35:627–632; Kloos et al., 1981, Can J Microbiol, 27:271–278; Moller, 1988, J Hosp Infect 12:19–27). Though the most important forms of resistance has been the inactivation of antibiotics, particularly penicillins and cephalosporins, recent clinical isolates have resistance to one or more of the following antibiotics, methicillin, tetracycline, erythromycin, gentamycin, kanamycin and chloramphenicol. In fact due to the wide spread occurrence of plasmids and their involvement in antibiotic resistance, plasmid profiling has been used as an epidemiological reagent to study nosocomial infections. This invention relates to isolated nucleic acids and polypeptides derived from *S. epidermidis*>plasmids that are useful as molecular targets for diagnosis, prophylaxis and treatment of pathological conditions, as well as materials and methods for the diagnosis, prevention, and amelioration of pathological conditions resulting from bacterial infection.

These concerns point to the need for diagnostic tools and therapeutics aimed at proper identification of strain and eradication of virulence. The design of vaccines that will limit the spread of infection and halt transfer of resistance factors is very desirable.

SUMMARY OF THE INVENTION

The present invention fulfills the need for diagnostic tools and therapeutics by providing bacterial-specific compositions and methods for detecting *Staphylococcus* species including *S. epidermidis*, as well as compositions and methods useful for treating and preventing *Staphylococcus* infection, in particular, *S. epidermidis* infection, in vertebrates including mammals.

The present invention encompasses isolated nucleic acids and polypeptides derived from *S. epidermidis* that are useful as reagents for diagnosis of bacterial disease, components of effective antibacterial vaccines, and/or as targets for antibacterial drugs including anti-*S. epidermidis* drugs. They can also be used to detect the presence of *S. epidermidis* and other *Staphylococcus* species in a sample; and in screening compounds for the ability to interfere with the *S. epidermidis* life cycle or to inhibit *S. epidermidis* infection. They also have use as biocontrol agents for plants.

In one aspect, the invention features compositions of nucleic acids corresponding to entire coding sequences of *S. epidermidis* proteins (SEQ ID NO: 1–SEQ ID NO: 3702), including surface or secreted proteins or parts thereof, nucleic acids capable of binding mRNA from *S. epidermidis* proteins to block protein translation, and methods for producing *S. epidermidis* proteins or parts thereof using peptide synthesis and recombinant DNA techniques. This invention also features antibodies and nucleic acids useful as probes to detect *S. epidermidis* infection. In addition, vaccine compositions and methods for the protection or treatment of infection by *S. epidermidis* are within the scope of this invention.

In another aspect, the invention relates to the nucliec acids corresponding to 2 naturally occurring plasmids of *S. epidermidis* (SEQ ID NO: 3703–SEQ ID NO: 3772) and the corresponding amino acid sequences (SEQ ID NO: 7475–SEQ ID NO: 7544).

The nucleotide sequences provided in SEQ ID NO: 1–SEQ ID NO: 3772, a fragment thereof, or a nucleotide sequence at least about 99.5% identical to a sequence contained within SEQ ID NO: 1–SEQ ID NO: 3772 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 3772, a fragment thereof, or a nucleotide sequence at least about 99.5% identical to a sequence contained within SEQ ID NO: 1–SEQ ID NO: 3772. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 3772, a fragment thereof, or a nucleotide sequence at least about 99.5% identical to SEQ ID NO: 1-SEQ ID NO: 3772 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *S. epidermidis* open reading frames (ORFs) within SEQ ID NO: 1–SEQ ID NO: 3772 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *S. epidermidis* genome and *S. epidermidis* plasmid sand are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *S. epidermidis* genome and plasmids. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer- based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the S. epidermidis genome and plasmids which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the S. epidermidis genome and plasmids from S. epidermidis, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the S. epidermidis genome and plasmids possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the S. epidermidis genome and plasmids. In the present examples, implementing software which implement the BLASTP2 and bic_SW algorithms (Altschul et al., J. Mol. Biol. 215:403–410 (1990); Compugen Biocellerator) was used to identify open reading frames within the S. epidermidis genome and plasmids. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features S. epidermidis polypeptides, preferably a substantially pure preparation of an S. epidermidis polypeptide, or a recombinant S. epidermidis polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the S. epidermidis amino acid sequences of the invention contained in the Sequence Listing is also encompassed by the invention.

In preferred embodiments: the S. epidermidis polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject S. epidermidis polypeptide differs in amino acid sequence at about 1, 2, 3, 5, 10 or more residues from a sequence of the invention contained in the Sequence Listing. The differences, however, are such that the S. epidermidis polypeptide exhibits an S. epidermidis biological activity, e.g., the S. epidermidis polypeptide retains a biological activity of a naturally occurring S. epidermidis enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the S. epidermidis polypeptide is a recombinant fusion protein having a first S. epidermidis polypeptide portion and a second polypeptide portion, e.g., a second polypeptide portion having an amino acid sequence unrelated to S. epidermidis. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *S. epidermidis* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *S. epidermidis* encoded polypeptide exhibits an *S. epidermidis* biological activity, e.g., the encoded *S. epidermidis* enzyme retains a biological activity of a naturally occurring *S. epidermidis*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *S. epidermidis* strain, 18972, from which genomic sequences have been sequenced, has been deposited on Jul. 10, 1997, in the American Type Culture Collection and assigned the ATCC designation # 55998.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *S. epidermidis* polypeptides, especially by antisera to an active site or binding domain of *S. epidermidis* polypeptide. The invention also includes fragments, preferably biologically active fragments. These and other polypeptides are also referred to herein as *S. epidermidis* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *S. epidermidis* nucleic acid will include a transcriptional regulatory sequence, e.g., at least one of a transcriptional promoter or transcriptional enhancer sequence, operably linked to the *S. epidermidis* gene sequence, e.g., to render the *S. epidermidis* gene sequence suitable for expression in a recombinant host cell.

In yet a further preferred embodiment, the nucleic acid which encodes an *S. epidermidis* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *S. epidermidis* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *S. epidermidis* polypeptide or an *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating an *S. epidermidis* or *S. epidermidis* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 3772 or complements thereof. Alternatively, the nucleic acids comprise sequences contained within any ORF (open reading frame), including a complete protein-coding sequence, of which any of SEQ ID NO: 1–SEQ ID NO: 3772 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing.

The invention also encompasses recombinant DNA (including DNA cloning and expression vectors) comprising these *S. epidermidis*-derived sequences; host cells comprising such DNA, including fungal, bacterial, yeast, plant, insect, and mammalian host cells; and methods for producing expression products comprising RNA and polypeptides encoded by the *S. epidermidis* sequences. These methods are carried out by incubating a host cell comprising an *S. epidermidis*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *S. epidermidis* polypeptide from the cell fraction, the medium fraction, or both. The polypeptides can also be made by in vitro translation.

In another aspect, the invention features nucleic acids capable of binding mRNA of *S. epidermidis*. Such nucleic acid is capable of acting as antisense nucleic acid to control the translation of mRNA of *S. epidermidis*. A further aspect features a nucleic acid which is capable of binding specifically to an *S. epidermidis* nucleic acid. These nucleic acids are also referred to herein as complements and have utility as probes and as capture reagents.

In another aspect, the invention features an expression system comprising an open reading frame corresponding to *S. epidermidis* nucleic acid. The nucleic acid further comprises a control sequence compatible with an intended host. The expression system is useful for making polypeptides corresponding to *S. epidermidis* nucleic acid.

In another aspect, the invention encompasses: a vector including a nucleic acid which encodes an *S. epidermidis* polypeptide or an *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating the *S. epidermidis* or *S. epidermidis* polypeptide variant, e.g., from the cell or from the cell culture medium.

In yet another embodiment of the invention encompasses reagents for detecting bacterial infection, including *S. epidermidis* infection, which comprise at least one *S. epidermidis*-derived nucleic acid defined by any one of SEQ ID NO: 1–SEQ ID NO: 3772, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1–SEQ ID NO: 3772, or polypeptide sequences contained within any of SEQ ID NO: 3773–SEQ ID NO: 7544, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *S. epidermidis*-derived immunogenic component, wherein the immunogenic component comprises one or more of the polypeptides encoded by any one of SEQ ID NO: 1–SEQ ID NO: 3772 or sequence-conservative or function-conservative variants thereof; or polypeptides that are contained within any ORFs, including complete protein-coding sequences, of which any of SEQ ID NO: 1–SEQ ID NO: 3772 forms a part; or polypeptide sequences contained within any of SEQ ID NO: 3773–SEQ ID NO: 7544; or polypeptides of which any of SEQ ID NO: 3773–SEQ ID NO: 7544 forms a part. Host animals include any warm blooded animal, including without limitation mammals and birds. Such antibodies have utility as reagents for immunoassays to evaluate the abundance and distribution of *S. epidermidis*-specific antigens.

In yet another aspect, the invention provides diagnostic methods for detecting *S. epidermidis* antigenic components or anti-*S. epidermidis* antibodies in a sample. *S. epidermidis* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 3772 or sequence-conservative or function-conservative variants thereof, or against a polypeptide sequence contained in any of SEQ ID NO: 3773–SEQ ID NO: 7544 or function- conservative variants thereof.

In yet another aspect, the invention provides a method for detecting antibacterial- specific antibodies in a sample, which comprises: (i) contacting a sample suspected to contain antibacterial-specific antibodies with an *S. epidermidis* antigenic component, under conditions in which a stable antigen-antibody complex can form between the *S. epidermidis* antigenic component and antibacterial antibodies in the sample; and (ii) detecting any antigen- antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 3772 or sequence-conservative and function-conservative variants thereof, or is a polypeptide sequence contained in any of SEQ ID NO: 3773–SEQ ID NO: 7544 or function-conservative variants thereof.

In another aspect, the invention features a method of generating vaccines for immunizing an individual against *S. epidermidis* The method includes: immunizing a subject with an *S. epidermidis* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *S. epidermidis* polypeptide. The method includes contacting the compound to be evaluated with an *S. epidermidis* polypeptide and determining if the compound binds or otherwise interacts with the *S. epidermidis* polypeptide. Compounds which bind or otherwise interact with *S. epidermidis* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *S. epidermidis* nucleic acid, e.g., DNA or RNA. The method includes contacting the compound to be evaluated with an *S. epidermidis* nucleic acid and determining if the compound binds or otherwise interacts with the *S. epidermidis* nucleic acid. Compounds which bind *S. epidermidis* are candidates as modultors, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *S. epidermidis* 18972. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti- bacterial activity.

The invention also provides methods for preventing or treating disease caused by certain bacteria, including *S.*

*epidermidis*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 7544. Use of the terms "SEQ ID NO: 1–SEQ ID NO: 3772", "SEQ ID NO: 3773–SEQ ID NO: 7544, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine- containing polymers of any length, either polyribonucleotides or polydeoxyribonucleotides or mixed polyribo-polydeoxyribo nucleotides. This includes single- and double-stranded molecules, i.e., DNA—DNA, DNA-RNA and RNA—RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence- conservative variants are those in which a change of one or more nucleotides in a given codon position results in no alteration in the amino acid encoded at that position. Function- conservative variants are those in which a given amino acid residue in a polypeptide has been changed without altering the overall conformation and function of the native polypeptide, including, but not limited to, replacement of an amino acid with one having similar physico- chemical properties (such as, for example, acidic, basic, hydrophobic, and the like). "Function-conservative" variants also include any polypeptides that have the ability to elicit antibodies specific to a designated polypeptide.

An "*S. epidermidis*-derived" nucleic acid or polypeptide sequence may or may not be present in other bacterial species, and may or may not be present in all *S. epidermidis* strains. This term is intended to refer to the source from which the sequence was originally isolated. Thus, an *S. epidermidis*-derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome and plasmids of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *S. epidermidis* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro- cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *S. epidermidis* biological activity if it has one, two or preferably more of the following properties: (1) if when expressed in the course of an *S. epidermidis* infection, it can promote, or mediate the attachment of *S. epidermidis* to a cell; (2) it has an enzymatic activity, structural or regulatory function characteristic of an *S. epidermidis* protein; (3) the gene which encodes it can rescue a lethal mutation in an *S. epidermidis* gene. A polypeptide has biological activity if it is an antagonist, agonist, or super-agonist of a polypeptide having one of the above-listed properties.

A biologically active fragment or analog is one having an in vivo or in vitro activity which is characteristic of the *S. epidermidis* polypeptides of the invention contained in the Sequence Listing, or of other naturally occurring *S. epidermidis* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as *S. epidermidis* polypeptides often exhibit a range of physiological properties and because such properties may be attributable to different portions of the molecule, a useful *S. epidermidis* fragment or *S. epidermidis* analog is one which exhibits a biological activity in any biological assay for *S. epidermidis* activity. The fragment or analog possesses about 10%, preferably about 40%, more preferably about 60%, 70%, 80% or 90% or greater of the activity of *S. epidermidis*, in any in vivo or in vitro assay.

Analogs can differ from naturally occurring *S. epidermidis* polypeptides in amino acid sequence or in ways that do not involve sequence, or both. Non-sequence modifications include changes in acetylation, methylation, phosphorylation, carboxylation, or glycosylation. Preferred analogs include *S. epidermidis* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *S. epidermidis* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
| --- | --- | --- |
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3, 4, or 5-phenylproline, cis-3, 4, or 5-phenylproline |
| Proline | P | D-Pro, L-I-thioazolidine-4-carboxylic acid, D- or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *S. epidermidis* analog, will ordinarily be at least about 20 residues, more typically at least about 40 residues, preferably at least about 60 residues in length. Fragments of *S. epidermidis* polypeptides can be generated by methods known to those skilled in the art. The ability of an *Staphylococcus* fragment to exhibit a biological activity of *S. epidermidis* polypeptide can be assessed by methods known to those skilled in the art as described herein. Also included are *S. epidermidis* polypeptides containing residues that are not required for biological activity of the peptide or that result from alternative mRNA splicing or alternative protein processing events.

An "immunogenic component" as used herein is a moiety, such as an *S. epidermidis* polypeptide, analog or fragment thereof, that is capable of eliciting a humoral and/or cellular immune response in a host animal.

An "antigenic component" as used herein is a moiety, such as an *S. epidermidis* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *S. epidermidis* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and*

*the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

S. epidermidis Genomic Sequence

This invention provides nucleotide sequences of the genome of *S. epidermidis* which thus comprises a DNA sequence library of *S. epidermidis* genomic DNA. The detailed description that follows provides nucleotide sequences of *S. epidermidis*, and also describes how the sequences were obtained and how ORFs and protein-coding sequences were identified. Also described are compositions and methods of using the disclosed *S. epidermidis* sequences in methods including diagnostic and therapeutic applications. Furthermore, the library can be used as a database for identification and comparison of medically important sequences in this and other strains of *S. epidermidis*.

To determine the genomic sequence of *S. epidermidis*, DNA from strain 18972 of *S. epidermidis* was isolated and a library of DNA fragments were transformed into DH5α cells. DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire *S. epidermidis* genome. Synthetic oligonucleotides are designed that are complementary to sequences at the end of each contig. These oligonucleotides may be hybridized to libaries of *S. epidermidis* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *S. epidermidis* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *S. epidermidis* polypeptide. These ORFs may contain start codons which indicate the initiation of protein synthesis of a naturally-occurring *S. epidermidis* polypeptide. Such start codons within the ORFs provided herein were identified by those of ordinary skill in the relevant art, and the resulting ORF and the encoded *S. epidermidis* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *S. epidermidis* polypeptide was recognized. The predicted coding regions were defined by evaluating the coding potential of such sequences with the program GENEMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

S. epidermidis Plasmid Sequences

This invention also provides nucleotide sequences of two naturally occurs plasmids which thus comprises a DNA sequence library of *S. epidermidis* plasmid DNA. One plasmid disclosed is approximately 39 Kb and nucleic acid sequence is contained within SEQ ID NO: 3703–SEQ ID NO: 3764. The other plasmid is approximately 2.9 Kb contained within SEQ ID NO: 3765–SEQ ID NO: 3772. The detailed description that follows provides nucleotide sequences of *S. epidermidis*, and also describes how the sequences were obtained and how ORFs and protein-coding sequences were identified. Also described are compositions and methods of using the disclosed *S. epidermidis* sequences in methods including diagnostic and therapeutic applications. The plasmid sequences can also be used as vectors and gene expression. Furthermore, the plasmid library can be used as a database for identification and comparison of medically important sequences in this and other strains of *S. epidermidis*.

Similar methods were used to determine to plasmid sequences of *S. epidermidis* as described above in determining the genomic sequence. A more detailed description of the methods are in the Exemplification.

S. epidermidis Nucleic Acids

The present invention provides a library of *S. epidermidis*-derived nucleic acid sequences. The libraries provide probes, primers, and markers which are used as markers in epidemiological studies. The present invention also provides a library of *S. epidermidis*-derived nucleic acid sequences which comprise or encode targets for therapeutic drugs.

The nucleic acids of this invention may be obtained directly from the DNA of the above referenced *S. epidermidis* strain by using the polymerase chain reaction (PCR). See "*PCR, A Practical Approach*" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, NY).

It is also possible to obtain nucleic acids encoding *S. epidermidis* polypeptides from a cDNA library in accordance with protocols herein described. A cDNA encoding an *S. epidermidis* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *S. epidermidis* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *S. epidermidis*. With the sequence information set forth in the present application, sequences of twenty or more nucleotides are identified which provide the desired inclusivity and exclusivity with respect to *S. epidermidis*, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Staphylococcus* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *S. epidermidis* nucleic acid from one strain from the nucleic acid of other another strain as well as from other organisms. Nucleic acid having twenty or more nucleotides in a sequence of the invention contained in the Sequence Listing can also have utility to separate other *Staphylococcus* species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *S. epidermidis* nucleic acid. These nucleic acids may also have utility as primers for the amplification of nucleic acids in other *Staphylococcus* species. With respect to polymerase chain reaction (PCR) techniques, nucleic acid sequences of $\geq$10–15 nucleotides of the invention contained in the Sequence Listing have utility in conjunction with suitable enzymes and reagents to create copies of *S. epidermidis* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *S. epidermidis* and/or other *Staphylococcus* species. The copies can also be incorporated into cloning and expression vectors to generate polypeptides corresponding to the nucleic acid synthesized by PCR, as is described in greater detail herein.

The nucleic acids of the present invention find use as templates for the recombinant production of *S. epidermidis*-derived peptides or polypeptides.

Antisense

Nucleic acid or nucleic acid-hybridizing derivatives isolated or synthesized in accordance with the sequences described herein have utility as antisense agents to prevent the expression of *S. epidermidis* genes. These sequences also have utility as antisense agents to prevent expression of genes of other *Staphylococcus* species.

In one embodiment, nucleic acid or derivatives corresponding to *S. epidermidis* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *S. epidermidis* that are useful as reagents for diagnosis of bacterial infection, components of effective anti-bacterial vaccines, and/or as targets for anti-bacterial drugs, including anti-*S. epidermidis* drugs.

Expression of *S. epidermidis* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLASTP2 algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT LN") and the length of the amino acid ORF ("AA LN"), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description frame ("Desciption") below the ORF Name. These genes in the Description were identified when the designated ORF was compared against a comprehensive non-redundant protein database. Specifically, the sixth column represents the Blast Score ("Score") for the match (a higher score is a better match), and the seventh column represents the probability ("P-value") for the match (the probability that such a match can have occurred by chance; the lower the value, the more likely the match is valid). If a BLASTP2 score of less than 100 was obtained, no value is reported in the table. The Description provides, where available, the Swissprot accession number (SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 3772, SEQ ID NO: 3773–SEQ ID NO: 7544 and in Table 2 together with routine cloning and sequencing methods, one of ordinary skill in the art will be able to clone and sequence all the nucleic acid fragments of interest including open reading frames (ORFs) encoding a large variety of proteins of *S. epidermidis*.

Nucleic acid isolated or synthesized in accordance with the sequences described herein have utility to generate polypeptides. The nucleic acid of the invention exemplified in SEQ ID NO: 1–SEQ ID NO: 3772 and in Table 2 or fragments of said nucleic acid encoding active portions of *S. epidermidis* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae, Methanobacterium* strains or other Archaea, and Eubacteria such as *E. coli, B. Subtilis, S. Aureus, S. Pneumonia* or *Pseudomonas putida*. In some cases the expression host will utilize the natural *S. epidermidis* promoter whereas in others, it will be necessary to drive the gene with a promoter sequence derived from the expressing organism (e.g., an *E. coli* beta-galactosidase promoter for expression in *E. coli*).

To express a gene product using the natural *S. epidermidis* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *S. epidermidis* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *S. epidermidis* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *S. epidermidis* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *S. epidermidis*-derived nucleic acid sequences. The libraries provide probes, primers, and markers which can be used as markers in epidemiological studies. The present invention also provides a library of *S. epidermidis*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 3772. For example, DNA can be chemically synthesized using, e.g., the phosphoramidite solid support method of Matteucci et al., 1981, J. Am. Chem. Soc. 103:3185, the method of Yoo et al., 1989, J. Biol. Chem. 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 3773–SEQ ID NO: 7544 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, Science 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *S. epidermidis* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *S. epidermidis*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded S. epidermidis polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted S. epidermidis coding sequences may be synthesized by standard methods, isolated from natural sources, or prepared as hybrids, etc. Ligation of the S. epidermidis coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are S. epidermidis, E. coli, B. Subtilis, Saccharomyces cerevisiae, Saccharomyces carlsbergensis, Schizosaccharomyces pombi, SF9 cells, C129 cells, 293 cells, Neurospora, and CHO cells, COS cells, HeLa cells, and immortalized mammalian myeloid and lymphoid cell lines. Preferred replication systems include M13, ColE 1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced S. epidermidis-derived peptides and polypeptides.

Advantageously, vectors may also include a transcription regulatory element (i.e., a promoter) operably linked to the S. epidermidis portion. The promoter may optionally contain operator portions and/or ribosome binding sites. Non-limiting examples of bacterial promoters compatible with E. coli include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL 1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant S. epidermidis-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of S. epidermidis-derived peptides or polypeptides.

Identification and Use of S. epidermidis Nucleic Acid Sequences

The disclosed S. epidermidis polypeptide and nucleic acid sequences, or other sequences that are contained within ORFs, including complete protein-coding sequences, of which any of the disclosed S. epidermidis-specific sequences forms a part, are useful as target components for diagnosis and/or treatment of S. epidermidis-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic S. epidermidis DNA as template; this is followed by sequencing the amplified product. The isolated nucleic acid encoding the disclosed sequence, or fragments thereof, can also be hybridized to S. epidermidis genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against S. epidermidis The disclosed S. epidermidis genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against S. epidermidis. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed *S. epidermidis* sequences with previously reported sequences present in publicly available databases is useful for identifying functional *S. epidermidis* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein: protein interactions, etc. These consensus sequences may be quite short and thus may represent only a fraction of the entire protein-coding sequence. Identification of such a feature in an *S. epidermidis* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *S. epidermidis* proteins identified as containing putative signal sequences and/or transmembrane domains are useful as immunogenic components of vaccines.

Targets for therapeutic drugs according to the invention include, but are not limited to, polypeptides of the invention, whether unique to *S. epidermidis* or not, that are essential for growth and/or viability of *S. epidermidis* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences:

Because of the evolutionary relationship between different *S. epidermidis* strains, it is believed that the presently disclosed *S. epidermidis* sequences are useful for identifying, and/or discriminating between, previously known and new *S. epidermidis* strains. It is believed that other *S. epidermidis* strains will exhibit at least about 70% sequence homology with the presently disclosed sequence. Systematic and routine analyses of DNA sequences derived from samples containing *S. epidermidis* strains, and comparison with the present sequence allows for the identification of sequences that can be used to discriminate between strains, as well as those that are common to all *S. epidermidis* strains. In one embodiment, the invention provides nucleic acids, including probes, and peptide and polypeptide sequences that discriminate between different strains of *S. epidermidis*. Strain-specific components can also be identified functionally by their ability to elicit or react with antibodies that selectively recognize one or more *S. epidermidis* strains.

In another embodiment, the invention provides nucleic acids, including probes, and peptide and polypeptide sequences that are common to all *S. epidermidis* strains but are not found in other bacterial species.

*S. epidermidis* Polypeptides

This invention encompasses isolated *S. epidermidis* polypeptides encoded by the disclosed *S. epidermidis* genomic sequences, including the polypeptides of the invention contained in the Sequence Listing. Polypeptides of the invention are preferably at least about amino acid residues in length. Using the DNA sequence information provided herein, the amino acid sequences of the polypeptides encompassed by the invention can be deduced using methods well-known in the art. It will be understood that the sequence of an entire nucleic acid encoding an *S. epidermidis* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *S. epidermidis* DNA as template; this is followed by sequencing the amplified product.

The polypeptides of the present invention, including function-conservative variants of the disclosed ORFs, may be isolated from wild-type or mutant *S. epidermidis* cells, or from heterologous organisms or cells (including, but not limited to, bacteria, fungi, insect, plant, and mammalian cells) including *S. epidermidis* into which an *S. epidermidis*-derived protein-coding sequence has been introduced and expressed. Furthermore, the polypeptides may be part of recombinant fusion proteins.

*S. epidermidis* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *S. epidermidis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *S. epidermidis* protein or against peptides derived therefrom can be used as purification reagents. Other purification methods are possible.

The present invention also encompasses derivatives and homologues of S. epidermidis-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify S. epidermidis-derived polypeptides for use in the present invention, essentially the complete genomic sequence of a virulent, methicillin-resistant isolate of Staphylococcus mirabilis isolate was analyzed. While, in very rare instances, a nucleic acid sequencing error may be revealed, resolving a rare sequencing error is well within the art, and such an occurrence will not prevent one skilled in the art from practicing the invention.

Also encompassed are any S. epidermidis polypeptide sequences that are contained within the open reading frames (ORFs), including complete protein-coding sequences, of which any of SEQ ID NO: 1–SEQ ID NO: 3772 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of S. epidermidis-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of S. epidermidis-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose S. epidermidis infection, including use as markers in epidemiological studies. Non- limiting examples of such sequences are listed by SEQ ID NO in Table 2, which is appended hereto and part hereof.

The present invention also provides a library of S. epidermidis-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination Of Staphylococcus Protein Antigens for Antibody and Vaccine Development The selection of Staphylococcus protein antigens for vaccine development can be derived from the nucleic acids encoding S. epidermidis polypeptides. First, the ORF's can be analyzed for homology to other known exported or membrane proteins and analyzed using the discriminant analysis described by Klein, et al. (Klein, P., Kanehsia, M., and DeLisi, C. (1985) Biochimica et Biophysica Acta 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-1}$ that the homology is only due to random chance) to membrane or exported proteins represent protein antigens for vaccine development. Possible functions can be provided to S. epidermidis genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of S. epidermidis Nucleic Acids and Polypeptides Based on the discovery of the S. epidermidis gene products of the invention provided in the Sequence Listing, one skilled in the art can alter the disclosed structure of S. epidermidis genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind S. epidermidis polypeptides. Such screens are useful for the identification of inhibitors of S. epidermidis.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. AG Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA*, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *S. epidermidis* Nucleic Acids and Polypeptides

It is possible to modify the structure of an *S. epidermidis* polypeptide for such purposes as increasing solubility, enhancing stability (e.g., shelf life ex vivo and resistance to proteolytic degradation in vivo). A modified *S. epidermidis* protein or peptide can be produced in which the amino acid sequence has been altered, such as by amino acid substitution, deletion, or addition as described herein.

An *S. epidermidis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *S. epidermidis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *S. epidermidis* polypeptide can be modified using polyethylene glycol (PEG) according to the method of A. Sehon and co- workers (Wie et al., supra) to produce a protein conjugated with PEG. In addition, PEG can be added during chemical synthesis of the protein. Other modifications of *S. epidermidis* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, WH Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an *S. epidermidis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *S. epidermidis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *S. epidermidis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *S. epidermidis* polypeptide, e.g., of cellular proteins, or of randomly generated polypeptides which bind to an *S. epidermidis* protein. (The *S. epidermidis* domain is used as the bait protein and the library of variants are expressed as prey fusion proteins.) In an analogous fashion, a two hybrid assay (as with the other screening methods described herein), can be used to find polypeptides which bind an *S. epidermidis* polypeptide.

Display Libraries

In one approach to screening assays, the *Staphylococcus* peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence- activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J.* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) EMBO 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) Vaccines 91, pp. 387–392), PhoE (Agterberg, et al. (1990) Gene 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward- extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233–1251). These particular biases are not a factor in the LacI display system.

The number of small peptides available in recombinant random libraries is enormous. Libraries of $10^{7-109}$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/ translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *S. epidermidis* Polypeptides

The invention also provides for reduction of the protein binding domains of the subject *S. epidermidis* polypeptides to generate mimetics, e.g. peptide or non-peptide agents. The peptide mimetics are able to disrupt binding of a polypeptide to its counter ligand, e.g., in the case of an *S. epidermidis* polypeptide binding to a naturally occurring ligand. The critical residues of a subject *S. epidermidis* polypeptide which are involved in molecular recognition of a polypeptide can be determined and used to generate *S. epidermidis*-derived peptidomimetics which competitively or noncompetitively inhibit binding of the *S. epidermidis* polypeptide with an interacting polypeptide (see, for example, European patent applications EP-412,762A and EP-B31,080A).

For example, scanning mutagenesis can be used to map the amino acid residues of a particular *S. epidermidis* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *S. epidermidis* polypeptide to an interacting polypeptide and thereby interfere with the function of *S. epidermidis* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in Peptides: *Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986)*Biochem Biophys Res Commun* 134:71).

Vaccine Formulations for *S. epidermidis* Nucleic Acids and Polypeptides

This invention also features vaccine compositions for protection against infection by *S. epidermidis* or for treatment of *S. epidermidis* infection. In one embodiment, the vaccine compositions contain one or more immunogenic components such as a surface protein from *S. epidermidis*, or portion thereof, and a pharmaceutically acceptable carrier. Nucleic acids within the scope of the invention are exemplified by the nucleic acids of the invention contained in the Sequence Listing which encode *S. epidermidis* surface proteins. Any nucleic acid encoding an immunogenic *S. epidermidis* protein, or portion thereof, which is capable of expression in a cell, can be used in the present invention. These vaccines have therapeutic and prophylactic utilities.

One aspect of the invention provides a vaccine composition for protection against infection by *S. epidermidis* which contains at least one immunogenic fragment of an *S. epidermidis* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *S. epidermidis* protein. In addition, fragments can be chemically synthesized using techniques known in the art such as conventional Merrifield solid phase f- Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic S. epidermidis peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in Proc. Natl. Acad. Sci USA, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., S. epidermidis polypeptide or fragment thereof or nucleic acid encoding an S. epidermidis polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing S. epidermidis polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) Science 247: 1465–1468 and by Sedegah et al. (1994) Immunology 91: 9866–9870. Other modes of administration include oral and pulmonary formulations, suppositories, and transdermal applications. Oral immunization is preferred over parenteral methods for inducing protection against infection by S. epidermidis. Cain et. al. (1993) Vaccine 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N- acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the S. epidermidis polypeptide with cholera toxin or its B subunit, procholeragenoid, fungal polysaccharides, including schizophyllan, muramyl dipeptide, muramyl dipeptide derivatives, phorbol esters, labile toxin of E. coli, non-S. epidermidis bacterial lysates, block polymers or saponins.

Other suitable delivery methods include biodegradable microcapsules or immuno- stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including S. epidermidis polypeptide in an insoluble form as fusion proteins. Suitable carriers for the vaccines of the invention are enteric coated capsules and polylactide-glycolide microspheres. Suitable diluents are 0.2 N NaHCO$_3$ and/or saline.

Vaccines of the invention can be administered as a primary prophylactic agent in adults or in children, as a secondary prevention, after successful eradication of S. epidermidis in an infected host, or as a therapeutic agent in the aim to induce an immune response in a susceptible host to prevent infection by S. epidermidis. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., J. Urol. 150:917–921 (1993); Boedecker et al., American Gastroenterological Assoc. 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, American Gastroenterological Assoc. 888:A-222 (1993)).

In a preferred embodiment, a vaccine composition of the invention can be based on a killed whole *E. coli* preparation with an immunogenic fragment of an *S. epidermidis* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *S. epidermidis* infection, some are useful only for treating *S. epidermidis* infection, and some are useful for both preventing and treating *S. epidermidis* infection. In a preferred embodiment, the vaccine composition of the invention provides protection against *S. epidermidis* infection by stimulating humoral and/or cell- mediated immunity against *S. epidermidis*. It should be understood that amelioration of any of the symptoms of *S. epidermidis* infection is a desirable clinical goal, including a lessening of the dosage of medication used to treat *S. epidermidis*-caused disease, or an increase in the production of antibodies in the serum or mucous of patients.

Antibodies Reactive With *S. epidermidis* Polypeptides

The invention also includes antibodies specifically reactive with the subject *S. epidermidis* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *S. epidermidis* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *S. epidermidis* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*S. epidermidis* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *S. epidermidis* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*S. epidermidis* portion.

Both monoclonal and polyclonal antibodies (Ab) directed against *S. epidermidis* polypeptides or *S. epidermidis* polypeptide variants, and antibody fragments such as Fab' and F(ab')$_2$, can be used to block the action of *S. epidermidis* polypeptide and allow the study of the role of a particular *S. epidermidis* polypeptide of the invention in aberrant or unwanted intracellular signaling, as well as the normal cellular function of the *S. epidermidis* and by microinjection of anti-*S. epidermidis* polypeptide antibodies of the present invention.

Antibodies which specifically bind *S. epidermidis* epitopes can also be used in immunohistochemical staining of tissue samples in order to evaluate the abundance and pattern of expression of *S. epidermidis* antigens. Anti-*S. epidermidis* polypeptide antibodies can be used diagnostically in immuno-precipitation and immuno-blotting to detect and evaluate *S. epidermidis* levels in tissue or bodily fluid as part of a clinical testing procedure. Likewise, the ability to monitor *S. epidermidis* polypeptide levels in an individual can allow determination of the efficacy of a given treatment regimen for an individual afflicted with such a disorder. The level of an *S. epidermidis* polypeptide can be measured in cells found in bodily fluid, such as in urine samples or can be measured in tissue, such as produced by gastric biopsy. Diagnostic assays using anti-*S. epidermidis* antibodies can include, for example, immunoassays designed to aid in early diagnosis of *S. epidermidis* infections. The present invention can also be used as a method of detecting antibodies contained in samples from individuals infected by this bacterium using specific *S. epidermidis* antigens.

Another application of anti-*S. epidermidis* polypeptide antibodies of the invention is in the immunological screening of cDNA libraries constructed in expression vectors such as λgt11, λgt11–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *S. epidermidis* polypeptide can then be detected with antibodies, as, for example, reacting nitrocellulose filters lifted from infected plates with anti-*S. epidermidis* polypeptide antibodies. Phage, scored by this assay, can then be isolated from the infected plate. Thus, the presence of *S. epidermidis* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect S. epidermidis or other species of Staphylococcus acid sequence using bio chip technology. Bio chips containing arrays of nucleic acid sequence can also be used to measure expression of genes of S. epidermidis or other species of Staphylococcus. For example, to diagnose a patient with a S. epidermidis or other Staphylococcus infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, Science 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (Science, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, Nature Biotechnology, 16: 45–48. Patents teaching this technology include U.S. Pat. Nos. 5,445,934, 5,744,305, and 5800992.

Drug Screening Assays Using S. epidermidis Polypeptides

By making available purified and recombinant S. epidermidis polypeptides, the present invention provides assays which can be used to screen for drugs which are either agonists or antagonists of the normal cellular function, in this case, of the subject S. epidermidis polypeptides, or of their role in intracellular signaling. Such inhibitors or potentiators may be useful as new therapeutic agents to combat S. epidermidis infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified S. epidermidis polypeptide.

Screening assays can be constructed in vitro with a purified S. epidermidis polypeptide or fragment thereof, such as an S. epidermidis polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the S. epidermidis polypeptide. Some of these active compounds may directly, or with chemical alterations to promote membrane permeability or solubility, also inhibit or potentiate the same activity (e.g., enzymatic activity) in whole, live S. epidermidis cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature,* 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae.* The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein—protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medica-* tions, Dekker, New York; Lieberman et al (eds.), 1990, *Pharmaceutical Dosage Forms: Disperse Systems*, Dekker, New York.

The antibacterial agents and compositions of the present invention are useful for preventing or treating *S. epidermidis* infections. Infection prevention methods incorporate a prophylactically effective amount of an antibacterial agent or composition. A prophylactically effective amount is an amount effective to prevent *S. epidermidis* infection and will depend upon the specific bacterial strain, the agent, and the host. These amounts can be determined experimentally by methods known in the art and as described above.

*S. epidermidis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

Exemplification

Cloning and Sequencing *S. epidermidis* Genomic Sequence

This invention provides nucleotide sequences of the genome of *S. epidermidis* which thus comprises a DNA sequence library of *S. epidermidis* genomic DNA. The invention also provides nucleotide sequences of two naturally occurring plasmids in *S. epidermidis*. The detailed description that follows provides nucleotide sequences of *S. epidermidis*, and also describes how the sequences were obtained and how ORFs (Open Reading Frames) and protein-coding sequences can be identified. Also described are methods of using the disclosed *S. epidermidis* sequences in methods including diagnostic and therapeutic applications. Furthermore, the library can be used as a database for identification and comparison of medically important sequences in this and other strains of *S. epidermidis* as well as other species of *Staphylococcus*.

Chromosomal DNA from strain 18972 of *S. epidermidis*, was isolated using a protocol described by Storrs, et al. (*J. Bacteriol.* 173: 4347–4352 (1991). The only exception to this protocol was that lysostaphin (120 U/ml) was used instead of lysozyme. Two endogenous plasmids of approximately 39 Kb and 2.9 Kb in size were identified upon visualization of the *S. epidermidis* genomic DNA on a 0.5% agarose gel. The first library constructed contained fragments from the *S. epidermidis* genome as well as from the endogenous plasmid. A second library was later constructed with genomic DNA, from which the plasmid DNA was removed by CsCl centrifugation. The genomic DNA prep involved a lysozyme:lysostaphin digestion, sodium dodecyl sulfate lysis, Proteinase K and RNase treatment, phenol: chloroform extraction, and sodium acetate precipitation, followed by the CsCl gradient to remove the plasmid.

In the construction of both libraries, genomic *S. epidermidis* DNA was hydrodynamically sheared in an HPLC and then separated on a standard 1% agarose gel. A fraction corresponding to 2000–3000 bp in length was excised from the gel and purifed by the GeneClean procedure (Biol101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5ácompetent cells (Gibco/BRL, DH5α transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores.

Finishing followed the initial assembly. Missing mates (sequences from clones that only gave reads from one end of the *Staphylococcus* DNA inserted in the plasmid) were identified and sequenced with ABI technology to allow the identification of additional overlapping contigs.

End-sequencing of randomly picked genomic lambda was also performed. Sequencing of both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

Additional templates for the physical gaps were obtained through PCR using primers designed from the ends of the contigs. These templates were then used in sequencing reactions to close the gaps. Contigs were ordered by aligning identified *S. epidermidis* genes to the published physical maps. Order was confirmed by PCR. The final chromosomal assembly included 23 ordered contigs and the two plasmids each contained 1 contig each.

To identify *S. epidermidis* polypeptides the complete genomic sequence of *S. epidermidis* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GEN-EMARK™ (Borodovsky and McIninch, 1993, Comp. Chem. 17:123).

Identification, Cloning and Expression of *S. epidermidis* Nucleic Acids

Expression and purification of the *S. epidermidis* polypeptides of the invention can be performed essentially as outlined below.

To facilitate the cloning, expression and purification of membrane and secreted proteins from *S. epidermidis* a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID. NO: 3772 for cloning from the 18972 strain of *S. epidermidis* and plasmids are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *S. epidermidis* DNA sequence. All reverse primers (specific for the 3' end of any *S. epidermidis* ORF) include a EcoRI site at the extreme 5' terminus to permit cloning of each *S. epidermidis* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA or plasmid DNA prepared from the 18972 strain of *S. epidermidis* is used as the source of template DNA for PCR amplification reactions (Current Protocols in Molecular Biology, John Wiley and Sons, Inc., F. Ausubel et al., eds., 1994). To amplify a DNA sequence containing an *S. epidermidis* ORF, genomic DNA (50 nanograms) is introduced into a reaction vial containing 2 mM $MgCl_2$, 1 micromolar synthetic oligonucleotide primers (forward and reverse primers) complementary to and flanking a defined *S. epidermidis* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA)(Current Protocols in Molecular Biology, John Wiley and Sons, Inc., F. Ausubel et al., eds., 1994). DNA samples are then subjected to electrophoresis on 1.0% NuSeive (FMC Bio-Products, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of *S. epidermidis* Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E coli* strain BL21 or *E. coli* strain BL21 (DE3), are transformed with recombinant pET expression plasmids carrying the cloned *S. epidermidis* sequences according to standard methods (Current Protocols in Molecular; John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM $MgCl2$, 10 mM $MgSO4$ and 20, mM glucose) at 37°C with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with *S. epidermidis* Nucleic Acids Individual BL21 clones transformed with recombinant pET-28b *S. epidermidis* ORFs are analyzed by PCR amplification of the cloned inserts using the same forward and reverse primers, specific for each *S. epidermidis* sequence, that were used in the original PCR amplification cloning reactions. Successful amplification verifies the integration of the *S. epidermidis* sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned *S. epidermidis* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression Of Recombinant *S. epidermidis* Sequences In *E. coli*

The pET vector can be propagated in any *E. coli* K-12 strain e.g. HMS 174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant *S. epidermidis* sequences, 50 nanograms of plasmid DNA isolated as described above is used to transform competent BL21 (DE3) bacteria as described above (provided by Novagen as part of the pET expression system kit). The lacZ gene (beta- galactosidase) is expressed in the pET-System as described for the *S. epidermidis* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *S. epidermidis* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resupended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

Equivalents

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| ORF Name | NT ID | AA ID | NT LN | AA LN | Score | P-Value |
|---|---|---|---|---|---|---|
| AI7503000979__10192177__f1__14 | 1 | 3773 | 135 | 44 | | |

Description
NO-HIT

| ORF Name | NT ID | AA ID | NT LN | AA LN | Score | P-Value |
|---|---|---|---|---|---|---|
| AI7503000979__10578392__f2__146 | 2 | 3774 | 510 | 169 | 525 | 1.7e-50 |

Description
gp:[GI:g2735511] [LN:SCU96108] [AC:U96108] [PN:YwpF homolog] [OR:*Staphylococcus carnosus*] [DB:genpept-bct2] [DE:*Staphylococcus carnosus* (3R)-hydroxymyristoyl acyl carrier proteindehydrase homolog (fabZ) gene, partial cds, YwpF homolog, single-strand binding protein homolog (ssb), SceD precursor (sceD), SceA precursor (sceA) and SceE precursor (sceE) genes, complete cds, and TenA homolog (tenA) gene, partial cds.] [NT:Orf2; similar to *B. subtilis* YwpF protein encoded] [LE:219] [RE:668] [DI:complement]

| ORF Name | NT ID | AA ID | NT LN | AA LN | Score | P-Value |
|---|---|---|---|---|---|---|
| AI7503000979__10632763__f1__106 | 3 | 3775 | 135 | 44 | | |

Description
NO-HIT

| ORF Name | NT ID | AA ID | NT LN | AA LN | Score | P-Value |
|---|---|---|---|---|---|---|
| AI7503000979__10739063__c1__376 | 4 | 3776 | 693 | 230 | 601 | 1.5e-58 |

Description
gp:[GI:g2735513] [LN:SCU96108] [AC:U96108] [PN:SceD precursor] [GN:sceD]
OR:*Staphylococcus carnosus*] [DB:genpept-bct2] [DE:*Staphylococcus carnosus*
(3R)-hydroxymyristoyl acyl carrier proteindehydrase homolog (fabZ) gene,
partial cds, YwpF homolog, single-strand binding protein homolog (ssb), SceD
precursor (sceD), SceA precursor (sceA) and SceE precursor (sceE) genes,
complete cds, and TenA homolog (tenA) gene, partial cds.] [NT:secreted
protein] [LE:1825] [RE:2523] [DI:direct]

| ORF Name | NT ID | AA ID | NT LN | AA LN | Score | P-Value |
|---|---|---|---|---|---|---|
| AI7503000979__10939577__f1__79 | 5 | 3777 | 153 | 50 | | |

Description
NO-HIT

| ORF Name | NT ID | AA ID | NT LN | AA LN | Score | P-Value |
|---|---|---|---|---|---|---|
| AI7503000979__1206255__f2__219 | 6 | 3778 | 126 | 41 | | |

Description
NO-HIT

| ORF Name | NT ID | AA ID | NT LN | AA LN | Score | P-Value |
|---|---|---|---|---|---|---|
| AI7503000979__12111018__f3__297 | 7 | 3779 | 426 | 141 | 174 | 2.7e-13 |

Description
gp:[GI:g642965] [LN:ABCARRA] [AC:X70360] [GN:carR] [OR:*Azospirillum brasilense*] [DB:genpept-bct1] [DE:*A. brasilense* carR gene.] [NT:ORF2] [LE:59] [RE:580] [DI:direct]

| ORF Name | NT ID | AA ID | NT LN | AA LN | Score | P-Value |
|---|---|---|---|---|---|---|
| AI7503000979__12142768__f1__110 | 8 | 3780 | 300 | 99 | 110 | 4.2e-06 |

Description
pir:[LN:D71245] [AC:D71245] [PN:hypothetical protein PH0221] [GN:PH0221]
[OR:*Pyrococcus horikoshii*] [DB:pir2] >gp:[GI:d1030234:g3256608] [LN:AP000001]
[AC:AP000001:AB009465:AB009464:AB009466:AB009467:AB009468:AB009469]
[PN:235aa long hypothetical protein] [GN:PH0221] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:194212]
[RE:194919] [DI:complement]

| ORF Name | NT ID | AA ID | NT LN | AA LN | Score | P-Value |
|---|---|---|---|---|---|---|
| AI7503000979__1250__c3__509 | 9 | 3781 | 714 | 237 | 644 | 4.2e-63 |

Description
gp:[GI:g2735516] [LN:SCU96108] [AC:U96108] [PN:TenA homolog] [GN:tenA]
[OR:*Staphylococcus carnosus*] [DB:genpept-bct2] [DE:*Staphylococcus carnosus*
(3R)-hydroxymyristoyl acyl carrier proteindehydrase homolog (fabZ) gene,
partial cds, YwpF homolog, single-strand binding protein homolog (ssb), SceD
precursor (sceD), SceA precursor (sceA) and SceE precursor (sceE) genes,
complete cds, and TenA homolog (tenA) gene, partial cds.] [NT:similar to TenA
of *B. subtilis*, encoded by GenBank] [LE:4569] [RE:>5086] [DI:direct]

| ORF Name | NT ID | AA ID | NT LN | AA LN | Score | P-Value |
|---|---|---|---|---|---|---|
| AI7503000979__12587886__f1__33 | 10 | 3782 | 138 | 45 | | |

Description
NO-HIT

| ORF Name | NT ID | AA ID | NT LN | AA LN | Score | P-Value |
|---|---|---|---|---|---|---|
| AI7503000979__1281557__c3__517 | 11 | 3783 | 1131 | 376 | 903 | 1.5e-90 |

Description
sp:[LN:DDL__BACSU] [AC:P96612] [GN:DDLA:DDL] [OR:*BACILLUS SUBTILIS*]
[EC:6.3.2.4] [DE:D-ALANINE- -D-ALANINE LIGASE, (D-ALANYLALANINE SYNTHETASE)]
[SP:P96612] [DB:swissprot] >pir:[LN:D69613] [AC:D69613]
[PN:D-alanyl-D-alanine ligase A ddlA] [GN:ddlA] [CL:D-alanine- -D-alanine
ligase] [OR:*Bacillus subtilis*] [DB:pir2] >gp:[GI:d1020046:g1881266]
[LN:AB001488] [AC:AB001488] [PN:PROBABLE D-ALANINE- -D-ALANINE LIGASE A]
[GN:ddlA] [OR:*Bacillus subtilis*] [SR:*Bacillus subtilis* (strain:168) DNA]
[DB:genpept-bct1] [EC:6.3.2.4] [DE:*Bacillus subtilis* genome sequence, 148 kb
sequence of the region between 35 and 47 degree.] [LE:41311] [RE:42375]

[DI:direct] >gp:[GI:e1182422:g2632756] [LN:BSUB0003] [AC:Z99106:AL009126]
[PN:D-alanyl-D-alanine ligase A] [GN:ddlA] [FN:peptidoglycan biosynthesis]
[OR:*Bacillus subtilis*] [DB:genpept-bct1] [EC:6.3.2.4] [DE:*Bacillus subtilis*
complete genome (section 3 of 21): from 402751 to 611850.] [SP:P96612]
[LE:105055] [RE:106119] [DI:direct]

| ORF Name | NT ID | AA ID | NT LN | AA LN | Score | P-Value |
|---|---|---|---|---|---|---|
| AI7503000979_1292842_c2_415 | 12 | 3784 | 672 | 223 | 790 | 1.4e-78 |

Description
gp:[GI:d1037675:g4126674] [LN:AB016431] [AC:AB016431] [OR:*Staphylococcus
aureus*] [SR:*Staphylococcus aureus* (strain:912) DNA] [DB:genpept-bct1]
[DE:*Staphylococcus aureus*, zinc responsible operon czr genes, complete and
partial cds.] [NT:Hypothetical protein] [LE:2175] [RE:2813] [DI:direct]

| ORF Name | NT ID | AA ID | NT LN | AA LN | Score | P-Value |
|---|---|---|---|---|---|---|
| AI7503000979_12_f1_1 | 13 | 3785 | 243 | 80 | 75 | 0.0084 |

Description
pir:[LN:A44803] [AC:A44803] [PN:pG1 protein] [OR:*Homo sapiens*] [SR:, man] [DB:pir2]

| ORF Name | NT ID | AA ID | NT LN | AA LN | Score | P-Value |
|---|---|---|---|---|---|---|
| AI7503000979_1366660_c3_484 | 14 | 3786 | 1215 | 404 | 566 | 7.8e-55 |

Description
pir:[LN:A70842] [AC:A70842 ] [PN:probable amiB protein] [GN:amiB]
[OR:Mycobacterium tuberculosis] [DB:pir2] >gp:[GI:e1251137:g2894215]
[LN:MTV016] [AC:AL021841:AL123456] [PN:amiB] [GN:amiB] [OR:Mycobacterium
tuberculosis] [DB:genpept-bct1] [DE:Mycobacterium tuberculosis H37Rv
complete genome; segment 143/162.] [NT:Rv3306c, (MTV016.05c), len:394.
amiB, Probable] [LE:3363] [RE:4547] [DI:complement]
>gp:[GI:e1251137:g2894215] [LN:MTV016] [AC:AL021841:AL123456] [PN:amiB]
[GN:amiB] [OR:Mycobacterium tuberculosis] [DB:genpept] [DE:Mycobacterium
tuberculosis H37Rv complete genome; segment 143/162.] [NT:Rv3306c,
(MTV016.05c), len:394. amiB, Probable] [LE:3363] [RE:4547] [DI:complement)

| ORF Name | NT ID | AA ID | NT LN | AA LN | Score | P-Value |
|---|---|---|---|---|---|---|
| AI7503000979_13790952_c2_422 | 15 | 3787 | 1194 | 397 | 1350 | 6.5e-138 |

Description
pir:[LN:B69619] [AC:B69619] [PN:phosphodeoxyribomutase drm] [GN:drm]
[CL:phosphopentomutase] [OR:*Bacillus subtilis*] [DB:pir2]
>gp:[GI:d1013330:g1303995] [LN:BACJHG42] [AC:D84432:D82370] [PN:YqkN]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:271220] [RE:272404] [DI:direct]
>gp:[GI:e1185619:g2634785] [LN:BSUB0013] [AC:Z99116:AL009126]
[PN:phosphodeoxyribomutase] [GN:drm] [FN:conversion of
ribose-1-P/deoxyribose-1-P to] [OR:*Bacillus subtilis*] [DB:genpept-bct1]
[EC:5.4.2.7] [DE:*Bacillus subtilis* complete genome (section 13 of 21): from
2395261 to 2613730.] [NT:alternate gene name:yqkN] [SP:P46353] [LE:51215]
[RE:52399] [DI:complement]

| ORF Name | NT ID | AA ID | NT LN | AA LN | Score | P-Value |
|---|---|---|---|---|---|---|
| AI7503000979_1415877_c2_413 | 16 | 3788 | 912 | 303 | 201 | 3.7e-16 |

Description
gp:[GI:g4982462] [LN:AE001824] [AC:AE001824:AE000512] [PN:conserved
hypothetical protein] [GN:TM1876] [OR:*Thermotoga maritima*] [DB:genpept-bct2]
[DE:*Thermotoga maritima* section 136 of 136 of the complete genome.]
[NT:similar to GB:Pyro_h percent identity:60.17;] [LE:4717] [RE:5481] [DI:direct]

| ORF Name | NT ID | AA ID | NT LN | AA LN | Score | P-Value |
|---|---|---|---|---|---|---|
| AI7503000979_14160455_c2_466 | 17 | 3789 | 162 | 53 | | |

Description
NO-HIT

| ORF Name | NT ID | AA ID | NT LN | AA LN | Score | P-Value |
|---|---|---|---|---|---|---|
| AI7503000979_14225327_f1_91 | 18 | 3790 | 1029 | 342 | 1252 | 1.6e-127 |

-continued

Description
gp:[GI:d1037673:g4126672] [LN:AB016431] [AC:AB016431] [GN:czrB] [FN:Zinc
resistance] [OR:*Staphylococcus aureus*] [SR:*Staphylococcus aureus*
(strain:912) DNA] [DB:genpept-bct1] [DE:*Staphylococcus aureus*, zinc
responsible czr genes, complete and partial cds.] [NT:czcD] [LE:724]
[RE:1701] [DI:complement]

| ORF Name | NT ID | AA ID | NT LN | AA LN | Score | P-Value |
|---|---|---|---|---|---|---|
| AI7503000979_1438927_c1_356 | 19 | 3791 | 1686 | 561 | 2118 | 2.7e-219 |

Description
sp:[LN:PYRG_BACSU] [AC:P13242] [GN:CTRA] [OR:*BACILLUS SUBTILIS*] [EC:6.3.4.2]
[DE:CTP SYNTHASE, (UTP- -AMMONIA LIGASE) (CTP SYNTHETASE)] [SP:P13242]
[DB:swissprot] >pir:[LN:SYBSTP] [AC:A32354:S55423:C69610] [PN:CTP
synthase, :CTP-synthetase:UTP- -ammonia ligase] [GN:ctrA:pyrG] [CL:CTP
synthase] [OR:*Bacillus subtilis*] [EC:6.3.4.2] [DB:pir1] [MP:37 min]
>gp:[GI:g143597] [LN:BACSPO0FA] [AC:M22039] [PN:CTP synthetase] [GN:ctrA]
[OR:*Bacillus subtilis*] [SR:*Bacillus subtilis* (strains JH642 and UOT0550)
DNA] [DB:genpept-bct1] [DE:*Bacillus subtillis* spo0F, CTP synthetase (ctrA),
and fructose-bisphosphate aldolase (orfY-tsr) genes, complete cds.] [LE:339]
[RE:1946] [DI:direct] >gp:[GI:g853762] [LN:BSDNA320D] [AC:Z49782] [PN:CTP
synthase] [GN:pyrG] [OR:*Bacillus subtilis*] [DB:genpept-bct1] [DE:*B. subtilis*
chromosomal DNA (region 320–321 degrees).] [SP:P13242] [LE:9480] [RE:11087]
[DI:direct] >gp:[GI:e1186216:g2636252] [LN:BSUB0020] [AC:Z99123:AL009126]
[PN:CTP synthetase] [GN:ctrA] [FN:pyrimidine biosynthesis] [OR:*Bacillus
subtilis*] [DB:genpept-bct1] [EC:6.3.4.2] [DE:*Bacillus subtilis* complete
genome (section 20 of 21) from 3798401 to 4010550.] [NT:alternate gene name:
pyrG] [SP:P13242] [LE:11346] [RE:12953] [DI:complement]

| ORF Name | NT ID | AA ID | NT LN | AA LN | Score | P-Value |
|---|---|---|---|---|---|---|
| AI7503000979_14454660_f1_26 | 20 | 3792 | 138 | 45 | | |

Description
NO-HIT

| ORF Name | NT ID | AA ID | NT LN | AA LN | Score | P-Value |
|---|---|---|---|---|---|---|
| AI7503000979_14492142_f1_81 | 21 | 3793 | 126 | 41 | | |

Description
NO-HIT

| ORF Name | NT ID | AA ID | NT LN | AA LN | Score | P-Value |
|---|---|---|---|---|---|---|
| AI7503000979_14634450_f2_208 | 22 | 3794 | 171 | 56 | 52 | 0.029 |

Description
pir:[LN:H71683] [AC:H71683] [PN:hypothetical protein RP285] [GN:RP285]
[OR:*Rickettsia prowazekii*] [DB:pir2] >gp:[GI:e1342590:g3860846] [LN:RPXX02]
[AC:AJ235271:AJ235269] [PN:unknown] [GN:RP285] [OR:*Rickettsia prowazekii*]
[DB:genpept-bct1] [DE:*Rickettsia prowazekii* strain Madrid E, complete
genome; segment 2/4.] [LE:68773] [RE:69213] [DI:complement]

| ORF Name | NT ID | AA ID | NT LN | AA LN | Score | P-Value |
|---|---|---|---|---|---|---|
| AI7503000979_14849093_c3_469 | 23 | 3795 | 294 | 97 | 133 | 6.0e-09 |

Description
pir:[LN:F71245] [AC:F71245] [PN:hypothetical protein PHS004] [GN:PHS004]
[OR:*Pyrococcus horikoshii*] [DB:pir2] >gp:[GI:d1030236:g3256610] [LN:AP000001]
[AC:AP000001:AB009465:AB009464:AB009466:AB009467:AB009468:AB009469] [PN:58aa
long hypothetical protein] [GN:PHS004] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1-287000 nt. position (1/7).] [NT:similar to
GENPEPT:Z47547 percent identity:50.000] [LE:195255] [RE:195431] [DI:direct]

| ORF Name | NT ID | AA ID | NT LN | AA LN | Score | P-Value |
|---|---|---|---|---|---|---|
| AI7503000979_14855051_c1_401 | 24 | 3796 | 471 | 156 | 409 | 3.4e-38 |

Description
pir:[LN:H69773] [AC:H69773] [PN:conserved hypothetical protein ydcK]
[GN:ydcK] [CL:hypothetical protein HI1173] [OR:*Bacillus subtilis*] [DB:pir2]
>gp:[GI:d1020070:g1881290] [LN:AB001488] [AC:AB001488] [GN:ydcK]
[OR:*Bacillus subtilis*] [SR:*Bacillus subtilis* (strain:168) DNA]
[DB:genpept-bct1] [DE:*Bacillus subtilis* genome sequence, 148 kb sequence of
the region between 35 and 47 degree.] [NT:FUNCTION UNKNOWN.] [LE:61365]

-continued

[RE:61817] [DI:direct] >gp:[GI:e1182445:g2632779] [LN:BSUB0003]
[AC:Z99106:AL009126] [GN:ydcK] [FN:unknown] [OR:*Bacillus subtilis*]
[DB:genpept-bct1] [DE:*Bacillus subtilis* complete genome (section 3 of 21)
from 402751 to 611850.] [NT:similar to hypothetical proteins] [LE:125110]
[RE:125562] [DI:direct]

| ORF Name | NT ID | AA ID | NT LN | AA LN | Score | P-Value |
|---|---|---|---|---|---|---|
| AI7503000979__15798901__c3__471 | 25 | 3797 | 123 | 40 | | |

Description
NO-HIT

| ORF Name | NT ID | AA ID | NT LN | AA LN | Score | P-Value |
|---|---|---|---|---|---|---|
| AI7503000979__16251305__c3__501 | 26 | 3798 | 786 | 261 | 724 | 1.4e-71 |

Description
sp:[LN:ATP6_BACST] [AC:P42010] [GN:ATPB] [OR:*BACILLUS STEAROTHERMOPHILUS*]
[EC:3.G.1.34] [DE:ATP SYNTHASE A CHAIN, (PROTEIN 6)] [SP:P42010]
[DB:swissprot] >gp:[GI:d1007828:g534857] [LN:BACATPSAC] [AC:D38059]
[PN:ATPase subunit a] [OR:*Bacillus stearothermophilus*] [SR:*Bacillus
stearothermophilus* (strain IFO1035) (library:library o] [DB:genpept-bct1]
[DE:*Bacillus stearothermophilus* genes for ATPase subunits a and c, complete
cds.] [LE:256] [RE:966] [DI:direct]

| ORF Name | NT ID | AA ID | NT LN | AA LN | Score | P-Value |
|---|---|---|---|---|---|---|
| AI7503000979__165888__f3__321 | 27 | 3799 | 156 | 51 | | |

Description
NO-HIT

| ORF Name | NT ID | AA ID | NT LN | AA LN | Score | P-Value |
|---|---|---|---|---|---|---|
| AI7503000979__19693831__c1__350 | 28 | 3800 | 165 | 54 | | |

Description
NO-HIT

| ORF Name | NT ID | AA ID | NT LN | AA LN | Score | P-Value |
|---|---|---|---|---|---|---|
| AI7503000979__19728433__f2__133 | 29 | 3801 | 1215 | 404 | 691 | 4.4e-68 |

Description
sp:[LN:YWCF_BACSU] [AC:P39604] [GN:YWCF:IPA-42D] [OR:*BACILLUS SUBTILIS*]
[DE:HYPOTHETICAL 43.3 KD PROTEIN IN QOXD-VPR INTERGENIC REGION] [SP:P39604]
[DB:swissprot] >pir:[LN:S39697] [AC:S39697:A70053] [PN:cell-division
protein homolog ywcF:protein ipa-42d] [GN:ywcF] [OR:*Bacillus subtilis*]
[DB:pir2] >gp:[GI:g413966] [LN:BSGENR] [AC:X73124] [GN:ipa-42d] [OR:*Bacillus
subtilis*] [DB:genpept-bct1] [DE:*B. subtilis* genomic region (325 to 333).]
[SP:P39604] [LE:44053] [RE:45234] [DI:direct] >gp:[GI:e1186311:g2636347]
[LN:BSUB0020] [AC:Z99123:AL009126] [GN:ywcF] [FN:unknown] [OR:*Bacillus
subtilis*] [DB:genpept-bct1] [DE:*Bacillus subtilis* complete genome (section
20 of 21): from 3798401 to 4010550.] [NT:alternate gene name:ipa-42d;
similar to] [SP:P39604] [LE:112728] [RE:113909] [DI:complement]

| ORF Name | NT ID | AA ID | NT LN | AA LN | Score | P-Value |
|---|---|---|---|---|---|---|
| AI7503000979__19739675__c3__494 | 30 | 3802 | 636 | 211 | 638 | 1.8e-62 |

Description
sp:[LN:KITH_BACSU] [AC:Q03221] [GN:TDK] [OR:*BACILLUS SUBTILIS*] [EC:2.7.1.21]
[DE:THYMIDINE KINASE,] [SP:Q03221] [DB:swissprot] >pir:[LN:S55432]
[AC:S55432:D69721] [PN:thymidine kinase, tdk] [GN:tdk] [CL:thymidine
kinase] [OR:*Bacillus subtilis*] [EC:2.7.1.21] [DB:pir2] >gp:[GI:g405819]
[LN:BACRHOTDKX] [AC:M97678] [PN:thymidine kinase] [GN:tdk] [OR:*Bacillus
subtilis*] [SR:*Bacillus subtilis* (Transposon Tn917 insertional library) DNA]
[DB:genpept-bct1] [DE:*Bacillus subtilis* OrfR, 3' end; OrfQ; transcriptional
terminator(rho) gene; ribosomal protein L31; thymidine kinase (tdk)
gene, complete cds.] [NT:Incorrect sequence given in Quirk et al. citation,]
[LE:3334] [RE:39211] [DI:direct] >gp:[GI:g853771] [LN:BSDNA320D] [AC:Z49782]
[PN:thymidine kinase] [GN:tdk] [OR:*Bacillus subtilis*] [DB:genpept-bct1]
[DE:*B. subtilis* chromosomal DNA (region 320–321 degrees).] [SP:Q03221]
[LE:18786] [RE:19373] [DI:direct] >gp:[GI:e1184612:g2636231] [LN:BSUB0019]
[AC:Z99122:AL009126] [PN:thymidine kinase] [GN:tdk] [OR:*Bacillus subtilis*]
[DB:genpept-bct1] [EC:2.7.1.21] [DE:*Bacillus subtilis* complete genome
(section 19 of 21): from 3597091 to 3809700.] [SP:Q03221] [LE:204370]
[RE:204957] [DI:complement] >gp:[GI:e1186207:g2636243] [LN:BSUB0020]

-continued

[AC:Z99123:AL009126] [PN:thymidine kinase] [GN:tdk] [OR:*Bacillus subtilis*]
[DB:genpept-bct1] [EC:2.7.1.21] [DE:*Bacillus subtilis* complete genome
(section 20 of 21): from 3798401 to 4010550.] [SP:Q03221] [LE:3060] [RE:3647]
[DI:complement] >gp:[GI:e1184612:g2636231] [LN:BSUB0019]
[AC:Z99122:AL009126] [PN:thymidine kinase] [GN:tdk] [OR:*Bacillus subtilis*]
[DB:genpept] [EC:2.7.1.21] [DE:*Bacillus subtilis* complete genome (section 19
of 21): from 3597091 to 3809700.] [SP:Q03221] [LE:204370] [RE:204957]
[DI:complement]

| ORF Name | NT ID | AA ID | NT LN | AA LN | Score | P-Value |
|---|---|---|---|---|---|---|
| AI7503000979_20032527_f2_127 | 31 | 3803 | 165 | 54 | | |

Description
NO-HIT

| ORF Name | NT ID | AA ID | NT LN | AA LN | Score | P-Value |
|---|---|---|---|---|---|---|
| AI7503000979_20156686_c3_498 | 32 | 3804 | 573 | 190 | 415 | 7.8e-39 |

Description
sp:[LN:YWLG_BACSU] [AC:P39157] [GN:YWLG:IPC-33D] [OR:*BACILLUS SUBTILIS*]
[DE:HYPOTHETICAL 19.4 KD PROTEIN IN SPOIIR-GLYC INTERGENIC REGION]
[SP:P39157] [DB:swissprot] >pir:[LN:I40482] [AC:I40482:D70062:S49362]
[PN:hypothetical protein ywlG:ipc-33d protein] [GN:ywlG-ipc-33d
[OR:*Bacillus subtilis*] [DB:pir2] >gp:[GI:g556885] [LN:BSSPORUPP] [AC:Z38002]
[PN:Unknown] [GN:ipc-33d] [OR:*Bacillus subtilis*] [DB:genpept-bct1]
[DE:*B. subtilis* spoII-R, glyc and upp genes.] [SP:P39157] [LE:4750] [RE:5292]
[DI:direct] >gp:[GI:e1184597:g2636216] [LN:BSUB0019] [AC:Z99122:AL009126]
[GN:ywlG] [FN:unknown] [OR:*Bacillus subtilis*] [DB:genpept-bct1] [DE:*Bacillus
subtilis* complete genome (section 19 of 21): from 3597091 to 3809700.]
[NT:alternate gene name:ipc-33d] [SP:P39157] [LE:192609] [RE:193151]
[DI:complement] >gp:[GI:e1184597:g2636216] [LN:BSUB0019]
[AC:Z99122:AL009126] [GN:ywlG] [FN:unknown] [OR:*Bacillus subtilis*]
[DB:genpept] [DE:*Bacillus subtilis* complete genome (section 19 of 21): from
3597091 to 3809700.] [NT:alternate gene name:ipc-33d] [SP:P39157]
[LE:192609] [RE:193151] [DI:complement]

| ORF Name | NT ID | AA ID | NT LN | AA LN | Score | P-Value |
|---|---|---|---|---|---|---|
| AI7503000979_20348453_c3_518 | 33 | 3805 | 1587 | 528 | 1226 | 9.0e-125 |

Description
gp:[GI:g4409804] [LN:AF091502] [AC:AF091502] [PN:autoaggregation-mediating
protein] [GN:aggH] [OR:*Lactobacillus reuteri*] [DB:genpept-bct2]
[DE:*Lactobacillus reuteri* autoaggregation-mediating protein (aggH)gene,
complete cds.] [NT:AggH; putative extracellular DEAD-box RNA helicase]
[LE:181] [RE:1674] [DI:direct]

| ORF Name | NT ID | AA ID | NT LN | AA LN | Score | P-Value |
|---|---|---|---|---|---|---|
| AI7503000979_20360687_c3_516 | 34 | 3806 | 141 | 46 | | |

Description
NO-HIT

| ORF Name | NT ID | AA ID | NT LN | AA LN | Score | P-Value |
|---|---|---|---|---|---|---|
| AI7503000979_20569052_c2_457 | 35 | 3807 | 327 | 108 | 198 | 7.8e-16 |

Description
pir:[LN:G70041] [AC:G70041] [PN:conserved hypothetical protein yvgZ]
[GN:yvgZ] [OR:*Bacillus subtilis*] [DB:pir2] >gp:[GI:e1186040:g2635865]
[LN:BSUB0018] [AC:Z99121:AL009126] [GN:yvgZ] [FN:unknown] [OR:*Bacillus
subtilis*] [DB:genpept-bct1] [DE:*Bacillus subtilis* complete genome (section
18 of 21): from 3399551 to 3609060.] [NT:similar to hypothetical proteins]
[LE:43408] [RE:43713] [DI:complement)

| ORF Name | NT ID | AA ID | NT LN | AA LN | Score | P-Value |
|---|---|---|---|---|---|---|
| AI7503000979_20572255_f1_34 | 36 | 3808 | 207 | 68 | | |

Description
NO-HIT

| ORF Name | NT ID | AA ID | NT LN | AA LN | Score | P-Value |
|---|---|---|---|---|---|---|
| AI7503000979_20900062_f2_215 | 37 | 3809 | 147 | 48 | 53 | 0.045 |

-continued

Description
gp:[GI:g1086838] [LN:CELF10E7] [AC:U41264] [GN:F10E7.2] [OR:*Caenorhabditis elegans*] [SR:*Caenorhabditis elegans* strain = Bristol N2] [DB:genpept-inv1] [DE:*Caenorhabditis elegans* cosmid F10E7.] [NT:also contains weak similarity to a C2H2-type zinc] [LE:21609:21709:23024:23277] [RE:21661:21796:23149:23753] [DI:directJoin]

| ORF Name | NT ID | AA ID | NT LN | AA LN | Score | P-Value |
|---|---|---|---|---|---|---|
| AI7503000979_2117125_c2_432 | 38 | 3810 | 129 | 42 | | |

Description
NO-HIT

| ORF Name | NT ID | AA ID | NT LN | AA LN | Score | P-Value |
|---|---|---|---|---|---|---|
| AI7503000979_2125637_f3_335 | 39 | 3811 | 150 | 49 | | |

Description
NO-HIT

| ORF Name | NT ID | AA ID | NT LN | AA LN | Score | P-Value |
|---|---|---|---|---|---|---|
| AI7503000979_21517182_f3_322 | 40 | 3812 | 375 | 124 | 396 | 8.1e-37 |

Description
gp:[GI:d1037674:g4126673] [LN:AB016431] [AC:AB016431] [GN:CzrA] [FN:repressor] [OR:*Staphylococcus aureus*] [SR:*Staphylococcus aureus* (strain:912) DNA] [DB:genpept-bct1] [DE:*Staphylococcus aureus*, zinc responsible operon czr genes, complete and partial cds.] [LE:1703] [RE:2023] [DI:complement] >gp:[GI:g3445566] [LN:AF044951] [AC:AF044951] [PN:repressor protein] [GN:rzcA] [FN:zinc and cobalt transport repressor] [OR:*Staphylococcus aureus*] [DB:genpept-bct2] [DE:*Staphylococcus aureus* repressor protein (rzcA) and transportprotein (rzcB) genes, complete cds.] [LE:193] [RE:513] [DI:direct]

| ORF Name | NT ID | AA ID | NT LN | AA LN | Score | P-Value |
|---|---|---|---|---|---|---|
| AI7503000979_21562827_f3_306 | 41 | 3813 | 132 | 43 | | |

Description
NO-HIT

| ORF Name | NT ID | AA ID | NT LN | AA LN | Score | P-Value |
|---|---|---|---|---|---|---|
| AI7503000979_21756937_c1_379 | 42 | 3814 | 672 | 223 | 401 | 2.4e-37 |

Description
sp:[LN:THIE_BACSU] [AC:P39594] [GN:THIE:THIC:IPA-26D] [OR:*BACILLUS SUBTILIS*] [EC:2.5.1.3] [DE:PYROPHOSPHORYLASE) (TMP-PPASE) (THIAMIN-PHOSPHATE SYNTHASE)] [SP:P39594] [DB:swissprot] >pir:[LN:S39681] [AC:S39681:E69722] [PN:thiamin-phosphate pyrophosphorylase, thiC:protein ipa-26d] [GN:thiC] [CL:thiE protein:thiamin-phosphate pyrophosphorylase homology] [OR:*Bacillus subtilis*] [EC:2.5.1.3] [DB:pir2] >gp:[GI:g413950] [LN:BSGENR] [AC:X73124] [GN:ipa-26d] [OR:*Bacillus subtilis*] [DB:genpept-bct1] [DE:*B. subtilis* genomic region (325 to 333).] [SP:P39594] [LE:26188] [RE:26856] [DI:direct] >gp:[GI:e1186328:g2636364] [LN:BSUB0020] [AC:Z99123:AL009126] [PN:thiamine-phosphate pyrophosphorylase] [GN:thiC] [FN:substitution of the pyrophosphate of] [OR:*Bacillus subtilis*] [DB:genpept-bct1] [EC:2.5.1.3] [DE:*Bacillus subtilis* complete genome (section 20 of 21): from 3798401 to 4010550.] [NT:alternate gene name:ipa-26d, ywbK] [SP:P39594] [LE:131103] [RE:131771] [DI:complement]

| ORF Name | NT ID | AA ID | NT LN | AA LN | Score | P-Value |
|---|---|---|---|---|---|---|
| AI7503000979_2230303_f3_265 | 43 | 3815 | 669 | 222 | 346 | 1.6e-31 |

Description
sp:[LN:YPGQ_BACSU] [AC:P54168] [GN:YPGQ] [OR:*BACILLUS SUBTILIS*] [DE:HYPOTHETICAL 23.1 KD PROTEIN IN BSAA-ILVD INTERGENIC REGION] [SP:P54168] [DB:swissprot] >pir:[LN:E69935] [AC:E69935] [PN:conserved hypothetical protein ypgQ] [GN:ypgQ] [CL:conserved hypothetical protein AF0994] [OR:*Bacillus subtilis*] [DB:pir2] >gp:[GI:g1256633] [LN:BACYACA] [AC:L77246] [GN:ypgQ] [OR:*Bacillus subtilis*] [DB:genpept-bct1] [DE:*Bacillus subtilis* (YAC10-9 clone) DNA region between the serA and kdg loci.] [NT:putative] [LE:16914] [RE:17531] [DI:direct] >gp:[GI:e1183636:g2634609] [LN:BSUB0012] [AC:Z99115:AL009126] [GN:ypgQ] [FN:unknown] [OR:*Bacillus subtilis*] [DB:genpept-bct1] [DE:*Bacillus subtilis* complete genome (section 12 of 21): from 2195541 to 2409220.] [NT:similar to hypothetical proteins] [SP:P54168]

-continued

[LE:107621] [RE:108238] [DI:complement]

| ORF Name | NT ID | AA ID | NT LN | AA LN | Score | P-Value |
|---|---|---|---|---|---|---|
| AI7503000979__22460882__c3__482 | 44 | 3816 | 687 | 228 | 612 | 1.0e-59 |

Description
gp:[GI:e1191863:g809660] [LN:BSDNPOP] [AC:X82174] [PN:deoxyribose-phosphate aldolase] [GN:dra] [OR:*Bacillus subtilis*] [DB:genpept-bct1] [EC:4.1.2.4] [DE:*B. subtilis* operon contg. dra, nupC and pdp genes.] [SP:P39121] [LE:1462] [RE:2106] [DI:direct]

| ORF Name | NT ID | AA ID | NT LN | AA LN | Score | P-Value |
|---|---|---|---|---|---|---|
| AI7503000979__22692137__c2__464 | 45 | 3817 | 486 | 161 | 688 | 9.2e-68 |

Description
gp:[GI:e279934:g1934990] [LN:SASIGFACB] [AC:Y07645] [GN:rsbW] [OR:*Staphylococcus aureus*] [DB:genpept-bct1] [DE:*S. aureus* sigB gene.] [LE:2220] [RE:2699] [DI:direct] >gp:[GI:e284999:g1729796] [LN:SAUSIGB] [AC:Y09929] [GN:rsbW] [OR:*Staphylococcus aureus*] [DB:genpept-bct1] [DE:*S. aureus* rsbU, rsbV, rsbW & sigB genes.] [LE:2233] [RE:2712] [DI:direct]

| ORF Name | NT ID | AA ID | NT LN | AA LN | Score | P-Value |
|---|---|---|---|---|---|---|
| AI7503000979__23437803__c3__523 | 46 | 3818 | 2187 | 728 | 1827 | 1.9e-188 |

Description
gp:[GI:e279936:g1934992] [LN:SASIGFACB] [AC:Y07645] [GN:ORF6] [OR:*Staphylococcus aureus*] [DB:genpept-bct1] [DE:*S. aureus* sigB gene.] [LE:3878] [RE:>5272] [DI:direct]

| ORF Name | NT ID | AA ID | NT LN | AA LN | Score | P-Value |
|---|---|---|---|---|---|---|
| AI7503000979__23439002__c2__417 | 47 | 3819 | 1404 | 467 | | |

Description
NO-HIT

| ORF Name | NT ID | AA ID | NT LN | AA LN | Score | P-Value |
|---|---|---|---|---|---|---|
| AI7503000979__23446887__f3__323 | 48 | 3820 | 1155 | 384 | 548 | 6.3e-53 |

Description
gp:[GI:g4097757] [LN:SAU67965] [AC:U67965] [PN:lytic regulatory protein] [OR:*Staphylococcus aureus*] [DB:genpept-bct2] [DE:*Staphylococcus aureus* lytic regulatory protein gene, complete cds.] [LE:712] [RE:1824] [DI:direct]

| ORF Name | NT ID | AA ID | NT LN | AA LN | Score | P-Value |
|---|---|---|---|---|---|---|
| AI7503000979__23594057__c1__362 | 49 | 3821 | 183 | 60 | | |

Description
NO-HIT

| ORF Name | NT ID | AA ID | NT LN | AA LN | Score | P-Value |
|---|---|---|---|---|---|---|
| AI7503000979__23595137__c3__480 | 50 | 3822 | 501 | 166 | 423 | 1.1e-39 |

Description
pir:[LN:H69618] [AC:H69618] [PN:Stress- and starvation-induced gene controlled by sigma-B dps] [GN:dps] [CL:hypothetical protein HI1349] [OR:*Bacillus subtilis*] [DB:pir2] >gp:[GI:e1185938:g2635549] [LN:BSUB0016] [AC:Z99912.9:AL009126] [GN:dps] [OR:*Bacillus subtilis*] [DB:genpept-bct1] [DE:*Bacillus subtilis* complete genome (section 16 of 21): from 2997771 to 3213410.] [NT:alternate gene name:ytkB; stress- and] [SP:P80879] [LE:137548] [RE:137985] [DI:complement] >gp:[GI:g2293159] [LN:AF008220] [AC:AF008220] [GN:ytkB] [OR:*Bacillus subtilis*] [DB:genpept-bct2] [DE:*Bacillus subtilis* rrnB-dnaB genomic region.] [NT:similarity to HI1349 from H. influenzae] [LE:42442] [RE:42879] [DI:direct]

| ORF Name | NT ID | AA ID | NT LN | AA LN | Score | P-Value |
|---|---|---|---|---|---|---|
| AI7503000979__23625008__c1__347 | 51 | 3823 | 963 | 320 | 749 | 3.2e-74 |

Description
gp:[GI:d1039089:g4512388] [LN:AB011838] [AC:AB011838] [PN:mannnose-6 phospate isomerase] [GN:ydhS] [OR:*Bacillus halodurans*] [SR:*Bacillus halodurans* (strain:C-125) DNA, clone__lib:lambda no.] [DB:genpept-bct1]

-continued

[EC:5.3.1.8] [DE:*Bacillus halodurans* C-125 genomic DNA, 6A fragment, clone ALBAC004.] [NT:similar to *B. subtilis* ydhS gene (53–69% identity)] [LE:7672] [RE:8619] [DI:direct]

| ORF Name | NT ID | AA ID | NT LN | AA LN | Score | P-Value |
|---|---|---|---|---|---|---|
| AI7503000979_23625387_c1_402 | 52 | 3824 | 219 | 72 | | |

Description
NO-HIT

| ORF Name | NT ID | AA ID | NT LN | AA LN | Score | P-Value |
|---|---|---|---|---|---|---|
| AI7503000979_23634678_c2_424 | 53 | 3825 | 1194 | 397 | | |

Description
NO-HIT

| ORF Name | NT ID | AA ID | NT LN | AA LN | Score | P-Value |
|---|---|---|---|---|---|---|
| AI7503000979_23634702_c2_453 | 54 | 3826 | 792 | 263 | 498 | 1.3e-47 |

Description
sp:[LN:THIM_BACSU] [AC:P39593] [GN:THIM:THIK:IPA-25D] [OR:*BACILLUS SUBTILIS*]
[EC:2.7.1.50] [DE:HYDROXYETHYLTHIAZOLE KINASE) (THZ KINASE) (TH KINASE)]
[SP:P39593] [DB:swissprot] >pir:[LN:S39680] [AC:S39680:G69722]
[PN:hydroxyethylthiazole kinase, thiK:protein ipa-25d] [GN:thiK]
[CL:hydroxyethylthiazole kinase:hydroxyethylthiazole kinase homology]
[OR:*Bacillus subtilis*] [EC:2.7.1.50] [DB:pir2] >gp:[GI:g413949] [LN:BSGENR]
[AC:X73124] [GN:ipa-25d] [OR:*Bacillus subtilis*] [DB:genpept-bct1]
[DE:*B. subtilis* genomic region (325 to 333).] [SP:P39593] [LE:25373]
[RE:26191] [DI:direct] >gp:[GI:e1186329:g2636365] [LN:BSUB0020]
[AC:Z99123:AL009126] [PN:hydroxyethylthiazole kinase] [GN:thiK]
[FN:phosphorylation of] [OR:*Bacillus subtilis*] [DB:genpept-bct1]
[EC:2.7.1.50] [DE:*Bacillus subtilis* complete genome (section 20 of 21): from
3798401 to 4010550.] [NT:alternate gene name:ipa-25d, ywbJ] [SP:P39593]
[LE:1317681] [RE:132586] [DI:complement]

| ORF Name | NT ID | AA ID | NT LN | AA LN | Score | P-Value |
|---|---|---|---|---|---|---|
| AI7503000979_23651702_c1_343 | 55 | 3827 | 870 | 289 | 255 | 7.1e-22 |

Description
pir:[LN:C70070] [AC:C70070] [PN:conserved hypothetical protein ywtE]
[GN:ywtE] [CL:hypothetical protein ywpJ] [OR:*Bacillus subtilis*] [DB:pir2]
>gp:[GI:e1184491:g2636110] [LN:BSUB0019] [AC:Z99122:AL009126] [GN:ywtE]
[FN:unknown] [OR:*Bacillus subtilis*] [DB:genpept-bct1] [DE:*Bacillus subtilis*
complete genome (section 19 of 21): from 3597091 to 3809700.] [NT:similar to
hypothetical proteins] [LE:97330] [RE:98190] [DI:direct]
>gp:[GI:e308093:g1894770] [LN:BSZ92954] [AC:Z92954] [GN:ywtE] [OR:*Bacillus
subtilis*] [DB:genpept-bct1] [DE:*B. subtilis* yws[A,B,C,D,E,F,G] and gerBC
genes.] [NT:product similar to *Bacillus subtilis* YxeH and YcsE] [LE:4292]
[RE:5152] [DI:complement] >gp:[GI:e1184491:g2636110] [LN:BSUB0019]
[AC:Z99122:AL009126] [GN:ywtE] [FN:unknown] [OR:*Bacillus subtilis*]
[DB:genpept] [DE:*Bacillus subtilis* complete genome (section 19 of 21): from
3597091 to 3809700.] [NT:similar to hypothetical proteins] [LE:97330]
[RE:98190] [DI:direct]

| ORF Name | NT ID | AA ID | NT LN | AA LN | Score | P-Value |
|---|---|---|---|---|---|---|
| AI7503000979_23711642_c1_397 | 56 | 3828 | 1026 | 341 | 1445 | 5.6e-148 |

Description
gp:[GI:e284997:g1729794] [LN:SAUSIGB] [AC:Y09929] [GN:rsbU]
[OR:*Staphylococcus aureus*] [DB:genpept-bct1] [DE:*S. aureus* rsbU, rsbV, rsbW &
sigB genes.] [LE:784] [RE:1785] [DI:direct]

| ORF Name | NT ID | AA ID | NT LN | AA LN | Score | P-Value |
|---|---|---|---|---|---|---|
| AI7503000979_2379658_f2_237 | 57 | 3829 | 225 | 74 | | |

Description
NO-HIT

| ORF Name | NT ID | AA ID | NT LN | AA LN | Score | P-Value |
|---|---|---|---|---|---|---|
| AI7503000979_2383253_c2_405 | 58 | 3830 | 399 | 132 | | |

Description

-continued

NO-HIT

| ORF Name | NT ID | AA ID | NT LN | AA LN | Score | P-Value |
|---|---|---|---|---|---|---|
| AI7503000979__24015687__c2__438 | 59 | 3831 | 465 | 154 | 119 | 1.8e-07 |

Description
sp:[LN:ATPZ__BACP3] [AC:P09354] [OR:*BACILLUS* PS3] [SR:,THERMOPHILIC BACTERIUM PS-3] [DE:ATP SYNTHASE PROTEIN I] [SP:P09354] [DB:swissprot] >pir:[LN:S01397] [AC:S01397] [PN:H+-transporting ATP synthase, chain I] [CL:*Bacillus* H+-transporting ATP synthase chain I] [OR:thermophilic bacterium PS-3] [EC:3.6.1.34] [DB:pir2] >gp:[GI:g458091] [LN:PS3TF0F1] [AC:X07804:X07374] [OR:thermophilic bacterium PS3] [DB:genpept-bct1] [DE:Thermophilic bacterium PS3 TF0F-1 operon for ATP synthase complex.] [NT:I protein (AA 1–127)] [SP:P09354] [LE:433] [RE:816] [DI:direct]

| ORF Name | NT ID | AA ID | NT LN | AA LN | Score | P-Value |
|---|---|---|---|---|---|---|
| AI7503000979__24074137__c3__492 | 60 | 3832 | 1332 | 443 | 1360 | 5.7e-139 |

Description
gp:[GI:g143434] [LN:BACRHOTDKX] [AC:M97678] [PN:Rho Factor] [GN:rho] [FN:transcriptional terminator] [OR:*Bacillus subtilis*] [SR:*Bacillus subtilis* (Transposon Tn917 insertional library) DNA] [DB:genpept-bct1] [DE:*Bacillus subtilis* OrfR, 3' end; OrfQ; transcriptional terminator (rho) gene; ribosomal protein L31; thymidine kinase (tdk) gene,complete cds.] [LE:1643] [RE:2926] [DI:direct]

| ORF Name | NT ID | AA ID | NT LN | AA LN | Score | P-Value |
|---|---|---|---|---|---|---|
| AI7503000979__24228411__c1__375 | 61 | 3833 | 399 | 132 | 358 | 8.6e-33 |

Description
gp:[GI:g2735512] [LN:SCU96108] [AC:U96108] [PN:single-strand binding protein homolog] [GN:ssb] [OR:*Staphylococcus carnosus*] [DB:genpept-bct2] [DE:*Staphylococcus carnosus* (3R)-hydroxymyristoyl acyl carrier proteindehydrase homolog (fabZ) gene, partial cds, YwpF homolog, single-strand binding protein homolog (ssb), SceD precursor (sceD), SceA precursor (sceA) and SceE precursor (sceE) genes, complete cds, and TenA homolog (tenA) gene, partial cds.] [NT:SSB] [LE:857] [RE:1294] [DI:direct]

| ORF Name | NT ID | AA ID | NT LN | AA LN | Score | P-Value |
|---|---|---|---|---|---|---|
| AI7503000979__24235952__c1__398 | 62 | 3834 | 327 | 108 | 501 | 6.0e-48 |

Description
gp:[GI:e284998:g1729795] [LN:SAUSIGB] [AC:Y09929] [GN:rsbV] (OR:*Staphylococcus aureus*] [DB:genpept-bct1] [DE:*S. aureus* rsbU, rsbV, rsbW & sigB genes.] [LE:1905] [RE:2231] [DI:direct]

| ORF Name | NT ID | AA ID | NT LN | AA LN | Score | P-Value |
|---|---|---|---|---|---|---|
| AI7503000979__24245327__c1__364 | 63 | 3835 | 714 | 237 | 843 | 3.5e-84 |

Description
gp:[GI:e258331:g1765902] [LN:BCUPPGLYA] [AC:X99545] [PN:uracil phosphoribosyltransferase] [GN:upp] [OR:*Bacillus caldolyticus*] [DB:genpept-bct1] [DE:*B. caldolyticus* upp gene.] [SP:P70881] [LE:431] [RE:1060] [DI:direct]

| ORF Name | NT ID | AA ID | NT LN | AA LN | Score | P-Value |
|---|---|---|---|---|---|---|
| AI7503000979__24254202__c1__368 | 64 | 3836 | 1512 | 503 | 2050 | 4.3e-212 |

Description
sp:[LN:ATPA__BACME] [AC:P17674] [GN:ATPA] [OR:*BACILLUS MEGATERIUM*] [EC:3.6.1.34] [DE:ATP SYNTHASE ALPHA CHAIN,] [SP:P17674] [DB:swissprot] >pir:[LN:F31482] [AC:F31482] [PN:H+-transporting ATP synthase, alpha chain] [CL:H+-transporting ATP synthase alpha chain:H+-transporting ATP synthase alpha chain homology] [OR:*Bacillus megaterium*] [EC:3.6.1.34] [DB:pir2] >gp:[GI:g142559] [LN:BACATPA] [AC:M20255:J04455:M18352:M23924] [PN:ATP synthase alpha subunit] [OR:*Bacillus megaterium*] [SR:*B. megaterium* (QM B1551) DNA, clones pWSB100, pCAH1.3, and pWPC208] [DB:genpept-bct1] [DE:*B. megaterium* ATP synthase i, a, c, b, delta, alpha, gamma, beta and epsilon subunit genes, complete cds, and ORF.] [LE:2853] [RE:4361] [DI:direct]

| ORF Name | NT ID | AA ID | NT LN | AA LN | Score | P-Value |
|---|---|---|---|---|---|---|
| AI7503000979__24256562__c1__381 | 65 | 3837 | 126 | 41 | | |

-continued

| ORF Name | NT ID | AA ID | NT LN | AA LN | Score | P-Value |
|---|---|---|---|---|---|---|
| AI7503000979_24350953_f1_2 | 66 | 3838 | 132 | 43 | 72 | 0.017 |

Description
NO-HIT

| ORF Name | NT ID | AA ID | NT LN | AA LN | Score | P-Value |
|---|---|---|---|---|---|---|
| AI7503000979_24350953_f1_2 | 66 | 3838 | 132 | 43 | 72 | 0.017 |

Description
pir:[LN:G71244] [AC:G71244] [PN:hypothetical protein PH0217] [GN:PH0217]
[OR:*Pyrococcus horikoshii*] [DB:pir2] >gp:[GI:d1030229:g3256603]
[LN:AP 000001]
[AC:AP000001:AB009465:AB009464:AB009466:AB009467:AB009468:AB009469]
[PN:106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1-287000 nt. position (1/7).] [LE:191072]
[RE:191392] [DI:complement]

| ORF Name | NT ID | AA ID | NT LN | AA LN | Score | P-Value |
|---|---|---|---|---|---|---|
| AI7503000979_24353427_c3_503 | 67 | 3839 | 543 | 180 | 229 | 4.0e-19 |

Description
sp:[LN:ATPD_BACSU] [AC:P37811] [GN:ATPH] [OR:*BACILLUS SUBTILIS*]
[EC:3.G.1.34] [DE:ATP SYNTHASE DELTA CHAIN,] [SP:P37811] [DB:swissprot]
>pir:[LN:I40365] [AC:I40365:D69592:S39253] [PN:H+-transporting ATP
synthase, delta chain (atpH)] [GN:atpH] [CL:H+-transporting ATP synthase
delta chain] [OR:*Bacillus subtilis*] [EC:3.6.1.34] [DB:pir2] >gp:[GI:g433988]
[LN:BSATPASE] [AC:Z28592] [PN:ATP synthase subunit delta] [GN:atpH]
[OR:*Bacillus subtilis*] [DB:genpept-bct1] [DE:*B. subtilis*(168) atpase genes
for ATP synthase subunits i, a, c ,b, delta, alpha, gamma, beta, epsilon.]
[SP:P37811] [LE:2484] [RE:3029] [DI:direct] >gp:[GI:e1184590:g2636209]
[LN:BSUB0019] [AC:Z99122:AL009126] [PN:ATP synthase (subunit delta)]
[GN:atpH] [OR:*Bacillus subtilis*] [DB:genpept-bct1] [EC:3.6.1.34]
[DE:*Bacillus subtilis* complete genome (section 19 of 21): from 3597091 to
3809700.] [SP:P37811] [LE:187368] [RE:187913] [DI:complement]
>gp:[GI:e1184590:g2636209] [LN:BSUB0019] [AC:Z99122:AL009126] [PN:ATP
synthase (subunit delta)] [GN:atpH] [OR:*Bacillus subtilis*] [DB:genpept]
[EC:3.6.1.34] [DE:*Bacillus subtilis* complete genome (section 19 of 21): from
3597091 to 3809700.] [SP:P37811] [LE:187368] [RE:187913] [DI:complement]

| ORF Name | NT ID | AA ID | NT LN | AA LN | Score | P-Value |
|---|---|---|---|---|---|---|
| AI7503000979_24392193_c1_346 | 68 | 3840 | 204 | 67 | | |

Description
NO-HIT

| ORF Name | NT ID | AA ID | NT LN | AA LN | Score | P-Value |
|---|---|---|---|---|---|---|
| AI7503000979_24406260_c2_433 | 69 | 3841 | 1296 | 431 | 1258 | 3.7e-128 |

Description
sp:[LN:MURA_BACSU] [AC:P19670:Q03225] [GN:MURA:MURZ] [OR:*BACILLUS SUBTILIS*]
[EC:2.5.1.7] [DE:ENOLPYRUVYL TRANSFERASE) (EPT)] [SP:P19670:Q03225]
[DB:swissprot] >pir:[LN:G32354] [AC:S55428:G32354:H69662]
[PN:UDP-N-acetylglucosamine 1-carboxyvinyltransferase, murZ] [GN:murZ]
[CL:UDP-N-acetylglucosamine 1-carboxyvinyltransferase MurZ] [OR:*Bacillus
subtilis*] [EC:2.5.1.7] [DB:pir2] >gp:[GI:g853767] [LN:BSDNA320D]
[AC:Z49782] [PN:UDP-N-acetylglucosamine] [GN:murZ] [OR:*Bacillus subtilis*]
[DB:genpept-bct1] [DE:*B. subtilis* chromosomal DNA (region 320-321 degrees).]
[SP:P19670] [LE:14403] [RE:15692] [DI:direct] >gp:[GI:e1184616:g2636235]
[LN:BSUB0019] [AC:Z99122:AL009126] [PN:UDP-N-acetylglucosamine] [GN:murZ]
[FN:peptidoglycan biosynthesis] [OR:*Bacillus subtilis*] [DB:genpept-bct1]
[EC:2.5.1.7] [DE:*Bacillus subtilis* complete genome (section 19 of 21): from
3597091 to 3809700.] [NT:alternate gene name:murZ, lssF, rev-4] [LE:208051]
[RE:209340] [DI:complement] >gp:[GI:e118G211:g2636247] [LN:BSUB0020]
[AC:Z99123:AL00912G] [PN:UDP-N-acetylglucosamine] [GN:murZ]
[FN:peptidoglycan biosynthesis] [OR:*Bacillus subtilis*] [DB:genpept-bct1]
[EC:2.5.1.7] [DE:*Bacillus subtilis* complete genome (section 20 of 21): from
3798401 to 4010550.] [NT:alternate gene name:murZ, lssF, rev-4] [LE:6741]
[RE:8030] [DI:complement] >gp:[GI:e1184616:g2636235] [LN:BSUB0019]
[AC:Z99122:AL009126] [PN:UDP-N-acetylglucosamine] [GN:murZ]
[FN:peptidoglycan biosynthesis] [OR:*Bacillus subtilis*] *[DB:genpept]*
[EC:2.5.1.7] [DE:*Bacillus subtilis* complete genome (section 19 of 21): from
3597091 to 3809700.] [NT:alternate gene name:murZ, lssF, rev-4] [SP:P19670]
[LE:208051] [RE:209340] [DI:complement]

| ORF Name | NT ID | AA ID | NT LN | AA LN | Score | P-Value |
|---|---|---|---|---|---|---|

-continued

| | | | | | |
|---|---|---|---|---|---|
| AI7503000979__24407631__f3__252 | 70 | 3842 | 144 | 47 | |

Description
NO-HIT

| ORF Name | NT ID | AA ID | NT LN | AA LN | Score | P-Value |
|---|---|---|---|---|---|---|
| AI7503000979__24415933__c2__418 | 71 | 3843 | 435 | 144 | 83 | 0.026 |

Description
sp:[LN:YUXK__BACSU] [AC:P40761:O05233] [GN:YUXK] [OR:*BACILLUS SUBTILIS*]
[DE:HYPOTHETICAL 15.7 KD PROTEIN IN PBPD-COMA INTERGENIC REGION (ORF2)]
[SP:P40761:O05233] [DB:swissprot] >pir:[LN:B55220] [AC:B55220:D70025]
[PN:hypothetical protein yuxK:pbpD 3'-region hypothetical protein] [GN:yuxK]
[OR:*Bacillus subtilis*] [DB:pir2] >gp:[GI:g520537] [LN:BSU11882]
[AC:U11882] [PN:unknown] [GN:pbpD] [OR:*Bacillus subtilis*] [DB:genpept-bct1]
[DE:*Bacillus subtilis* orf1, partial cds, penicillin-binding protein 4(pbpD)
gene, complete cds, and orf2, complete cds.] [NT:orf2] [LE:2760] [RE:3173]
[DI:direct] >gp:[GI:e1184228:g2635646] [LN:BSUB0017] [AC:Z99120:AL009126]
[GN:yuxK] [FN:unknown] [OR:*Bacillus subtilis*] [DB:genpept-bct1] [DE:*Bacillus
subtilis* complete genome (section 17 of 21): from 3197001 to 3414420.]
[NT:alternate gene name:yugD] [SP:P40761] [LE:37885] [RE:38298] [DI:direct]
>gp:[GI:e311522:g1934785] [LN:BSZ93933] [AC:Z93933] [PN:unknown] [GN:yugD]
[OR:*Bacillus subtilis*] [DB:genpept-bct1] [DE:*B. subtilis* genomic DNA fragment
from yugA to yugD.] [SP:P40761] [LE:7318] [RE:7731] [DI:direct]

| ORF Name | NT ID | AA ID | NT LN | AA LN | Score | P-Value |
|---|---|---|---|---|---|---|
| AI7503000979__24508563__c2__436 | 72 | 3844 | 1092 | 363 | 1226 | 9.0e-125 |

Description
sp:[LN:RF1__BACSU] [AC:P45872] [GN:PRFA] [OR:*BACILLUS SUBTILIS*] [DE:PEPTIDE
CHAIN RELEASE FACTOR 1 (RF-1)] [SP:P45872] [DB:swissprot] >pir:[LN:S55437]
[AC:S55437:G69681] [PN:translation releasing factor RF-1:peptide chain
release factor 1] [GN:prfA:RF-1] [CL:translation releasing factor]
[OR:*Bacillus subtilis*] [DB:pir1] >gp:[GI:g853776] [LN:BSDNA320D] [AC:Z49782]
[PN:peptide chain release factor 1] [GN:prfA] [OR:*Bacillus subtilis*]
[DB:genpept-bct1] [DE:*B. subtilis* chromosomal DNA (region 320–321 degrees).]
[NT:gtg start codon] [SP:P45872] [LE:23623] [RE:24693] [DI:direct]
>gp:[GI:e1184607:g2636226] [LN:BSUB0019] [AC:Z99122:AL009126] [PN:peptide
chain release factor 1] [GN:prfA] [OR:*Bacillus subtilis*] [DB:genpept-bct1]
[DE:*Bacillus subtilis* complete genome (section 19 of 21): from 3597091 to
3809700.] [SP:P45872] [LE:199050] [RE:200120] [DI:complement]
>gp:[GI:e1184607:g2636226] [LN:BSUB0019] [AC:Z99122:AL009126] [PN:peptide
chain release factor 1] [GN:prfA] [OR:*Bacillus subtilis*] [DB:genpept]
[DE:*Bacillus subtilis* complete genome (section 19 of 21): from 3597091 to
3809700.] [SP:P45872] [LE:199050] [RE:200120] [DI:complement]

| ORF Name | NT ID | AA ID | NT LN | AA LN | Score | P-Value |
|---|---|---|---|---|---|---|
| AI7503000979__24625216__f3__264 | 73 | 3845 | 186 | 61 | | |

Description
NO-HIT

| ORF Name | NT ID | AA ID | NT LN | AA LN | Score | P-Value |
|---|---|---|---|---|---|---|
| AI7503000979__24641687__c2__437 | 74 | 3846 | 426 | 141 | 237 | 5.7e-20 |

Description
sp:[LN:YWLE__BACSU] [AC:P39155] [GN:YWLE:IPC-31D] [OR:*BACILLUS SUBTILIS*]
[EC:3.1.3.48] [DE:(EC 3.1.3.48)] [SP:P39155] [DB:swissprot] >pir:[LN:S49360]
[AC:I40479:B70062:S49360] [PN:protein-tyrosine-phosphatase, homolog ywlE,
low molecular weight:ipc-31d protein] [GN:ywlE:ipc-31d]
[CL:protein-tyrosine-phosphatase, low molecular weight] [OR:*Bacillus
subtilis*] [EC:3.1.3.48] [DB:pir1] >gp:[GI:g556883] [LN:BSSPORUPP]
[AC:Z38002] [PN:Unknown] [GN:ipc-31d] [OR:*Bacillus subtilis*]
[DB:genpept-bct1] [DE:*B. subtilis* spoII-R, glyC and upp genes.] [SP:P39155]
[LE:3679] [RE:4131] [DI:direct] >gp:[GI:e1184599:g2636218] [LN:BSUB0019)
[AC:Z99122:AL009126] [GN:ywlE] [FN:unknown] [OR:*Bacillus subtilis*]
[DB:genpept-bct1] [DE:*Bacillus subtilis* complete genome (section 19 of 21):
from 3597091 to 3809700.] [NT:alternate gene name:ipc-31d; similar to]
[SP:P39155] [LE:193770] [RE:194222] [DI:complement]
>gp:[GI:e1184599:g2636218] [LN:BSUB00l9] [AC:Z99122:AL009126] [GN:ywlE]
[FN:unknown] [OR:*Bacillus subtilis*] [DB:genpept] [DE:*Bacillus subtilis*
complete genome (section 19 of 21): from 3597091 to 3809700.] [NT:alternate
gene name:ipc-31d; similar to] [SP:P39155] [LE:193770] [RE:194222]
[DI:complement]

-continued

| ORF Name | NT ID | AA ID | NT LN | AA LN | Score | P-Value |
|---|---|---|---|---|---|---|
| AI7503000979_24642963_c2_458 | 75 | 3847 | 216 | 71 | 81 | 0.0019 |

Description
sp:[LN:COPP_HELFE] [AC:O32620] [GN:COPP] [OR:*HELICOBACTER FELIS*] [DE:COP ASSOCIATED PROTEIN (COPPER ION BINDING PROTEIN)] [SP:O32620] [DB:swissprot] >gp:[GI:e353967:g2660543] [LN:HFAJ1932] [AC:AJ001932] [GN:copP] [FN:divalent cation binding protein] [OR:*Helicobacter felis*] [DB:genpept-bct1] [DE:*Helicobacter felis* ftsH, copA, copP genes and two ORF's.] [SP:O32620] [LE:5306] [RE:5506] [DI:direct]

| ORF Name | NT ID | AA ID | NT LN | AA LN | Score | P-Value |
|---|---|---|---|---|---|---|
| AI7503000979_24647558_c1_352 | 76 | 3848 | 357 | 118 | | |

Description
NO-HIT

| ORF Name | NT ID | AA ID | NT LN | AA LN | Score | P-Value |
|---|---|---|---|---|---|---|
| AI7503000979_24665932_c3_496 | 77 | 3849 | 840 | 279 | 477 | 2.1e-45 |

Description
sp:[LN:HEMK_BACSU] [AC:P45873] [GN:YWKE] [OR:*BACILLUS SUBTILIS*] [DE:HEMK PROTEIN HOMOLOG] [SP:P45873] [DB:swissprot] >pir:[LN:S55438] [AC:S55438:D70061] [PN:protoporphyrinogen oxidase homolog ywkE] [GN:ywkE] [OR:*Bacillus subtilis*] [DB:pir2] >gp:[GI:g853777] [LN:BSDNA320D] [AC:Z49782] [GN:ywkE] [OR:*Bacillus subtilis*] [DB:genpept-bct1] [DE:*B. subtilis* chromosomal DNA (region 320–321 degrees).] [NT:product similar to *E. coli* PRFA2 protein] [SP:P45873] [LE:24695] [RE:25561] [DI:direct] >gp:[GI:e1184606:g2636225] [LN:BSUB0019] [AC:Z99122:AL009126] [GN:ywkE] [FN:unknown] [OR:*Bacillus subtilis*] [DB:genpept-bct1] [DE:*Bacillus subtilis* complete genome (section 19 of 21): from 3597091 to 3809700.] [NT:similar to protoporphyrinogen oxidase] [SP:P45873] [LE:198182] [RE:199048] [DI:complement] >gp:[GI:e1184606:g2636225] [LN:BSUB0019] [AC:Z99122:AL009126] [GN:ywkE] [FN:unknown] [OR:*Bacillus subtilis*] [DB:genpept] [DE:*Bacillus subtilis* complete genome (section 19 of 21): from 3597091 to 3809700.] [NT:similar to protoporphyrinogen oxidase] [SP:P45873] [LE:198182] [RE:199048] [DI:complement]

| ORF Name | NT ID | AA ID | NT LN | AA LN | Score | P-Value |
|---|---|---|---|---|---|---|
| AI7503000979_2541301_c3_505 | 78 | 3850 | 351 | 116 | 180 | 6.3e-14 |

Description
pir:[LN:G70070] [AC:G70070] [PN:hypothetical protein ywzB] [GN:ywzB] [OR:*Bacillus subtilis*] [DB:pir2] >gp:[GI:e1184584:g2636203] [LN:BSUB0019] [AC:Z99122:AL009126] [GN:ywzB] [FN:unknown] [OR:*Bacillus subtilis*] [DB:genpept-bct1] [DE:*Bacillus subtilis* complete genome (section 19 of 21): from 3597091 to 3809700.] [LE:182127] [RE:182357] [DI:complement] >gp:[GI:e1184584:g2636203] [LN:BSUB0019] [AC:Z99122:AL009126] [GN:ywzB] [FN:unknown] [OR:*Bacillus subtilis*] [DB:genpept] [DE:*Bacillus subtilis* complete genome (section 19 of 21): from 3597091 to 3809700.] [LE:182127] [RE:182357] [DI:complement]

| ORF Name | NT ID | AA ID | NT LN | AA LN | Score | P-Value |
|---|---|---|---|---|---|---|
| AI7503000979_25422081_c3_475 | 79 | 3851 | 204 | 67 | 84 | 0.014 |

Description
sp:[LN:ETF1_FOWP1] [AC:P21966] [GN:FPD6] [OR:FOWLPOX VIRUS] [SR:FP-1,] [DE:EARLY TRANSCRIPTION FACTOR 70 KD SUBUNIT] [SP:P21966] [DB:swissprot] >pir:[LN:F35216] [AC:F35216] [PN:FPD6 protein] [CL:vaccinia virus early transcription factor 70K chain] [OR:fowlpox virus] [DB:pir2] >gp:[GI:g61229] [LN:POFPHIND] [AC:X17202] [GN:ORF FPD6] [FN:Vaccinia D6 homolog] [OR:Fowlpox virus] [DB:genpept-vr1] [DE:Fowlpox virus DNA sequence (Hind III fragment).] [SP:P21966] [LE:6614] [RE:8431] [DI:direct]

| ORF Name | NT ID | AA ID | NT LN | AA LN | Score | P-Value |
|---|---|---|---|---|---|---|
| AI7503000979_26173800_c1_387 | 80 | 3852 | 186 | 61 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000979_26182767_c2_426 | 81 | 3853 | 123 | 40 | | |

Description
NO-HIT

| ORF Name | NT ID | AA ID | NT LN | AA LN | Score | P-Value |
|---|---|---|---|---|---|---|
| AI7503000979_26212756_f2_137 | 82 | 3854 | 1488 | 495 | 1477 | 2.3e-151 |

Description
sp:[LN:YWNE_BACSU] [AC:P71040] [GN:YWNE] [OR:*BACILLUS SUBTILIS*]
[DE:HYPOTHETICAL 55.8 KD PROTEIN IN SPOIIQ-MTA INTERGENIC REGION]
[SP:P71040] [DB:swissprot] >pir:[LN:G70063] [AC:G70063] [PN:cardiolipin
synthase homolog ywnE] [GN:ywnE] [CL:*Bacillus* probable cardiolipin
synthetase] [OR:*Bacillus subtilis*] [DB:pir2] >gp:[GI:e1184565:g2636184]
[LN:BSUB0019] [AC:Z99122:AL009126] [GN:ywnE] [FN:unknown] [OR:*Bacillus
subtilis*] [DB:genpept-bct1] [DE:*Bacillus subtilis* complete genome (section
19 of 21): from 3597091 to 3809700.] [NT:similar to cardiolipin synthase]
[SP:P71040] [LE:164628] [RE:166076] [DI:direct] >gp:[GI:e269549:g1592701]
[LN:BSUEROP] [AC:Y08559] [PN:Unknown] [GN:ywnE] [OR:*Bacillus subtilis*]
[DB:genpept-bct1] [DE:*B. subtilis* urease operon and downstream DNA.]
[NT:Product similar to *Escherichia coli* cardiolipin] [SP:P71040] [LE:5155]
[RE:6603] [DI:complement] >gp:[GI:e1184565:g2636184] [LN:BSUB0019]
[AC:Z99122:AL009126] [GN:ywnE] [FN:unknown] [OR:*Bacillus subtilis*]
[DB:genpept] [DE:*Bacillus subtilis* complete genome (section 19 of 21): from
3597091 to 3809700.] [NT:similar to cardiolipin synthase] [SP:P71040]
[LE:164628] [RE:166076] [D1:direct]

| ORF Name | NT ID | AA ID | NT LN | AA LN | Score | P-Value |
|---|---|---|---|---|---|---|
| AI7503000979_26360260_c3_520 | 83 | 3855 | 375 | 124 | 416 | 6.1e-39 |

Description
gp:[GI:e1340260:g3850850] [LN:SAU1G431] [AC:Y16431] [PN:dpj protein]
[GN:dpj] [OR:*Staphylococcus aureus*] [DB:genpept-bct1] [DE:*Staphylococcus
aureus* dpj, alr genes, partial kdpC gene and 4ORF's.] [LE:2975] [RE:3334]
[DI direct]

| ORF Name | NT ID | AA ID | NT LN | AA LN | Score | P-Value |
|---|---|---|---|---|---|---|
| AI7503000979_26751542_f1_73 | 84 | 3856 | 492 | 163 | 577 | 5.3e-56 |

Description
pir:[LN:A64533] [AC:A64533] [PN:conserved hypothetical protein HP0105]
[CL:conserved hypothetical protein H10491] [OR:*Helicobacter pylori*]
[DB:pir2] >gp:[GI:g2313188] [LN:AE000532] [AC:AE000532:AE000511]
[PN:conserved hypothetical protein] [GN:HP0105] [OR:*Helicobacter pylori*
26695] [DB:genpept-bct2] [DE:*Helicobacter pylori* 26695 section 10 of 134 of
the complete genome.] [NT:similar to GB:L42023 SP:P44007 PID:1003866]
[LE:5494] [RE:5961] [DI:complement]

| ORF Name | NT ID | AA ID | NT LN | AA LN | Score | P-Value |
|---|---|---|---|---|---|---|
| AI7503000979_26757677_c2_408 | 85 | 3857 | 1377 | 458 | 2163 | 4.6e-224 |

Description
gp:[GI:e1352473:g3892895] [LN:SAARGFEMD] [AC:Y15477]
[PN:phosphoglucosamine-mutase] [GN:glmM] [OR:*Staphylococcus aureus*]
[DB:genpept-bct1] [DE:*Staphylococcus aureus* argI, glmM genes and ORF1 and
ORF2.] [LE:2968] [RE:4323] [DI:direct] >gp:[GI:e283110:g1684749] [LN:SAFEMD]
[AC:Y09570] [GN:femD] [OR:*Staphylococcus aureus*] [DB:genpept-bct1]
[DE:*S. aureus* femD gene.] [LE:511] [RE:1866] [DI:direct]

| ORF Name | NT ID | AA ID | NT LN | AA LN | Score | P-Value |
|---|---|---|---|---|---|---|
| AI7503000979_2775462_c1_394 | 86 | 3858 | 522 | 173 | 331 | 6.2e-30 |

Description
gp:[GI:e1340259:g3850849] [LN:SAU16431] [AC:Y16431] [PN:hypothetical
protein] [GN:ORF4] [OR:*Staphylococcus aureus*] [DB:genpept-bct1]
[DE:*Staphylococcus aureus* dpj, alr genes, partial kdpC gene and 4ORF's.]
[LE:2477] [RE:2971] [DI:direct]

| ORF Name | NT ID | AA ID | NT LN | AA LN | Score | P-Value |
|---|---|---|---|---|---|---|
| AI7503000979_2925275_f1_20 | 87 | 3859 | 141 | 46 | | |

-continued

| Description |
|---|
| NO-HIT |

| ORF Name | NT ID | AA ID | NT LN | AA LN | Score | P-Value |
|---|---|---|---|---|---|---|
| AI7503000979_29307312_c3_470 | 88 | 3860 | 165 | 54 | | |

| Description |
|---|
| NO-HIT |

| ORF Name | NT ID | AA ID | NT LN | AA LN | Score | P-Value |
|---|---|---|---|---|---|---|
| AI7503000979_29695252_c3_497 | 89 | 3861 | 1098 | 365 | 665 | 2.5e-65 |

| Description |
|---|
| sp:[LN:YWLC_BACSU] [AC:P39153] [GN:YWLC:IPC-29D] [OR:*BACILLUS SUBTILIS*] [DE:HYPOTHETICAL 37.0 KD PROTEIN IN SPOIIR-GLYC INTERGENIC REGION] [SP:P39153] [DB:swissprot] >pir:[LN:140476] [AC:140476:H70061:S49358 [PN:conserved hypothetical protein ywlC:SUA5 homolog ipc-29d] [GN:ywlC:ipc-29d] [CL:*Bacillus subtilis* conserved hypothetical protein ywlC] [OR:*Bacillus subtilis*] [DB:pir2] >gp:[GI:g556881] [LN:BSSPORUPP] [AC:Z38002] [PN:Similar to *Saccharomyces cerevisiae* SUA5] [GN:ipc-29d] [OR:*Bacillus subtilis*] [DB:genpept-bct1] [DE:*B. subtilis* spoII-R, glyC and upp genes.] [SP:P39153] [LE:1927] [RE:2967] [DI:direct] >gp:[GI:e1184601:g2636220] [LN:BSUB0019] [AC:Z99122:AL009126] [GN:ywlC] [FN:unknown] [OR:*Bacillus subtilis*] [DB:genpept-bct1] [DE:*Bacillus subtilis* complete genome (section 19 of 21): from 3597091 to 3809700.] [NT:alternate gene name:ipc-29d; similar to] [SP:P39153] [LE:194934] [RE:195974] [DI:complement] >gp:[GI:e1184601:g2636220] [LN:BSUB0019] [AC:Z99122:AL009126] [GN:ywlC] [FN:unknown] [OR:*Bacillus subtilis*] [DB:genpept] [DE:*Bacillus subtilis* complete genome (section 19 of 21): from 3597091 to 3809700.] [NT:alternate gene name:ipc-29d; similar to] [SP:P39153] [LE:194934] [RE:195974] [DI:complement] |

| ORF Name | NT ID | AA ID | NT LN | AA LN | Score | P-Value |
|---|---|---|---|---|---|---|
| AI7503000979_29879407_c2_410 | 90 | 3862 | 189 | 62 | | |

| Description |
|---|
| NO-HIT |

| ORF Name | NT ID | AA ID | NT LN | AA LN | Score | P-Value |
|---|---|---|---|---|---|---|
| AI7503000979_30682816_c1_367 | 91 | 3863 | 537 | 178 | 376 | 1.1e-34 |

| Description |
|---|
| sp:[LN:ATPF_BACME] [AC:P20601] [GN:ATPF] [OR:*BACILLUS MEGATERIUM*] [EC:3.6.1.34] [DE:ATP SYNTHASE B CHAIN,] [SP:P20601] [DB:swissprot] >pir:[LN:D31482] [AC:D31482] [PN:H+-transporting ATP synthase, chain b] [CL:H+-transporting ATP synthase chain I] [OR:*Bacillus megaterium*] [EC:3.6.1.34] [DB:pir2] >gp:[GI:g142557] [LN:BACATPA] [AC:M20255:J04455:M18352:M23924] [PN:ATP synthase b subunit] [OR:*Bacillus megaterium*] [SR:*B. megaterium* (QM B1551) DNA, clones pWSB100, pCAH1.3, and pWPC208] [DB:genpept-bct1] [DE:*B. megaterium* ATP synthase i, a, c, b, delta, alpha, gamma, beta and epsilon subunit genes, complete cds, and ORF.] [LE:1777] [RE:2295] [DI:direct] |

| ORF Name | NT ID | AA ID | NT LN | AA LN | Score | P-Value |
|---|---|---|---|---|---|---|
| AI7503000979_31637_c2_406 | 92 | 3864 | 891 | 296 | 1229 | 4.3e-125 |

| Description |
|---|
| gp:[GI:e1352471:g3892893] [LN:SAARGFEMD] [AC:Y15477] [PN:hypothetical protein] [OR:*Staphylococcus aureus*] [DB:genpept-bct1] [DE:*Staphylococcus aureus* argI, glmM genes and ORF1 and ORF2.] [NT:orf1] [LE:1198] [RE:2007] [DI:direct] |

| ORF Name | NT ID | AA ID | NT LN | AA LN | Score | P-Value |
|---|---|---|---|---|---|---|
| AI7503000979_33412800_c2_429 | 93 | 3865 | 882 | 293 | 135 | 1.2e-08 |

| Description |
|---|
| pir:[LN:B69595] [AC:B69595] [PN:spermine/spermidine acetyltransferase bltD] [GN:bltD] [OR:*Bacillus subtilis*] [DB:pir2] >gp:[GI:d1013033:g1303698] [LN:BACJHG42] [AC:D84432:D82370] [PN:BltD] [OR:*Bacillus subtilis*] [SR:*Bacillus subtilis* (strain:JH642(trpC2 PheA1)) DNA] [DB:genpept-bct1] [DE:*Bacillus subtilis* DNA, 283 Kb region containing skin element.] [LE:811] [RE:1269] [DI:complement] >gp:[GI:e1183889:g2635105] [LN:BSUB0014] [AC:Z99117:AL009126] [PN:spermine/spermidine acetyltransferase] [GN:bltD] [OR:*Bacillus subtilis*] [DB:genpept-bct1] [EC:2.3.1.-] [DE:*Bacillus subtilis* |

-continued complete genome (section 14 of 21): from 2599451 to 2812870.] [NT:alternate gene name:bmr2D, bmtD] [SP:P39909] [LE:118163] [RE:118621] [DI:direct]

| ORF Name | NT ID | AA ID | NT LN | AA LN | Score | P-Value |
|---|---|---|---|---|---|---|
| AI7503000979__3361326__c2__403 | 94 | 3866 | 207 | 68 | | |

Description
NO-HIT

| ORF Name | NT ID | AA ID | NT LN | AA LN | Score | P-Value |
|---|---|---|---|---|---|---|
| AI7503000979__33673776__c2__435 | 95 | 3867 | 297 | 98 | 312 | 6.4e-28 |

Description
gp:[GI:g4193373] [LN:AF072894] [AC:AF072894] [PN:ribosomal protein L31] [GN:rpmE] [OR:*Listeria monocytogenes*] [DB:genpept-bct2] [DE:*Listeria monocytogenes* 4b1 putative transcription terminator Rho(rho) gene, partial cds; and wall teichoic acid glycosylationprotein GtcA (gtcA) and ribosomal protein L31 (rpmE) genes, complete cds.] [LE:848] [RE:1093] [DI:direct]

| ORF Name | NT ID | AA ID | NT LN | AA LN | Score | P-Value |
|---|---|---|---|---|---|---|
| AI7503000979__33751260__c1__372 | 96 | 3868 | 471 | 156 | 448 | 2.5e-42 |

Description
pir:[LN:D70065] [AC:D70065] [PN:(3R)-hydroxymyristoyl-[acyl carrier protein] dehydratase, ywpB] [GN:ywpB] [CL:(3R)-hydroxymyristoyl-[acyl carrier protein] dehydratase] [OR:*Bacillus subtilis*] [EC:4.2.1.-] [DB:pir2] >gp:[GI:e1184543:g2636162] [LN:BSUB0019] [AC:Z99122:AL009126] [GN:ywpB] [FN:unknown] [OR:*Bacillus subtilis*] [DB:genpept-bct1] [DE:*Bacillus subtilis* complete genome (section 19 of 21): from 3597091 to 3809700.] [NT:similar to hydroxymyristoyl-(acyl carrier protein)] [LE:145724] [RE:146122] [DI:complement] >gp:[GI:e289141:g1763703] [LN:BSZ83337] [AC:Z83337] [GN:ywpB] [OR:*Bacillus subtilis*] [DB:genpept-bct1] [DE:*B. subtilis* mbl, flh[O,P], rapD, ywp(B, C, D, E, F, G, H, I, J] and ywqAgenes.] [NT:similar to hydroxymyristoyl-(acyl carrier protein)] [LE:3199] [RE:3597] [DI:direct] >gp:[GI:e1184543:g2636162] [LN:BSUB0019] [AC:Z99122:AL009126] [GN:ywpB] [FN:unknown] [OR:*Bacillus subtilis*] [DB:genpept] [DE:*Bacillus subtilis* complete genome (section 19 of 21): from 3597091 to 3809700.] [NT:similar to hydroxymyristoyl-(acyl carrier protein)] [LE:145724] [RE:146122] [DI:complement]

| ORF Name | NT ID | AA ID | NT LN | AA LN | Score | P-Value |
|---|---|---|---|---|---|---|
| AI7503000979__33870312__c3__522 | 97 | 3869 | 792 | 263 | 1213 | 2.1e-123 |

Description
gp:[GI:e279935:g1934991] [LN:SASIGFACB] [AC:Y07645] [PN:sigma factor B] [GN:sigB] [OR:*Staphylococcus aureus*] [DB:genpept-bct1] [DE:*S. aureus* sigB gene.] [LE:2674] [RE:3444] [DI:direct] >gp:[GI:e285000:g1729797] [LN:SAUSIGB] [AC:Y09929] [PN:sigma-B] [GN:sigB] [OR:*Staphylococcus aureus*] [DB:genpept-bct1] [DE:*S. aureus* rsbU, rsbV, rsbW & sigB genes.] [LE:2687] [RE:3457] [DI:direct]

| ORF Name | NT ID | AA ID | NT LN | AA LN | Score | P-Value |
|---|---|---|---|---|---|---|
| AI7503000979__34062928__c3__521 | 98 | 3870 | 1083 | 360 | 1321 | 7.7e-135 |

Description
gp:[GI:e1340261:g3850851] [LN:SAU16431] [AC:Y16431] [PN:alr protein] [GN:alr] [OR:*Staphylococcus aureus*] [DB:genpept-bct1] [DE:*Staphylococcus aureus* dpj, alr genes, partial kdpC gene and 4ORF's.] [LE:3400] [RE:4548] [DI:direct]

| ORF Name | NT ID | AA ID | NT LN | AA LN | Score | P-Value |
|---|---|---|---|---|---|---|
| AI7503000979__34181277__c2__461 | 99 | 3871 | 501 | 166 | 299 | 1.5e-26 |

Description
gp:[GI:e1340257:g3850847] [LN:SAU16431] [AC:Y16431] [PN:hypothetical protein] [GN:ORF2] [OR:*Staphylococcus aureus*] [DB:genpept-bct1] [DE:*Staphylococcus aureus* dpj, air genes, partial kdpC gene and 4ORF's.] [LE:438] [RE:917] [DI:direct]

| ORF Name | NT ID | AA ID | NT LN | AA LN | Score | P-Value |
|---|---|---|---|---|---|---|
| AI7503000979__34187702__c2__407 | 100 | 3872 | 936 | 311 | 1173 | 3.7e-119 |

-continued

Description
gp:[GI:e1352472:g3892894] [LN:SAARGFEMD] [AC:Y15477] [PN:hypothetical
protein] [GN:orf2] [OR:*Staphylococcus aureus*] [DB:genpept-bct1]
[DE:*Staphylococcus aureus* argI, glmM genes and ORF1 and ORF2.] [LE:2009]
[RE:2941] [DI:direct]

| ORF Name | NT ID | AA ID | NT LN | AA LN | Score | P-Value |
|---|---|---|---|---|---|---|
| AI7503000979__34197275__f2__176 | 101 | 3873 | 126 | 41 | | |

Description
NO-HIT

| ORF Name | NT ID | AA ID | NT LN | AA LN | Score | P-Value |
|---|---|---|---|---|---|---|
| AI7503000979__34250327__c1__396 | 102 | 3874 | 363 | 120 | 540 | 4.5e-52 |

Description
gp:[GI:e279931:g1934987] [LN:SASIGFACB] [AC:Y07645] [GN:ORF1]
[OR:*Staphylococcus aureus*] [DB:genpept-bct1] [DE:*S. aureus* sigB gene.]
[LE:72] [RE:434] [DI:direct]

| ORF Name | NT ID | AA ID | NT LN | AA LN | Score | P-Value |
|---|---|---|---|---|---|---|
| AI7503000979__34589010__c1__348 | 103 | 3875 | 246 | 81 | | |

Description
NO-HIT

| ORF Name | NT ID | AA ID | NT LN | AA LN | Score | P-Value |
|---|---|---|---|---|---|---|
| AI7503000979__34611067__f3__302 | 104 | 3876 | 540 | 179 | 145 | 3.2e-10 |

Description
sp:[LN:YWJG__BACSU] [AC:P06629] [GN:YWJG] [OR:*BACILLUS SUBTILIS*]
[DE:HYPOTHETICAL 19.1 KD PROTEIN IN SPO0F-PYRG INTERGENIC REGION (ORF5)]
[SP:P066291] [DB:swissprot] >pir:[LN:I40471] [AC:I40471:S55424:E70060]
[PN:hypothetical protein ywjG:spoOF protein] [GN:ywjG:spoOF] [OR:*Bacillus
subtilis*] [DB:pir2] >gp:[GI:g853763] [LN:BSDNA320D] [AC:Z49782] [GN:ywjG]
[OR:*Bacillus subtilis*] [DB:genpept-bct1] [DE:*B. subtilis* chromosomal DNA
(region 320–321 degrees).] [SP:P06629] [LE:11169] [RE:11690] [DI:complement]
>gp:[GI:g401771] [LN:BSSPOO] [AC:V00105:J01549] [GN:spoOF] [OR:*Bacillus
subtilis*] [DB:genpept-bct1] [DE:*Bacillus subtilis* gene required at an early
stage of sporulation. (gene code spoOF).] [SP:P06629] [LE:541] [RE:1062]
[DI:direct] >gp:[GI:e1184620:g2636239] [LN:BSUB0019] [AC:Z99122:AL009126]
[GN:ywjG] [FN:unknown] [OR:*Bacillus subtilis*] [DB:genpept-bct1] [DE:*Bacillus
subtilis* complete genome (section 19 of 21): from 3597091 to 3809700.)
[SP:P06629] [LE:212053] [RE:212574] [DI:direct] >gp:[GI:e1186215:g2636251]
[LN:BSUB0020] [AC:Z99123:AL009126] [GN:ywjG] [FN:unknown] [OR:*Bacillus
subtilis*] [DB:genpept-bct1] [DE:*Bacillus subtilis* complete genome (section
20 of 21): from 3798401 to 4010550.] [SP:P066291] [LE:10743] [RE:11264]
[DI:direct] >gp:[GI:e1184620:g2636239] [LN:BSUB0019] [AC:Z99122:AL009126]
[GN:ywjG] [FN:unknown] [OR:*Bacillus subtilis*] [DB:genpept] [DE:*Bacillus
subtilis* complete genome (section 19 of 21): from 3597091 to 3809700.]
[SP:P06629] [LE:212053] [RE:212574] [DI:direct]

| ORF Name | NT ID | AA ID | NT LN | AA LN | Score | P-Value |
|---|---|---|---|---|---|---|
| AI7503000979__34615700__f2__193 | 105 | 3877 | 819 | 272 | 155 | 2.8e-08 |

Description
gp:[GI:g1293846] [LN:CELC42D8] [AC:U56966] [GN:C42D8.3] [OR:*Caenorhabditis
elegans*] [SR:*Caenorhabditis elegans* strain = Bristol N2] [DB:genpept-inv1]
[DE:*Caenorhabditis elegans* cosmid C42D8.] [NT:coded for by *C. elegans* cDNA
yk30b3.5; coded for by] [LE:8907:9377:9844:10820] [RE:9056:9564:10206:10976]
[DI:directJoin]

| ORF Name | NT ID | AA ID | NT LN | AA LN | Score | P-Value |
|---|---|---|---|---|---|---|
| AI7503000979__34646926__f2__206 | 106 | 3878 | 732 | 243 | 585 | 7.6e-57 |

Description
sp:[LN:DEOD__ACTPL] [AC:P94164] [GN:DEOD] [OR:ACTINOBACILLUS
PLEUROPNEUMONIAE] [SR:,HAEMOPHILUS PLEUROPNEUMONIAE] [EC:2.4.2.1] [DE:(PNP)]
[SP:P94164] [DB:swissprot] >gp:[GI:g1732037] [LN:APU55016] [AC:U55016]
[PN:purine nucleoside phosphorylase] [GN:deoD] [FN:cleavage of guanosine or
inosine to respective] [OR:Actinobacillus pleuropneumoniae]
[DB:genpept-bct1] [EC:2.4.2.1] [DE:Actinobacillus pleuropneumoniae
heat-shock 10 protein GroES (mopB), heat-shock 60 protein GroEL (mopA), -continued purine nucleoside phosphorylase(deoD) genes, complete cds, alcohol
dehydrogenase (adhE) gene, partial cds.] [LE:176] [RE:898] [DI:direct]

| ORF Name | NT ID | AA ID | NT LN | AA LN | Score | P-Value |
|---|---|---|---|---|---|---|
| AI7503000979__35354656__f1__108 | 107 | 3879 | 228 | 75 | | |

Description
NO-HIT

| ORF Name | NT ID | AA ID | NT LN | AA LN | Score | P-Value |
|---|---|---|---|---|---|---|
| AI7503000979__35647783__f1__103 | 108 | 3880 | 690 | 229 | 181 | 4.9e-14 |

Description
pir:[LN:F71082] [AC:F71082] [PN:hypothetical protein PH0924] [GN:PH0924]
[OR:*Pyrococcus horikoshii*] [DB:pir2] >gp:[GI:d1030963:g3257337]
[LN:AP000004]
[AC:AP000004:AB009494:AB009495:AB009496:AB009497:AB009498:AB009499]
[PN:128aa long hypothetical protein] [GN:PH0924] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 777001–994000 nt. position(4/7).] [LE:55768]
[RE:56154] [DI:direct]

| ORF Name | NT ID | AA ID | NT LN | AA LN | Score | P-Value |
|---|---|---|---|---|---|---|
| AI7503000979__36128785__c1__369 | 109 | 3881 | 888 | 295 | 796 | 3.3e-79 |

Description
sp:[LN:ATPG_BACME] [AC:P20602] [GN:ATPG] [OR:*BACILLUS MEGATERIUM*]
[EC:3.6.1.34] [DE:ATP SYNTHASE GAMMA CHAIN,] [SP:P20602] [DB:swissprot]
>pir:[LN:G31482] [AC:G31482] [PN:H+-transporting ATP synthase, gamma chain]
[CL:H+-transporting ATP synthase gamma chain] [OR:*Bacillus megaterium*]
[EC:3.6.1.34] [DB:pir2] >gp:[GI:g142560] [LN:BACATPA]
[AC:M20255:J04455:Ml8352:M23924] [PN:ATP synthase gamma subunit]
[OR:*Bacillus megaterium*] [SR:*B. megaterium* (QM B1551) DNA, clones pWSB100,
pCAH1.3, and pWPC208] [DB:genpept-bct1] [DE:*B. megaterium* ATP synthase
i, a, c, b, delta, alpha, gamma, beta and epsilon subunit genes, complete cds, and
ORF.] [LE:4467] [RE:5324] [DI:direct]

| ORF Name | NT ID | AA ID | NT LN | AA LN | Score | P-Value |
|---|---|---|---|---|---|---|
| AI7503000979__36225052__c3__502 | 110 | 3882 | 234 | 77 | 270 | 1.8e-23 |

Description
pir:[LN:I39786] [AC:I39786] [PN:H+-transporting ATP synthase, C chain]
[GN:atpE] [CL:H+-transporting ATP synthase lipid-binding protein]
[OR:*Bacillus firmus*] [EC:3.6.1.34] [DB:pir2] >gp:[GI:g142570]
[LN:BACATPSYNB] [AC:M84713] [PN:ATP synthase c subunit] [GN:atpE] [FN:proton
translocation] [OR:*Bacillus firmus*] [SR:*Bacillus firmus* DNA]
[DB:genpept-bct1] [DE:*Bacillus firmus* ATP synthase a and c subunit genes, 3'
end and complete cds.] [NT:putative] [LE:299] [RE:511] [DI:direct]

| ORF Name | NT ID | AA ID | NT LN | AA LN | Score | P-Value |
|---|---|---|---|---|---|---|
| AI7503000979__36363432__f1__85 | 111 | 3883 | 132 | 43 | | |

Description
NO-HIT

| ORF Name | NT ID | AA ID | NT LN | AA LN | Score | P-Value |
|---|---|---|---|---|---|---|
| AI7503000979__4039012__c3__514 | 112 | 3884 | 168 | 55 | 59 | 0.036 |

Description
gp:[GI:g5410434] [LN:AF134170] [AC:AF134170] [PN:gag] [OR:*Dictyostelium
discoideum*] [DB:genpept] [DE:*Dictyostelium discoideum* retrotransposon
TRE3-B, complete sequence.] [LE:139] [RE:1347] [DI:direct]

| ORF Name | NT ID | AA ID | NT LN | AA LN | Score | P-Value |
|---|---|---|---|---|---|---|
| AI7503000979__4063202__c3__499 | 113 | 3885 | 1239 | 412 | 1563 | 1.8e-160 |

Description
sp:[LN:GLYA_BACSU] [AC:P39148] [GN:GLYA:GLYC:IPC-34D] [OR:*BACILLUS SUBTILIS*]
[EC:2.1.2.1] [DE:(SHMT)] [SP:P39148] [DB:swissprot] >pir:[LN:I40483]
[AC:I40483:H69635:S49363] [PN:glycine hydroxymethyltransferase, glyA:serine
hydroxymethyltransferase] [GN:glyA:glyC] [CL:glycine
hydroxymethyltransferase] [OR:*Bacillus subtilis*] [EC:2.1.2.1] [DB:pir2]

-continued

>gp:[GI:g556886] [LN:BSSPORUPP] [AC:Z38002] [PN:serine
hydroxymethyltransferase] [GN:glyC] [OR:*Bacillus subtilis*] [DB:genpept-bct1]
[DE:*B. subtilis* spoII-R, glyc and upp genes.] [SP:P39148] [LE:5499] [RE:6746]
[DI:direct] >gp:[GI:e1184596:g2636215] [LN:BSUB0019] [AC:Z99122:AL009126]
[PN:serine hydroxymethyltransferase] [GN:glyA] [FN:glycine/serine/threonine
metabolism] [OR:*Bacillus subtilis*] [DB:genpept-bct1] [EC:2.1.2.1]
[DE:*Bacillus subtilis* complete genome (section 19 of 21): from 3597091 to
3809700.] [NT:alternate gene name:glyc, ipc-34d] [SP:P39148] [LE:191155]
[RE:192402] [DI:complement] >gp:[GI:e1184596:g2636215] [LN:BSUB0019]
[AC:Z99122:AL009126] [PN:serine hydroxymethyltransferase] [GN:glyA]
[FN:glycine/serine/threonine metabolism] [OR:*Bacillus subtilis*] [DB:genpept]
[EC:2.1.2.1] [DE:*Bacillus subtilis* complete genome (section 19 of 21): from
3597091 to 3809700.] [NT:alternate gene name:glyc, ipc-34d] [SP:P39148]
[LE:191155] [RE:192402] [DI:complement]

| ORF Name | NT ID | AA ID | NT LN | AA LN | Score | P-Value |
|---|---|---|---|---|---|---|
| AI7503000979_40712_f2_210 | 114 | 3886 | 216 | 71 | | |

Description
NO-HIT

| ORF Name | NT ID | AA ID | NT LN | AA LN | Score | P-Value |
|---|---|---|---|---|---|---|
| AI7503000979_4072135_c3_490 | 115 | 3887 | 1467 | 488 | 870 | 4.8e-87 |

Description
pir:[LN:E70961] [AC:E70961] [PN:hypothetical protein Rv0223c] [GN:Rv0223c]
[OR:*Mycobacterium tuberculosis*] [DB:pir2] >gp:[GI:e304956:g1871596]
[LN:MTCY8D5] [AC:Z92669:AL123456] [PN:hypothetical protein Rv0223c]
[GN:Rv0223c] [OR:*Mycobacterium tuberculosis*] [DB:genpept-bct1]
[DE:Mycobacterium tuberculosis H37Rv complete genome; segment 12/162.]
[NT:Rv0223c, (MTCY08D5.18), aldehyde dehydrogenase,] [LE:18979] [RE:20442]
[DI:complement]

| ORF Name | NT ID | AA ID | NT LN | AA LN | Score | P-Value |
|---|---|---|---|---|---|---|
| AI7503000979_4079511_f1_3 | 116 | 3888 | 147 | 48 | | |

Description
NO-HIT

| ORF Name | NT ID | AA ID | NT LN | AA LN | Score | P-Value |
|---|---|---|---|---|---|---|
| AI7503000979_409556_f1_111 | 117 | 3889 | 135 | 44 | 112 | 2.5e-06 |

Description
pir:[LN:D71245] [AC:D71245] [PN:hypothetical protein PH0221] [GN:PH0221]
[OR:*Pyrococcus horikoshii*] [DB:pir2] >gp:[GI:d1030234:g3256608]
[LN:AP000001]
[AC:AP000001:AB009465:AB009464:AB009466:AB009467:AB009468:AB009469]
[PN:235aa long hypothetical protein] [GN:PH0221] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1–287000 nt. position (1/7).] [LE:194212]
[RE:194919] [DI:complement]

| ORF Name | NT ID | AA ID | NT LN | AA LN | Score | P-Value |
|---|---|---|---|---|---|---|
| AI7503000979_4178218_c1_353 | 118 | 3890 | 675 | 224 | 81 | 0.0066 |

Description
gp:[GI:g1131502] [LN:PBU42580] [AC:U42580:U17055:U32570] [GN:A158L]
[OR:*Paramecium bursaria* Chlorella virus 1] [DB:genpept-vrl] [DE:Paramecium
bursaria Chlorella virus 1, complete genome.] [LE:80789] [RE:81103] [DI complement]

| ORF Name | NT ID | AA ID | NT LN | AA LN | Score | P-Value |
|---|---|---|---|---|---|---|
| AI7503000979_4346926_c2_450 | 119 | 3891 | 123 | 40 | | |

Description
NO-HIT

| ORF Name | NT ID | AA ID | NT LN | AA LN | Score | P-Value |
|---|---|---|---|---|---|---|
| AI7503000979_4728558_c2_409 | 120 | 3892 | 1860 | 619 | 2088 | 4.1e-216 |

Description
pir:[LN:B69633] [AC:B69633] [PN:L-glutamine-D-fructose-6-phosphate
amidotransferase glmS] [GN:glmS] [CL:glutamine- -fructose-6-phosphate -continued aminotransferase (isomerizing)] [OR:*Bacillus subtilis*] [DB:pir2]
>gp:LGI:d1034037:g3599596] [LN:AB006424] [AC:AR006424]
[PN:L-GLUTAMINE-D-FRUCTOSE-6-PHOSPHATE AMIDO] [GN:gcaA] [OR:*Bacillus subtilis*] [SR:*Bacillus subtilis* (strain:168) DNA] [DB:genpept-bct1]
[DE:*Bacillus subtilis* genomic DNA, 70 kb region between 17 and 23 degree.]
[LE:3246] [RE:5048] [DI:direct] >gp:[GI:g726480] [LN:BSU21932]
[AC:U21932:D21198] [PN:L-glutamine-D-fructose-6-phosphate] [GN:gcaA]
[OR:*Bacillus subtilis*] [DB:genpept-bct1] [DE:*Bacillus subtilis*
L-glutamine-D-fructose-6-phosphateamidotransferase (gcaA) gene, complete
cds.] [LE:312] [RE:2114] [DI:direct] >gp:[GI:e1182111:g2632445]
[LN:BSUB0001] [AC:Z99104:AL009126] [PN:L-glutamine-D-fructose-6-phosphate]
[GN:glmS] [OR:*Bacillus subtilis*] [DB:genpept-bct1] [EC:2.6.1.16]
[DE:*Bacillus subtilis* complete genome (section 1 of 21): from 1 to 213080.]
[NT:alternate gene name:gcaA, ybxD] [SP:P39754] [LE:200263] [RE:202065]
[DI:direct] >gp:[GI:e1182129:g2632463] [LN:BSUB0002] [AC:Z99105:AL009126]
[PN:L-glutamine-D-fructose-6-phosphate] [GN:glmS] [OR:*Bacillus subtilis*]
[DB:genpept-bct1] [EC:2.6.1.16] [DE:*Bacillus subtilis* complete genome
(section 2 of 21): from 194651 to 415810.] [NT:alternate gene name:gcaA,
ybxD] [SP:P39754] [LE:5613] [RE:7415] [DI:direct]

| ORF Name | NT ID | AA ID | NT LN | AA LN | Score | P-Value |
|---|---|---|---|---|---|---|
| AI7503000979_476567_c1_355 | 121 | 3893 | 567 | 188 | 292 | 8.5e-26 |

Description
sp:[LN:RPOE_BACSU] [AC:P12464] [GN:RPOE] [OR:*BACILLUS SUBTILIS*] [EC:2.7.7.6]
[DE:DNA-DIRECTED RNA POLYMERASE DELTA SUBUNIT,] [SP:P12464] [DB:swissprot]
>pir:[LN:JT0302] [AC:JT0302:H32354:S55422:H69698] [PN:DNA-directed RNA
polymerase, delta chain rpoE] [GN:rpoE] [CL:DNA-directed RNA polymerase
delta chain] [OR:*Bacillus subtilis*] [EC:2.7.7.6] [DB:pir1] >gp:[GI:g143456]
[LN:BACRPOE] [AC:M21677] [OR:*Bacillus subtilis*] [SR:*B. subtilis* (strain 168)
DNA, clone mML11 [DB:genpept-bct1] [DE:*B. subtilis* RNA polymerase delta
subunit (rpoE) gene, complete cds.] [NT:rpoE protein (ttg start codon)]
[LE:101] [RE:622] [DI:direct] >gp:[GI:g853761] [LN:BSDNA320D] [AC:Z49782]
[PN:RNA polymerase delta subunit] [GN:rpoE] [OR:*Bacillus subtilis*]
[DB:genpept-bct1] [DE:*B. subtilis* chromosomal DNA (region 320–321 degrees).]
[NT:ttg start codon] [SP:P12464] [LE:8717] [RE:9238] [DI:direct]
>gp:[GI:e1186217:g2636253] [LN:BSUB0020] [AC:Z99123:AL009126] [PN:RNA
polymerase (delta subunit)] [GN:rpoE] [OR:*Bacillus subtilis*]
[DB:genpept-bct1] [EC:2.7.7.6] [DE:*Bacillus subtilis* complete genome
(section 20 of 21): from 3798401 to 4010550.] [SP:P12464] [LE:13195]
[RE:13716] [DI:complement]

| ORF Name | NT ID | AA ID | NT LN | AA LN | Score | P-Value |
|---|---|---|---|---|---|---|
| AI7503000979_4869213_c3_519 | 122 | 3894 | 1521 | 506 | 811 | 3.4e-128 |

Description
gp:[GI:e1340258:g3850848] [LN:SAU16431] [AC:Y16431] [PN:hypothetical
protein] [GN:ORF3] [OR:*Staphylococcus aureus*] [DB:genpept-bct1]
[DE:*Staphylococcus aureus* dpj, air genes, partial kdpC gene and 4ORF's.]
[LE:910] [RE:2493] [DI:direct]

| ORF Name | NT ID | AA ID | NT LN | AA LN | Score | P-Value |
|---|---|---|---|---|---|---|
| AI7503000979_4881262_f3_293 | 123 | 3895 | 171 | 56 | | |

Description
NO-HIT

| ORF Name | NT ID | AA ID | NT LN | AA LN | Score | P-Value |
|---|---|---|---|---|---|---|
| AI7503000979_4881302_f2_191 | 124 | 3896 | 150 | 49 | | |

Description
NO-HIT

| ORF Name | NT ID | AA ID | NT LN | AA LN | Score | P-Value |
|---|---|---|---|---|---|---|
| AI7503000979_4901712_c1_370 | 125 | 3897 | 1428 | 475 | 1999 | 1.1e-206 |

Description
sp:[LN:ATPB_BACSU] [AC:P37809] [GN:ATPD] [OR:*BACILLUS SUBTILIS*]
[EC:3.6.1.34] [DE:(VEG31)] [SP:P37809] [DB:swissprot] >pir:[LN:I40368]
[AC:I40368:H69591:S39256] [PN:H+-transporting ATP synthase, beta chain
(atpD)] [GN:atpD] [CL:H+-transporting ATP synthase alpha chain:
H+-transporting ATP synthase alpha chain homology] [OR:*Bacillus subtilis*]
[EC:3.6.1.34] [DB:pir2] >gp:[GI:g433991] [LN:BSATPASE] [AC:Z28592] [PN:ATP
synthase subunit beta] [GN:atpD] [OR:*Bacillus subtilis*] [DB:genpept-bct1]

-continued

[DE:*B. subtilis* (168) atpase genes for ATP synthase subunits i, a, c ,b,
delta, alpha, gamma, beta, epsilon.] [SP:P37809] [LE:5520] [RE:6941]
[DI:direct] >gp:[GI:e1184587:g2636206] [LN:BSUB0019] [AC:Z99122:AL009126]
[PN:ATP synthase (subunit beta)] [GN:atpD] [OR:*Bacillus subtilis*]
[DB:genpept-bct1] [EC:3.6.1.34] [DE:*Bacillus subtilis* complete genome
(section 19 of 21): from 3597091 to 3809700.] [SP:P37809] [LE:183456]
[RE:184877] [DI:complement] gp:[GI:e1184587:g2636206] [LN:BSUB0019]
[AC:Z99122:AL009126] [PN:ATP synthase (subunit beta)] [GN:atpD] [OR:*Bacillus
subtilis*] [DB:genpept] [EC:3.6.1.34] [DE:*Bacillus subtilis* complete genome
(section 19 of 21): from 3597091 to 3809700.] [SP:P37809] [LE:183456]
[RE:184877] [DI:complement]

| ORF Name | NT ID | AA ID | NT LN | AA LN | Score | P-Value |
| --- | --- | --- | --- | --- | --- | --- |
| AI7503000979__4962802__c2__421 | 126 | 3898 | 1305 | 434 | 1591 | 1.9e-163 |

Description
gp:[GI:g4336793] [LN:AF105341] [AC:AF105341] [PN:pyrimidine nucleoside
phosphorylase] [GN:pdp1] [OR:*Listeria monocytogenes*] [DB:genpept-bct2]
LDE:*Listeria monocytogenes* threonine dehydratase (thd1) gene, partial cds;
alpha acetolactate decarboxylase gene, complete cds; and pyrimidine
nucleoside phosphorylase (pdp1) gene, partial cds.] [LE:1749] [RE:>3010]
[DI:complement]

| ORF Name | NT ID | AA ID | NT LN | AA LN | Score | P-Value |
| --- | --- | --- | --- | --- | --- | --- |
| AI7503000979__S078177__c1__365 | 127 | 3899 | 1062 | 353 | 1169 | 9.9e-119 |

Description
gp:[GI:g1773355] [LN:5AU81973] [AC:U81973] [PN:Cap5P] [GN:cap5P]
[OR:*Staphylococcus aureus*] [DB:genpept-bct2] [DE:*Staphylococcus aureus*
capsule gene cluster Cap5A through Cap5Pgenes, complete cds.] [NT:putative
N-acetylglucosamine 2-epimerase] [LE:157691] [RE:16944] [DI:direct]

| ORF Name | NT ID | AA ID | NT LN | AA LN | Score | P-Value |
| --- | --- | --- | --- | --- | --- | --- |
| AI7503000979__5111502__c2__454 | 128 | 3900 | 924 | 307 | 417 | 4.8e-39 |

Description
sp:[LN:YQJG__BACSU] [AC:P54544] [GN:YQJG] [OR:*BACILLUS SUBTILIS*]
[DE:PRECURSOR] [SP:P54544] [DB:swissprot] >pir:[LN:G69963] [AC:G69963]
[PN:lipoprotein SpoIIIJ-like homolog yqjG] [GN:yqjG] [CL:stage III
sporulation protein:stage III sporulation protein homology] [OR:*Bacillus
subtilis*] [DB:pir2] >gp:[GI:d1013293:g1303958] [LN:BACJH642]
[AC:D84432:D82370] [PN:YqjG] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:234919] [RE:235746]
[DI:complement] >gp:[GI:e1185657:g2634823] [LN:BSUB0013]
[AC:Z99116:AL009126] [GN:yqjG] [FN:unknown] [OR:*Bacillus subtilis*]
[DB:genpept-bct1] [DE:*Bacillus subtilis* complete genome (section 13 of 21):
from 2395261 to 2613730.] [NT:similar to lipoprotein SpoIIIJ-like]
[SP:P54544] [LE:87873] [RE:88700] [DI:direct]

| ORF Name | NT ID | AA ID | NT LN | AA LN | Score | P-Value |
| --- | --- | --- | --- | --- | --- | --- |
| AI7503000979__5131927__f1__93 | 129 | 3901 | 210 | 69 | | |

Description
NO-HIT

| ORF Name | NT ID | AA ID | NT LN | AA LN | Score | P-Value |
| --- | --- | --- | --- | --- | --- | --- |
| AI7503000979__5318785__c1__395 | 130 | 3902 | 156 | 51 | | |

Description
NO-HIT

| ORF Name | NT ID | AA ID | NT LN | AA LN | Score | P-Value |
| --- | --- | --- | --- | --- | --- | --- |
| AI7503000979__5319213__c2__442 | 131 | 3903 | 417 | 138 | 312 | 6.4e-28 |

Description
sp:[LN:ATPE__BACSU] [AC:P37812] [GN:ATPC] [OR:*BACILLUS SUBTILIS*]
[EC:3.6.1.34] [DE:ATP SYNTHASE EPSILON CHAIN,] [SP:P37812] [DB:swissprot]
>pir:[LN:I40369] [AC:I40369:G69591:S39257] [PN:H+-transporting ATP
synthase, epsilon chain (atpC)] [GN:atpC] [CL:H+-transporting ATP synthase
epsilon chain] [OR:*Bacillus subtilis*] [EC:3.6.1.34] [DB:pir2]
>gp:[GI:g433992] [LN:BSATPASE] [AC:Z28592] [PN:ATP synthase subunit epsilon]
[GN:atpC] [OR:*Bacillus subtilis*] [DB:genpept-bct1] [DE:*B. subtilis* (168)

-continued atpase genes for ATP synthase subunits i, a, c, b, delta, alpha, gamma,
beta, epsilon.] [SP:P37812] [LE:6965] [RE:7363] [DI:direct]
>gp:[GI:e1184586:g2636205] [LN:BSUB0019] [AC:Z99122:AL009126] [PN:ATP
synthase (subunit epsilon)] [GN:atpC] [OR:*Bacillus subtilis*]
[DB:genpept-bct1] [EC:3.6.1.34] [DE:*Bacillus subtilis* complete genome
(section 19 of 21): from 3597091 to 3809700.] [SP:P37812] [LE:183034]
[RE:183432] [DI:complement] >gp:[GI:e1184586:g2636205] [LN:BSUB0019]
[AC:Z99122:AL009126] [PN:ATP synthase (subunit epsilon)] [GN:atpC]
[OR:*Bacillus subtilis*] [DB:genpept] [EC:3.6.1.34] [DE:*Bacillus subtilis*
complete genome (section 19 of 21): from 3597091 to 3809700.] [SP:P37812]
[LE:183034] [RE:183432] [DI:complement]

| ORF Name | NT ID | AA ID | NT LN | AA LN | Score | P-Value |
|---|---|---|---|---|---|---|
| AI7503000979_582760_c2_463 | 132 | 3904 | 207 | 68 | 150 | 9.5e-11 |

Description
gp:[GI:e1340262:g3850852] [LN:SAU16431] [AC:Y16431] [PN:hypothetical
protein] [GN:ORF7] [OR:*Staphylococcus aureus*] [DB:genpept-bct1]
[DE:*Staphylococcus aureus* dpj, alr genes, partial kdpC gene and 4ORF's.]
[LE:4633] [RE:>4735] [DI:direct]

| ORF Name | NT ID | AA ID | NT LN | AA LN | Score | P-Value |
|---|---|---|---|---|---|---|
| AI7503000979_5895301_c1_378 | 133 | 3905 | 948 | 315 | 603 | 9.4e-59 |

Description
sp:[LN:THID_HAEIN] [AC:P44697] [GN:THID:H10416] [OR:HAEMOPHILUS INFLUENZAE]
[EC:2.7.4.7] [DE:(HMP-P KINASE)] [SP:P44697] [DB:swissprotj >pir:[LN:I64151]
[AC:I64151][PN:hypothetical protein HI0416] [CL:phosphomethylpyrimidine
phosphate kinase] [OR:Haemophilus influenzae] [DB:pir2] >gp:[GI:g1573390]
[LN:U32725] [AC:U32725:L42023] [PN:phosphomethylpyrimidine kinase (thiD)]
[GN:HI0416] [OR:Haemophilus influenzae Rd] [DB:genpept-bct2] [DE:Haemophilus
influenzae Rd section 40 of 163 of the complete genome.] [NT:similar to
GB:AE000511 PID:2313975 percent] [LE:1472] [RE:2281] [DI:direct]

| ORF Name | NT ID | AA ID | NT LN | AA LN | Score | P-Value |
|---|---|---|---|---|---|---|
| AI7503000979_6442192_f2_181 | 134 | 3906 | 132 | 43 | | |

Description
NO-HIT

| ORF Name | NT ID | AA ID | NT LN | AA LN | Score | P-Value |
|---|---|---|---|---|---|---|
| AI7503000979_6454635_c2_431 | 135 | 3907 | 912 | 303 | 1173 | 3.7e-119 |

Description
sp:[LN:ALF1_BACSU] [AC:P132431] [GN:FBAA:FBA:FBA1:TSR] [OR:*BACILLUS SUBTILIS*]
[EC:4.1.2.13] [DE:PROBABLE FRUCTOSE-BISPHOSPHATE ALDOLASE 1,] [SP:P13243]
[DB:swissprot] >pir:[LN:D32354] [AC:S55426:D32354:E32354:D41835:B6962]
[PN:fructose-bisphosphate aldolase, fbaA:30K phosphoprotein
orfY-tsr:fructose-1,6-bisphosphate aldolase] [GN:fbaA]
[CL:fructose-bisphosphate aldolase II] [OR:*Bacillus subtilis*] [EC:4.1.2.13]
[DB:pir1] >gp:[GI:g460911] [LN:BACSPO0FA] [AC:M22039]
[PN:fructose-bisphosphate aldolase] [GN:orfY-tsr] [OR:*Bacillus subtilis*]
[SR:*Bacillus subtilis* (strains JH642 and UOT0550) DNA] [DB:genpept-bct1]
[EC:4.1.2.13] [DE:*Bacillus subtillis* spo0F, CTP synthetase (ctrA),
and fructose-bisphosphate aldolase (orfY-tsr) genes, complete cds.] [LE:32701
[RE:4127] [DI:direct] >gp:[GI:g853765] [LN:BSDNA320D] [AC:Z49782]
[PN:fructose biphosphate aldolase] [GN:tsr] [OR:*Bacillus subtilis*]
[DB:genpept-bct1] [DE:*B. subtilis* chromosomal DNA (region 320–321 degrees).]
[SP:P13243] [LE:12411] [RE:13268] [DI:direct] >gp:[GI:e1184618:g2636237]
[LN:BSUB0019] [AC:Z99122:AL009126] [PN:fructose-1,6-bisphosphate aldolase]
[GN:fbaA] [FN:glycolysis] [OR:*Bacillus subtilis*] [DB:genpept-bct1]
[EC:4.1.2.13] [DE:*Bacillus subtilis* complete genome (section 19 of 21): from
3597091 to 3809700.] [NT:alternate gene name:tsr, fba] [SP:P13243]
[LE:210475] [RE:211332] [DI:complement] >gp:[GI:e1186213:g2636249]
[LN:BSUB0020] [AC:Z99123:AL009126] [PN:fructose-1,6-bisphosphate aldolase]
[GN:fbaA] [FN:glycolysis] [OR:*Bacillus subtilis*] [DB:genpept-bct1]
[EC:4.1.2.13] [DE:*Bacillus subtilis* complete genome (section 20 of 21): from
3798401 to 4010550.] [NT:alternate gene name:tsr, fba] [SP:P13243] [LE:9165]
[RE:10022] [DI:complement] >gp:[GI:e1184618:g2636237] [LN:BSUB0019]
[AC:Z99122:AL009126] [PN:fructose-1,6-bisphosphate aldolase] [GN:fbaA]
[FN:glycolysis] [OR:*Bacillus subtilis*] [DB:genpept] [EC:4.1.2.13]
[DE:*Bacillus subtilis* complete genome (section 19 of 21): from 3597091 to
3809700.] [NT:alternate gene name:tsr, fba] [SP:P13243] [LE:210475]
[RE:211332] [DI:complement]

-continued

| ORF Name | NT ID | AA ID | NT LN | AA LN | Score | P-Value |
|---|---|---|---|---|---|---|
| AI7503000979_6645391_c1_342 | 136 | 3908 | 165 | 54 | | |

Description
NO-HIT

| ORF Name | NT ID | AA ID | NT LN | AA LN | Score | P-Value |
|---|---|---|---|---|---|---|
| AI7503000979_6681316_f2_197 | 137 | 3909 | 135 | 44 | | |

Description
NO-HIT

| ORF Name | NT ID | AA ID | NT LN | AA LN | Score | P-Value |
|---|---|---|---|---|---|---|
| AI7503000979_6721877_f2_194 | 138 | 3910 | 153 | 50 | | |

Description
NO-HIT

| ORF Name | NT ID | AA ID | NT LN | AA LN | Score | P-Value |
|---|---|---|---|---|---|---|
| AI7503000979_6906576_c1_371 | 139 | 3911 | 1296 | 431 | 1429 | 2.8e-146 |

Description
pir:[LN:A69662] [AC:A69662 ] [PN:UDP-N-acetylglucosamine
1-carboxyvinyltransferase murA] [GN:murA] [CL:UDP-N-acetylglucosamine
1-carboxyvinyltransferase MurZ] [OR:*Bacillus subtilis*] [DB:pir2]
>gp:[GI:e276830:g1648861] [LN:BSATPC] [AC:Z81356]
[PN:UDP-N-acetylglucosamine] [GN:murA] [OR:*Bacillus subtilis*]
[DB:genpept-bct1] [DE:*B. subtilis* atpC gene.] [LE:1943] [RE:3253] [DI:direct]
>gp:[GI:e1184582:g2636201] [LN:BSUB0019] [AC:Z99122:AL009126]
[PN:UDP-N-acetylglucosamine] [GN:murA] [FN:peptidoglycan biosynthesis]
[OR:*Bacillus subtilis*] [DB:genpept-bct1] [EC:2.5.1.7] [DE:*Bacillus subtilis*
complete genome (section 19 of 21): from 3597091 to 3809700.] [LE:179914]
[RE:181224] [DI:complement] >gp:[GI:e1184582:g2636201] [LN:BSUB0019]
[AC:Z99122:AL009126] [PN:UDP-N-acetylglucosamine] [GN:murA]
[FN:peptidoglycan biosynthesis] [OR:*Bacillus subtilis*] [DB:genpept]
[EC:2.5.1.7] [DE:*Bacillus subtilis* complete genome (section 19 of 21): from
3597091 to 3809700.] [LE:179914] [RE:181224] [DI:complement]

| ORF Name | NT ID | AA ID | NT LN | AA LN | Score | P-Value |
|---|---|---|---|---|---|---|
| AI7503000979_7240675_c2_460 | 140 | 3912 | 1374 | 457 | 976 | 2.8e-98 |

Description
sp:[LN:MURF_BACSU] [AC:P96613] [GN:MURF] [OR:*BACILLUS SUBTILIS*]
[EC:6.3.2.15] [DE:(D-ALANYL-D-ALANINE-ADDING ENZYME)] [SP:P96613]
[DB:swissprot] >pir:[LN:F69662] [AC:F69662]
[PN:UDP-N-acetylmuramoylalanyl-D-glutamyl-2,6-diaminopimelate-D-al murF]
[GN:murF] [OR:*Bacillus subtilis*] [DB:pir2] >gp:[GI:d1020047:g1881267]
[LN:AB001488] [AC:AB001488] [GN:ydbQ] [OR:*Bacillus subtilis*] [SR:*Bacillus
subtilis* (strain:168) DNA] [DB:genpept-bct1] [DE:*Bacillus subtilis* genome
sequence, 148 kb sequence of the region between 35 and 47 degree.]
[NT:PROBABLE UDP-N-ACETYLMURAMOYLALANYL-D-GLUTAMYL-2,] [LE:42447] [RE:43820]
[DI:direct] >gp:[GI:e1182423:g2632757] [LN:BSUB0003] [AC:Z99106:AL009126]
[PN:UDP-N-acetylmuramoylalanyl-D-glutamyl-2,6-] [GN:murF] [FN:peptidoglycan
biosynthesis] [OR:*Bacillus subtilis*] [DB:genpept-bct1] [EC:6.3.2.151]
[DE:*Bacillus subtilis* complete genome (section 3 of 21): from 402751
to 611850.] [NT:alternate gene name:ydbQ] [SP:P96613] [LE:106191]
[RE:107564] [DI:direct]

| ORF Name | NT ID | AA ID | NT LN | AA LN | Score | P-Value |
|---|---|---|---|---|---|---|
| AI7503000979_7292200_c1_351 | 141 | 3913 | 126 | 41 | | |

Description
NO-HIT

| ORF Name | NT ID | AA ID | NT LN | AA LN | Score | P-Value |
|---|---|---|---|---|---|---|
| AI7503000979_9784625_c3_507 | 142 | 3914 | 141 | 46 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000979__9800787__f2__216 | 143 | 3925 | 129 | 42 | | |

Description
NO-HIT

| ORF Name | NT ID | AA ID | NT LN | AA LN | Score | P-Value |
|---|---|---|---|---|---|---|
| AI7503000980__10006507__f3__164 | 144 | 3916 | 153 | 50 | | |

Description
NO-HIT

| ORF Name | NT ID | AA ID | NT LN | AA LN | Score | P-Value |
|---|---|---|---|---|---|---|
| AI7503000980__10736002__c1__211 | 145 | 3917 | 1521 | 506 | 2313 | 5.9e-240 |

Description
sp:[LN:SYK_STAAU] [AC:Q53638] [GN:LYSS] [OR:*STAPHYLOCOCCUS AUREUS*]
[EC:6.1.1.6] [DE:LYSYL-TRNA SYNTHETASE, (LYSINE- -TRNA LIGASE) (LYSRS)]
[SP:Q53638] [DB:swissprot] >gp:[GI:g567884] [LN:STA5SRR] [AC:L36472]
[PN:lysyl-tRNA synthetase] [OR:*Staphylococcus aureus*] [SR:*Staphylococcus
aureus* (clone library:ATCC 12600) DNA] [DB:genpept-bct1] [DE:*Staphylococcus
aureus* lysyl-tRNA sythetase gene, complete cds, transfer RNA (tRNA) genes, 5S
ribosomal RNA (5S rRNA) gene, 16S ribosomal RNA (16S rRNA) gene, 23S
ribosomal RNA (23S rRNA) gene.] [LE:176] [RE:1663] [DI:direct]

| ORF Name | NT ID | AA ID | NT LN | AA LN | Score | P-Value |
|---|---|---|---|---|---|---|
| AI7503000980__11210316__c1__203 | 146 | 3918 | 195 | 64 | 166 | 1.9e-12 |

Description
sp:[LN:YABO_BACSU] [AC:P37557] [GN:YABO] [OR:*BACILLUS SUBTILIS*]
[DE:HYPOTHETICAL 9.7 KD PROTEIN IN MFD-DIVIC INTERGENIC REGION] [SP:P37557]
[DB:swissprot] >pir:[LN:S66089] [AC:S66089:F69739] [PN:conserved
hypothetical protein yabO] [GN:yabO] [OR:*Bacillus subtilis*] [DB:pir2]
>gp:[GI:d1005836:g467448] [LN:BAC180K] [AC:D26185] [PN:unknownil [OR:*Bacillus
subtilis*] [SR:*Bacillus subtilis*(sub_species:Marburg, strain:168) DNA]
[DB:genpept-bct1] [DE:*B. subtilis* DNA, 180 kilobase region of replication
origin.] [LE:131477] [RE:131737] [DI:direct] >gp:[GI:e1181992:g2632326]
[LN:BSUB0001] [AC:Z99104:AL009126] [GN:yabO] [FN:unknown] [OR:*Bacillus
subtilis*] [DB:genpept-bct1] [DE:*Bacillus subtilis* complete genome (section 1
of 21): from 1 to 213080.] [NT:similar to hypothetical proteins] [SP:P37557]
[LE:67875] [RE:68135] [DI:direct]

| ORF Name | NT ID | AA ID | NT LN | AA LN | Score | P-Value |
|---|---|---|---|---|---|---|
| AI7503000980__1292767__c3__243 | 147 | 3919 | 138 | 45 | | |

Description
NO-HIT

| ORF Name | NT ID | AA ID | NT LN | AA LN | Score | P-Value |
|---|---|---|---|---|---|---|
| AI7503000980__12929625__c1__186 | 148 | 3920 | 810 | 269 | 819 | 1.2e-81 |

Description
sp:[LN:YAAT_BACSU] [AC:P37541] [GN:YAAT] [OR:*BACILLUS SUBTILIS*]
[DE:HYPOTHETICAL 31.2 KD PROTEIN IN XPAC-ABRB INTERGENIC REGION] [SP:P37541]
[DB:swissprot] >pir:[LN:S66062] [AC:S66062:A69738] [PN:signal peptidase II
homolog yaaT] [GN:yaaT] [OR:*Bacillus subtilis*] [DB:pir2]
>gp:[GI:d1005810:g467422] [LN:BAC180K] [AC:D26185] [PN:unknown] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:105257] [RE:106084] [DI:direct] >gp:[GI:e1181965:g2632299]
[LN:BSUB0001] [AC:Z99104:AL009126] [GN:yaaT] [FN:unknown) (OR:*Bacillus
subtilis*] [DB:genpept-bct1] [DE:*Bacillus subtilis* complete genome (section 1
of 21): from 1 to 213080.] [NT:similar to signal peptidase II] [SP:P37541]
[LE:41655] [RE:42482] [DI:direct]

| ORF Name | NT ID | AA ID | NT LN | AA LN | Score | P-Value |
|---|---|---|---|---|---|---|
| AI7503000980__13759688__c1__184 | 149 | 3921 | 615 | 204 | 527 | 1.1e-50 |

Description
sp:(LN:KTHY_BACSU] [AC:P37537] [GN:TMK] [OR:*BACILLUS SUBTILIS*] [EC:2.7.4.9]
[DE:THYMIDYLATE KINASE, (DTMP KINASE)] [SP:P37537] [DB:swissprot]
>pir:[LN:S66058] [AC:S66058:D69724] [PN:thymidylate kinase tmk] [GN:tmk]
[CL:dTMP kinase] [OR:*Bacillus subtilis*] [DB:pir2] >gp:[GI:d1005806:g467418]
[LN:BAC180K] [AC:D26185] [PN:unknown] [OR:*Bacillus subtilis*] [SR:*Bacillus*

*-continued*

*subtilis* (sub_species:Marburg, strain:168) DNA] [DB:genpept-bct1] [DE:*B. subtilis* DNA, 180 kilobase region of replication origin.] [LE:102759] [RE:103397] [DI:direct] >gp:[GI:e1181961:g2632295] [LN:BSUB0001] [AC:Z99104:AL009126] [PN:thymidylate kinase] [GN:tmk] [OR:*Bacillus subtilis*] [DB:genpept-bct1] [EC:2.7.4.9] [DE:*Bacillus subtilis* complete genome (section 1 of 21): from 1 to 213080.] [NT:alternate gene name:yaaP] [SP:P37537] [LE:39157] [RE:39795] [DI:direct]

| ORF Name | NT ID | AA ID | NT LN | AA LN | Score | P-Value |
|---|---|---|---|---|---|---|
| AI7503000980_14460015_f1_55 | 150 | 3922 | 141 | 46 | | |

Description
NO-HIT

| ORF Name | NT ID | AA ID | NT LN | AA LN | Score | P-Value |
|---|---|---|---|---|---|---|
| AI7503000980_16484577_f2_119 | 151 | 3923 | 153 | 50 | | |

Description
NO-HIT

| ORF Name | NT ID | AA ID | NT LN | AA LN | Score | P-Value |
|---|---|---|---|---|---|---|
| AI7503000980_16522641_f2_76 | 152 | 3924 | 597 | 198 | 207 | 1.9e-16 |

Description
gp:[GI:d1045277:g5106180] [LN:AP000064] [AC:AP000064] [PN:353aa long hypothetical protein] [GN:APE2475] [OR:*Aeropyrum pernix*] [SR:*Aeropyrum pernix* (strain:K1) DNA] [DB:genpept] [DE:*Aeropyrum pernix* genomic DNA, section 7/7.] [NT:similar to OWL:AP00000385 percent identity:66.667] [LE:151512] [RE:152573] [DI:direct]

| ORF Name | NT ID | AA ID | NT LN | AA LN | Score | P-Value |
|---|---|---|---|---|---|---|
| AI7503000980_16594202_c2_237 | 153 | 3925 | 480 | 159 | 383 | 1.9e-35 |

Description
sp:[LN:HPPK_BACSU] [AC:P29252] [GN:FOLK] [OR:*BACILLUS SUBTILIS*] [EC:2.7.6.3] [DE:(HPPK) (6-HYDROXYMETHYL-7,8-DIHYDROPTERIN PYROPHOSPHOKINASE) (PPPK)] [SP:P29252] [DB:swissprot] >pir:[LN:S66109] [AC:S66109:F37854:F69626] [PN:2-amino-4-hydroxy-6-hydroxymethyldihydropteridine pyrophosphokinase,:6-hydroxymethyl-7,8-dihydropterin pyrophosphokinase:7, 8-dihydro-6-hydroxymethylpterin pyrophosphokinase] [GM:folK] [CL:2-amino-4-hydroxy-6-hydroxymethyldihydropteridine pyrophosphokinase:2-amino-4-hydroxy-6-hydroxymethyldihydropteridine pyrophosphokinase homology] [OR:*Bacillus subtilis*] [EC:2.7.6.3] [DB:pir2] >gp:[GI:d1005856:g467468] [LM:BAC180K] [AC:D26185] [PM:7,8-dihydro-6-hydroxymethylpterin-pyrophosphokin] [GM:folk] [OR:*Bacillus subtilis*] [SR:*Bacillus subtilis*(sub_species:Marburg, strain:168) DNA] [DB:genpept-bct1] [DE:*B. subtilis* DNA, 180 kilobase region of replication origin.] [LE:150545] [RE:151048] [DI:direct] >gp:[GI:e1182012:g2632346] [LN:BSUB0001] [AC:Z99104:AL009126] [PN:7,8-dihydro-6-hydroxymethylpterin] [GM:folK] [FM:dihydrofolate biosynthesis] [OR:*Bacillus subtilis*] [DB:genpept-bct1] [EC:2.7.6.3] [DE:*Bacillus subtilis* complete genome (section 1 of 21): from 1 to 213080.] [LE:86943] [RE:87446] [DI:direct]

| ORF Name | NT ID | AA ID | NT LN | AA LN | Score | P-Value |
|---|---|---|---|---|---|---|
| AI7503000980_190875_f1_6 | 154 | 3926 | 210 | 69 | 70 | 0.028 |

Description
pir:[LN:S69873] [AC:S69873] [PM:hypothetical protein YML009w-a] [OR:*Saccharomyces cerevisiae*] [DB:pir2] [MP:13L]

| ORF Name | NT ID | AA ID | NT LN | AA LN | Score | P-Value |
|---|---|---|---|---|---|---|
| AI7503000980_194142_c1_194 | 155 | 3927 | 1386 | 461 | 1339 | 9.6e-137 |

Description
pir:[LN:S66080] [AC:S66080:I40018:C69629:S05371:S18903] [PN UDP-N-acetylglucosamine pyrophosphorylase gcaD cell division protein tms26:tms protein] [GN:gcaD:tms26] [CL:N-acetylglucosamine-1-phosphate uridyltransferase] [OR:*Bacillus subtilis*] [DB:pir2] >gp:[GI:d1005827:g467439] [LN:BAC180K] [AC:D26185] [PN:temperature sensitive cell division] [GN:tms26] [OR:*Bacillus subtilis*] [SR:*Bacillus subtilis* (sub_species:Marburg, strain:168) DNA) DB:genpept-bct1] [DE:*B. subtilis* DNA, 180 kilobase region of replication origin.] [LE:119952] [RE:121322] [DI:direct] >gp:[GI:e1181983:g2632317] [LN:BSUB0001] [AC:Z99104:AL009126]

-continued

[PN:UDP-N-acetylglucosamine pyrophosphorylase] [GN:gcaD] [FN peptidoglycan
and lipopolysaccharide] [OR:*Bacillus subtilis*] [DB:genpept-bct1]
[EC:2.7.7.23] [DE:*Bacillus subtilis* complete genome (section 1 of 21): from
1 to 213080.] [NT:alternate gene name:tms, tms26] [SP:P14192] [LE:56350]
[RE:57720] [DI:direct]

| ORF Name | NT ID | AA ID | NT LN | AA LN | Score | P-Value |
|---|---|---|---|---|---|---|
| AI7503000980__20335927__f2__69 | 156 | 3928 | 153 | 50 | | |

Description
NO-HIT

| ORF Name | NT ID | AA ID | NT LN | AA LN | Score | P-Value |
|---|---|---|---|---|---|---|
| AI7503000980__211687__c3__261 | 157 | 3928 | 897 | 298 | 985 | 3.1e-99 |

Description
sp:[LN:YACC__BACSU] [AC:P37565] [GN:YACC] [OR:*BACILLUS SUBTILIS*]
[DE:HYPOTHETICAL 31.8 KD PROTEIN IN FTSH-CYSK INTERGENIC REGION] [SP:P37565]
[DB:swissprot] >pir:[LN:S66101] [AC:S66101:F69740] [PN:conserved
hypothetical protein yacC] [GN:yacC] [CL:conserved hypothetical protein
sll19881] [OR:*Bacillus subtilis*] [DB:pir2] >gp:[GI:d1005848:g467460]
[LN:BAC180K] [AC:D26185] [PN:unknown] [OR:*Bacillus subtilis*] [SR:*Bacillus
subtilis* (sub_species:Marburg, strain:168) DNA] [DB:genpept-bct1] [DE:*B.
subtilis* DNA, 180 kilobase region of replication origin.] [LE:143479]
[RE:144354] [DI:direct] >gp:[GI:e1182004:g2632338] [LN:BSUB0001]
[AC:Z99104:AL009126] [GN:yacC] [FN:unknown] [OR:*Bacillus subtilis*]
[DB:genpept-bct1] [DE:*Bacillus subtilis* complete genome (section 1 of 21):
from 1 to 213080.] [NT:similar to hypothetical proteins] [SP:P37565]
[LE:79877] [RE:80752] [DI:direct]

| ORF Name | NT ID | AA ID | NT LN | AA LN | Score | P-Value |
|---|---|---|---|---|---|---|
| AI7503000980__21579131__f3__157 | 158 | 3980 | 123 | 40 | | |

Description
NO-HIT

| ORF Name | NT ID | AA ID | NT LN | AA LN | Score | P-Value |
|---|---|---|---|---|---|---|
| AI7503000980__22694002__c3__258 | 159 | 3931 | 546 | 181 | 544 | 1.7e-52 |

Description
sp:[LN:HPRT__BACSU] [AC:P37472] [GN:HPRT:HPT] [OR:*BACILLUS SUBTILIS*]
[EC:2.4.2.8] [DE:(HGPRTASE)] [SP:P37472] [DB:swissprot] >pir:[LN:S66098]
[AC:S66098:E69642] [PN:hypoxanthine phosphoribosyltransferase,
hprT:hypoxanthine-guanine phosphoribosyltransferase hprT] [GN:hprT]
[CL:hypoxanthine phosphoribosyltransferase] [OR:*Bacillus subtilis*]
[EC:2.4.2.8] [DB:pir2] >gp:[GI:d1005845:g467457] [LN:BAC180K] [AC:D26185]
[PN:hypoxanthine-guanine phosphoribosyltransferase] [GN:hprt] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:139944] [RE:140486] [DI:direct] >gp:[GI:e1182001:g2632335]
[LN:BSUB0001] [AC:Z99104:AL009126] [PN:hypoxanthine-guanine
phosphoribosyltransferase] [GN:hprT] [FN:purine salvage] [OR:*Bacillus
subtilis*] [DB:genpept-bct1] [EC:2.4.2.8] [DE:*Bacillus subtilis* complete
genome (section 1 of 21): from 1 to 213080.] [SP:P37472] [LE:76342]
[RE:76884] [DI:direct]

| ORF Name | NT ID | AA ID | NT LN | AA LN | Score | P-Value |
|---|---|---|---|---|---|---|
| AI7503000980__23445130__c1__207 | 160 | 3932 | 417 | 138 | 134 | 4.1e-08 |

Description
gp:[GI:e1182000:g2632334] [LN:BSUB0001] [AC:Z99104:AL009126] [GN:yacA]
[FN:unknown] [OR:*Bacillus subtilis*] [DB:genpept-bct1] [DE:*Bacillus subtilis*
complete genome (section 1 of 21): from 1 to 213080.] [NT:similar to
cell-cycle protein] [LE:74927] [RE:76345] [DI:direct]

| ORF Name | NT ID | AA ID | NT LN | AA LN | Score | P-Value |
|---|---|---|---|---|---|---|
| AI7503000980__23601702__c1__190 | 161 | 3933 | 891 | 296 | 919 | 3.1e-92 |

Description
sp:[LN:KSGA__BACSU] [AC:P37468] [GN:KSGA] [OR:*BACILLUS SUBTILIS*] [EC:2.1.1.-]
[DE:DIMETHYLTRANSFERASE)] [SP:P37468] [DB:swissprot] >pir:[LN:S66071]
[AC:S66071:A69649] [PN:dimethyladenosine transferase ksgA:high level
kasgamycin resistance protein ksgA] [GN:ksgA] [CL:rRNA -continued (adenine-N6-)-methyltransferase] [OR:*Bacillus subtilis*] [DB:pir2]
>gp:[GI:d1005819:g467431] [LN:BAC180K] [AC:D26185] [PN:high level kasgamycin
resistance] [GN:ksgA] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:114240] [RE:115118]
[DI:direct] >gp:[GI:e1181975:g2632309] [LN:BSUB0001] [AC:Z99104:AL009126]
[PN:dimethyladenosine transferase] [GN:ksgA] [FN:high level kasugamycin
resistance] [OR:*Bacillus subtilis*] [DB:genpept-bct1] [EC:2.1.1.-]
[DE:*Bacillus subtilis* complete genome (section 1 of 21): from 1 to 213080.]
[SP:P37468] [LE:50638] [RE:51516] [DI:direct]

| ORF Name | NT ID | AA ID | NT LN | AA LN | Score | P-Value |
|---|---|---|---|---|---|---|
| AI7503000980_23605438_c2_238 | 162 | 3934 | 144 | 47 | | |

Description
NO-HIT

| ORF Name | NT ID | AA ID | NT LN | AA LN | Score | P-Value |
|---|---|---|---|---|---|---|
| AI7503000980_2361327_c3_250 | 163 | 3935 | 966 | 321 | 1225 | 1.1e-124 |

Description
gp:[GI:g2289093] [LN:CAU76387] [AC:U76387] [PN:PRPP synthetase] [GN:prs]
[OR:*Corynebacterium ammoniagenes*] [DB:genpept-bct1] [EC:2.7.6.1]
[DE:*Corynebacterium ammoniagenes* N-acetyl glucoseamine
1-phosphateuridyltransferase (glmU) gene, partial cds, and
PRPP-synthetase(prs) gene, complete cds.] [LE:321] [RE:1274] [DI:direct]

| ORF Name | NT ID | AA ID | NT LN | AA LN | Score | P-Value |
|---|---|---|---|---|---|---|
| AI7503000980_23642135_c1_185 | 164 | 3936 | 357 | 118 | 389 | 4.5e-36 |

Description
sp:[LN:YAAQ_BACSU] [AC:P37538] [GN:YAAQ] [OR:*BACILLUS SUBTILIS*]
[DE:HYPOTHETICAL 12.0 KD PROTEIN IN XPAC-ABRB INTERGENIC REGION] [SP:P37538]
[DB:swissprot] >pir:[LN:S66059] [AC:S66059:G69737] [PN:conserved
hypothetical protein yaaQ] [GN:yaaQ] [OR:*Bacillus subtilis*] [DB:pir2]
>gp:[GI:d1005807:g467419] [LN:BAC180K] [AC:D26185] [PN:unknown] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:103471] [RE:103800] [DI:direct] >gp:[GI:e1181962:g2632296]
[LN:BSUB0001] [AC:Z99104:AL009126] [GN:yaaQ] [FN:unknown] [OR:*Bacillus
subtilis*] [DB:genpept-bct1] [DE:*Bacillus subtilis* complete genome (section 1
of 21): from 1 to 213080.] [NT:similar to hypothetical proteins] [SP:P37538]
[LE:39869] [RE:40198] [DI:direct]

| ORF Name | NT ID | AA ID | NT LN | AA LN | Score | P-Value |
|---|---|---|---|---|---|---|
| AI7503000980_23860952_c1_206 | 165 | 3937 | 882 | 293 | 304 | 4.5e-27 |

Description
gp:[GI:g4981097] [LN:AE001733] [AC:AE001733:AE000512] [PN:conserved
hypothetical protein] [GN:TM0579] [OR:*Thermotoga maritima*] [DB:genpept-bct2]
[DE:*Thermotoga maritima* section 45 of 136 of the complete genome.]
[NT:similar to GB:AE000657 percent identity:59.32;] [LE:230] [RE:1474]
[DI:direct]

| ORF Name | NT ID | AA ID | NT LN | AA LN | Score | P-Value |
|---|---|---|---|---|---|---|
| AI7503000980_24350952_f3_120 | 166 | 3938 | 132 | 43 | 72 | 0.017 |

Description
pir:[LN:G71244] [AC:G71244] [PN:hypothetical protein PH0217] [GN:PH0217]
[OR:*Pyrococcus horikoshii*] [DB:pir2] >gp:[GI:d1030229:g3256603]
[LN:AP000001]
[AC:AP000001:AB009465:AB009464:AB009466:AB009467:AB009468:AB009469]
[PN:106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1–287000 nt. position (1/7).] [LE:191072]
[RE:191392] [DI:complement]

| ORF Name | NT ID | AA ID | NT LN | AA LN | Score | P-Value |
|---|---|---|---|---|---|---|
| AI7503000980_24647936_c3_256 | 167 | 3939 | 408 | 135 | 172 | 4.4e-13 |

Description
gp:[GI:g4090866] [LN:AF023181] [AC:AF023181] [PN:DivIC homolog] [GN:divL]

[OR:*Listeria monocytogenes*] [DB:genpept-bct2] [DE:*Listeria monocytogenes* transcription-repair coupling factor (mfdL), low temperature requirement B protein (ltrB), and DivIC homolog(divL) genes, complete cds.] [LE:6077] [RE:6463] [DI:direct]

| ORF Name | NT ID | AA ID | NT LN | AA LN | Score | P-Value |
|---|---|---|---|---|---|---|
| AI7503000980__24649092__c2__236 | 168 | 3940 | 378 | 125 | 351 | 4.7e-32 |

Description
sp:[LN:FOLB__STAHA] [AC:Q59920] [GN:FOLB:FOLQ] [OR:*STAPHYLOCOCCUS HAEMOLYTICUS*] [EC:4.1.2.25] [DE:DIHYDRONEOPTERIN ALDOLASE, (DHNA) (FRAGMENT)] [SP:Q59920] [DB:swissprot] >gp:[GI:g1118003] [LN:SHU40768] [AC:U40768] [PN:dihydroneopterin aldolase] [GN:folQ] [OR:*Staphylococcus haemolyticus*] [DB:genpept-bct2] [EC:4.1.2.25] [DE:*Staphylococcus haemolyticus* cysteine synthase A (cysK) and dihydroneopterin aldolase (folQ) genes, partial cds, and dihydropteroate synthase (folP) gene, complete cds.] [NT:DHNA] [LE:1467] [RE:>1724] [DI:direct]

| ORF Name | NT ID | AA ID | NT LN | AA LN | Score | P-Value |
|---|---|---|---|---|---|---|
| AI7503000980__24663892__c3__251 | 169 | 3941 | 1881 | 626 | 1224 | 1.5e-124 |

Description
sp:[LN:MFD__BACSU] [AC:P37474] [GN:MFD] [OR:*BACILLUS SUBTILIS*] [DE:TRANSCRIPTION-REPAIR COUPLING FACTOR (TRCF)] [SP:P37474] [DB:swissprot] >pir:[LN:S66085] [AC:S66085:F69657] [PN:transcription-repair coupling factor mfd] [GN:mfd] [CL:transcription-repair coupling protein:DEAD/H box helicase homology] [OR:*Bacillus subtilis*] [DB:pir2] >gp:[GI:d1005832:g467444] [LN:BAC180K] [AC:D26185] [PN:transcription-repair coupling factor] [GN:mfd] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:124030] [RE:127563] [DI:direct] >gp:[GI:e1181988:g2632322] [LN:BSUB0001] [AC:Z99104:AL009126] [PN:transcription-repair coupling factor] [GN:mfd] [FN:probably involved in homologous DNA] [OR:*Bacillus subtilis*] [DB:genpept-bct1] [DE:*Bacillus subtilis* complete genome (section 1 of 21): from 1 to 213080.] [SP:P37474] [LE:60428] [RE:63961] [DI:direct]

| ORF Name | NT ID | AA ID | NT LN | AA LN | Score | P-Value |
|---|---|---|---|---|---|---|
| AI7503000980__24734661__f1__13 | 170 | 3942 | 138 | 45 | | |

Description
NO-HIT

| ORF Name | NT ID | AA ID | NT LN | AA LN | Score | P-Value |
|---|---|---|---|---|---|---|
| AI7503000980__24790916__c1__208 | 171 | 3943 | 2106 | 701 | 2133 | 6.9e-221 |

Description
sp:[LN:FTSH__BACSU] [AC:P37476] [GN:FTSH] [OR:*BACILLUS SUBTILIS*] [EC:3.4.24.-] [DE:CELL DIVISION PROTEIN FTSH HOMOLOG,] [SP:P37476] [DB:swissprot] >pir:[LN:E69627] [AC:E69627:566099] [PN:cell-division protein/general stress protein ftsH:class III heat shock protein ftsH] [GN:ftsH] [CL:cell division protein ftsH:FtsH/SEC18/CDC48-type ATP-binding domain homology] [OR:*Bacillus subtilis*] [DB:pir2] >gp:[GI:d1005846:g467458] [LN:BAC180K] [AC:D26185] [PN:cell division protein] [GN:ftsH] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:140584] [RE:142497] [DI:direct] >gp:[GI:e1182002:g2632336] [LN:BSUB0001] [AC:Z99104:AL009126] [PN:cell-division protein and general stress protein] [GN:ftsH] [FN:involved in major cellular processes such as] [OR:*Bacillus subtilis*] [DB:genpept-bct1] [EC:3.4.24.-] [DE:*Bacillus subtilis* complete genome (section 1 of 21): from 1 to 213080.] [LSP:P37476] [LE:76982] [RE:78895] [DI:direct]

| ORF Name | NT ID | AA ID | NT LN | AA LN | Score | P-Value |
|---|---|---|---|---|---|---|
| AI7503000980__25662965__c1__195 | 172 | 3944 | 729 | 242 | 463 | 6.4e-44 |

Description
sp:[LN:CTC__BACSU] [AC:P14194] [GN:CTC] [OR:*BACILLUS SUBTILIS*] [DE:GENERAL STRESS PROTEIN CTC] [SP:P14194] [DB:swissprot]

| ORF Name | NT ID | AA ID | NT LN | AA LN | Score | P-Value |
|---|---|---|---|---|---|---|
| AI7503000980__26210061__f2__99 | 173 | 3945 | 144 | 47 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000980__26839660__c3__246 | 174 | 3946 | 855 | 284 | 842 | 4.4e-84 |

Description
gp:[GI:e1386912:g4454322] [LN:SAU132803] [AC:AJ132803] [PN:hypothetical protein] [OR:*Staphylococcus aureus*] [DB:genpept-bct1] [DE:*Staphylococcus aureus* ORF1 and ORF2 (partial).] [NT:ORF2] [LE:1402] [RE:>2052] [DI:direct]

| ORF Name | NT ID | AA ID | NT LN | AA LN | Score | P-Value |
|---|---|---|---|---|---|---|
| AI7503000980__2928502__c3__262 | 175 | 3947 | 960 | 319 | 1166 | 2.1e-118 |

Description
sp:[LN:CYSK_BACSU] [AC:P37887] [GN:CYSK] [OR:*BACILLUS SUBTILIS*] [EC:4.2.99.8] [DE:PROTEIN 11) (SOI11)] [SP:P37887] [DB:swissprot]

| ORF Name | NT ID | AA ID | NT LN | AA LN | Score | P-Value |
|---|---|---|---|---|---|---|
| AI7503000980__29298162__f2__118 | 176 | 3948 | 123 | 40 | | |

| Description | | | | | | |
|---|---|---|---|---|---|---|
| NO-HIT | | | | | | |
| ORF Name | NT ID | AA ID | NT LN | AA LN | Score | P-Value |
| AI7503000980__29307187__c2__213 | 177 | 3949 | 165 | 54 | | |

| Description | | | | | | |
|---|---|---|---|---|---|---|
| NO-HIT | | | | | | |
| ORF Name | NT ID | AA ID | NT LN | AA LN | Score | P-Value |
| AI7503000980__31446881__c2__215 | 178 | 3950 | 351 | 116 | 194 | 2.1e-15 |

Description
sp:[LN:YABA_BACSU] [AC:P37542] [GN:YABA] [OR:*BACILLUS SUBTILIS*] [DE:HYPOTHETICAL 14.1 KD PROTEIN IN XPAC-ABRB INTERGENIC REGION] [SP:P37542] [DB:swissprot] >pir:[LN:S66063] [AC:S66063:B69738] [PN:hypothetical protein yabA] [GN:yabA] [OR:*Bacillus subtilis*] [DB:pir2] >gp:[GI:d1005811:g467423] [LN:BAC180K] [AC:D26185] [PN:unknown] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:106099] [RE:106458] [DI:direct] >gp:[GI:e1181966:g2632300] [LN:BSUB0001] [AC:Z99104:AL009126] [GN:yabA] [FN:unknown] [OR:*Bacillus subtilis*] [DB:genpept-bct1] [DE:*Bacillus subtilis* complete genome (section 1 of 21): from 1 to 213080.] [SP:P37542] [LE:42497] [RE:42856] [DI:direct]

| ORF Name | NT ID | AA ID | NT LN | AA LN | Score | P-Value |
|---|---|---|---|---|---|---|
| AI7503000980__32615811__f3__166 | 179 | 3951 | 189 | 62 | | |

| Description | | | | | | |
|---|---|---|---|---|---|---|
| NO-HIT | | | | | | |
| ORF Name | NT ID | AA ID | NT LN | AA LN | Score | P-Value |
| AI7503000980__33225017__c2__222 | 180 | 3952 | 867 | 288 | 792 | 8.8e-79 |

Description
sp:[LN:PURR_BACSU] [AC:P37551] [GN:PURR] [OR:*BACILLUS SUBTILIS*] [DE:PUR OPERON REPRESSOR] [SP:P37551] [DB:swissprot] >pir:[LN:S66076] [AC:S66076:D69685] [PN:transcription repressor of purine operon purR] [GN:purR] [OR:*Bacillus subtilis*] [DB:pir2] >gp:[GI:d1005824:g467436] [LN:BAC180K] [AC:D26185] [PN:unknown] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:118041] [RE:118898] [DI:direct] >gp:[GI:e1181980:g2632314] [LN:BSUB0001] [AC:Z99104:AL009126] [PN:transcriptional regulator] [GN:purR] [FN:negative regulation of the purine operon] [OR:*Bacillus subtilis*] [DB:genpept-bct1] [DE:*Bacillus subtilis* complete genome (section 1 of 21): from 1 to 213080.] [NT:alternate gene name:yabI] [SP:P37551] [LE:54439] [RE:55296] [DI:direct]

| ORF Name | NT ID | AA ID | NT LN | AA LN | Score | P-Value |
|---|---|---|---|---|---|---|
| AI7503000980__33313817__c1__192 | 181 | 3953 | 333 | 110 | 323 | 4.4e-29 |

-continued

Description
sp:[LN:SP5G_BACME] [AC:P28016] [GN:SPOVG] [OR:*BACILLUS MEGATERIUM*] [DE:STAGE
V SPORULATION PROTEIN G] [SP:P28016] [DB:swissprot] >pir:[LN:S18900]
[AC:S18900] [PN:spoVG protein] [CL:stage V sporulation protein spoVG]
[OR:*Bacillus megaterium*] [DB:pir2] >gp:[GI:g39656] [LN:BMSPOVG] [AC:X62377]
[GN:spoVG] [OR:*Bacillus megaterium*] [DB:genpept-bct1] [DE:*B. megaterium* spoVG
and tms genes.] [SP:P28016] [LE:31] [RE:321] [DI:direct]

| ORF Name | NT ID | AA ID | NT LN | AA LN | Score | P-Value |
|---|---|---|---|---|---|---|
| AI7503000980_34001510_c2_218 | 182 | 3954 | 798 | 265 | 916 | 6.4e-92 |

Description
sp:[LN:YABD_BACSU] [AC:P37545] [GN:YABD] [OR:*BACILLUS SUBTILIS*]
[DE:HYPOTHETICAL 29.2 KD PROTEIN IN METS-KSGA INTERGENIC REGION] [SP:P37545]
[DB:swissprot] >pir:[LN:S66068] [AC:S66068:E69738] [PN:conserved
hypothetical protein yabD] [GN:yabD] [CL:hypothetical protein HI0454]
[OR:*Bacillus subtilis*] [DB:pir2] >gp:[GI:d1005816:g4G7428] [LN:BAC180K]
[AC:D26185] [PN:unknown] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:111306] [RE:112073]
[DI:direct] >gp:[GI:e1181972:g2632306] [LN:BSUB0001] [AC:Z99104:AL009126]
[GN:yabD] [FN:unknown] [OR:*Bacillus subtilis*] [DB:genpept-bct1] [DE:*Bacillus
subtilis* complete genome (section 1 of 21): from 1 to 213080.] [NT:similar to
hypothetical proteins] [SP:P37545] [LE:47704] [RE:48471] [DI:direct]

| ORF Name | NT ID | AA ID | NT LN | AA LN | Score | P-Value |
|---|---|---|---|---|---|---|
| AI7503000980_34428515_c1_191 | 183 | 3955 | 285 | 94 | 284 | 6.0e-25 |

Description
sp:[LN:VEG_BACSU] [AC:P37466] [GN:VEG] [OR:*BACILLUS SUBTILIS*] [DE:VEG
PROTEIN] [SP:P37466] [DB:swissprot] >pir:[LN:S66073] [AC:S66073:C69730]
[PN:hypothetical protein veg] [GN:veg] [OR:*Bacillus subtilis*] [DB:pir2]
>gp:[GI:d1005821:g467433] [LN:BAC180K] [AC:D26185] [PN:unknown] [GN:veg]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:116363] [RE:11.6623] [DI:direct]
>gp:[GI:e1181977:g2632311] [LN:BSUB0001] [AC:Z99104:AL009126] [GN:veg]
[FN:unknown] [OR:*Bacillus subtilis*] [DB:genpept-bct1] [DE:*Bacillus subtilis*
complete genome (section 1 of 21): from 1 to 213080.] [SP:P37466] [LE:52761]
[RE:53021] [DI:direct]

| ORF Name | NT ID | AA ID | NT LN | AA LN | Score | P-Value |
|---|---|---|---|---|---|---|
| AI7503000980_34571011_c3_252 | 184 | 3956 | 1608 | 535 | 1712 | 2.8e-176 |

Description
sp:[LN:MFD_BACSU] [AC:P37474] [GN:MFD] [OR:*BACILLUS SUBTILIS*]
[DE:TRANSCRIPTION-REPAIR COUPLING FACTOR (TRCF)] [SP:P37474] [DB:swissprot]
>pir:[LN:S66085] [AC:S66085:F69657] [PN:transcription-repair coupling
factor mfd] [GN:mfd] [CL:transcription-repair coupling protein:DEAD/H box
helicase homology] [OR:*Bacillus subtilis*] [DB:pir2]
>gp:[GI:d1005832:g467444] [LN:BAC180K] [AC:D26185] [PN:transcription-repair
coupling factor] [GN:mfd] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:124030] [RE:127563]
[DI:direct] >gp:[GI:e1181988:g2632322] [LN:BSUB0001] [AC:Z99104:AL009126]
[PN:transcription-repair coupling factor] [GN:mfd] [FN:probably involved in
homologous DNA] [OR:*Bacillus subtilis*] [DB:genpept-bct1] [DE:*Bacillus
subtilis* complete genome (section 1 of 21): from 1 to 213080.] [SP:P37474]
[LE:60428] [RE:63961] [DI:direct]

| ORF Name | NT ID | AA ID | NT LN | AA LN | Score | P-Value |
|---|---|---|---|---|---|---|
| AI7503000980_35260887_c1_193 | 185 | 3957 | 141 | 46 | | |

Description
NO-HIT

| ORF Name | NT ID | AA ID | NT LN | AA LN | Score | P-Value |
|---|---|---|---|---|---|---|
| AI7503000980_3553_c3_245 | 186 | 3958 | 972 | 323 | 382 | 2.5e-35 |

Description
sp:[LN:HOLB_BACSU] [AC:P37540] [GN:HOLB] [OR:*BACILLUS SUBTILIS*] [EC:2.7.7.7]
[DE:DNA POLYMERASE III, DELTA' SUBUNIT,] [SP:P37540] [DB:swissprot]
>pir:[LN:S66061] [AC:S66061:C69642] [PN:DNA polymerase III (delta' subunit)
holB:dnaH homolog holB] [GN:holB] [OR:*Bacillus subtilis*] [DB:pir2]
>gp:[GI:d1005809:g467421] [LN:BAC180K] [AC:D26185] [PN:similar to *B.*

-continued

*subtilis* DnaH] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:104265] [RE:105254]
[DI:direct] >gp:[GI:e1181964:g2632298] [LN:BSUB0001] [AC:Z99104:AL009126]
[PN:DNA polymerase III (delta' subunit)] [GN:holB] [OR:*Bacillus subtilis*]
[DB:genpept-bct1] [EC:2.7.7.7] [DE:*Bacillus subtilis* complete genome
(section 1 of 21): from 1 to 213080.] [NT:alternate gene name:yaaS]
(SP:P37540] [LE:40663] [RE:41652] [DI:direct]

| ORF Name | NT ID | AA ID | NT LN | AA LN | Score | P-Value |
|---|---|---|---|---|---|---|
| AI7503000980_3916087_c2_216 | 187 | 3959 | 261 | 86 | 243 | 1.3e-20 |

Description
pir:[LN:A69742] [AC:A69742] [PN:conserved hypothetical protein yazA]
[GN:yazA] [CL:hypothetical protein 312] [OR:*Bacillus subtilis*] [DB:pir2]
>gp:[GI:e1181968:g2632302] [LN:BSUB0001] [AC:Z99104:AL009126] [GN:yazA]
[FN:unknown] [OR:*Bacillus subtilis*] [DB:genpept-bct1] [DE:*Bacillus subtilis*
complete genome (section 1 of 21): from 1 to 213080.] [NT:similar to
hypothetical proteins] [LE:43645] [RE:43944] [DI:direct]

| ORF Name | NT ID | AA ID | NT LN | AA LN | Score | P-Value |
|---|---|---|---|---|---|---|
| AI7503000980_3937950_f2_71 | 188 | 3960 | 186 | 61 | | |

Description
NO-HIT

| ORF Name | NT ID | AA ID | NT LN | AA LN | Score | P-Value |
|---|---|---|---|---|---|---|
| AI7503000980_3938838_c1_210 | 189 | 3961 | 846 | 281 | 1087 | 4.8e-110 |

Description
sp:[LN:DHPS_STAHA] [AC:Q59919] [GN:FOLP] [OR:*STAPHYLOCOCCUS HAEMOLYTICUS*]
[EC:2.5.1.15] [DE:PYROPHOSPHORYLASE) (DHPS)] [SP:Q59919] [DB:swissprot]
>gp:[GI:g1118002] [LN:SHU40768] [AC:U40768] [PN:dihydropteroate synthase]
[GN:folP] [OR:*Staphylococcus haemolyticus*] [DB:genpept-bct2] [EC:2.5.1.15]
[DE:*Staphylococcus haemolyticus* cysteine synthase A (cysK)
and dihydroneopterin aldolase (folQ) genes, partial cds, and dihydropteroate
synthase (folP) gene, complete cds.] [NT:DHPS] [LE:692] [RE:1495]
[DI:direct]

| ORF Name | NT ID | AA ID | NT LN | AA LN | Score | P-Value |
|---|---|---|---|---|---|---|
| AI7503000980_4034707_f2_114 | 190 | 3962 | 144 | 47 | | |

Description
NO-HIT

| ORF Name | NT ID | AA ID | NT LN | AA LN | Score | P-Value |
|---|---|---|---|---|---|---|
| AI7503000980_4723192_c1_196 | 191 | 3963 | 606 | 201 | 539 | 5.7e-52 |

Description
sp:[LN:SP5C_BACSU] [AC:P37470] [GN:SPOVC:PTH] [OR:*BACILLUS SUBTILIS*]
[EC:3.1.1.29] [DE:SPORULATION PROTEIN C)] [SP:P37470] [DB:swissprot]
>pir:[LN:C69715] [AC:C69715:S66083] [PN:stage V sporulation protein
spoVC:spore coat formation protein spoVC] [GN:spoVC] [CL:peptidyl-tRNA
hydrolase] [OR:*Bacillus subtilis*] [DB:pir2] >gp:[GI:d1005830:g4674421
[LN:BAC180K] [AC:D26185] [PN:stage V sporulation] [GN:spoVC] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:123104] [RE:123670] [DI:direct] >gp:[GI:e1181986:g2632320]
[LN:BSUB0001] [AC:Z99104:AL009126] [GN:spoVC] [OR:*Bacillus subtilis*]
[DB:genpept-bct1] [DE:*Bacillus subtilis* complete genome (section 1 of 21):
from 1 to 213080.] [NT:thermosensitive mutant blocks spore coat formation]
[SP:P37470] [LE:59502] [RE:60068] [DI:direct]

| ORF Name | NT ID | AA ID | NT LN | AA LN | Score | P-Value |
|---|---|---|---|---|---|---|
| AI7503000980_4775312_c3_257 | 192 | 3964 | 405 | 134 | 436 | 4.7e-41 |

Description
sp:[LN:YABR_BACSU] [AC:P37560] [GN:YABR] [OR:*BACILLUS SUBTILIS*]
[DE:HYPOTHETICAL 14.2 KD PROTEIN IN DIVIC-SPOIIE INTERGENIC REGION]
[SP:P37560] [DB:swissprot] >pir:[LN:C53380] [AC:C53380:S66093:A69740]
[PN:polyribonucleotide nucleotidyltransferase homolog yabR:divIC 3'-region
hypothetical protein] [GN:yabR] [CL:polyribonucleotide
nucleotidyltransferase homolog yabR] [OR:*Bacillus subtilis*] [DB:pir2]

-continued

>gp:[GI:d1005840:g467452] [LN:BAC180K] [AC:D26185] [PN:unknown] [OR:*Bacillus subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:133226] [RE:133612] [DI:direct] >gp:[GI:g385178] [LN:BACDIVIC]
[AC:L23497] [PN:unknown] [OR:*Bacillus subtilis*] [DB:genpept-bct1]
[DE:*Bacillus subtilis* cell division protein (divIC) gene, complete
cds, transfer RNA genes, complete sequence and sporulation protein (spoIIE)
gene, 5' end of cds.] [NT:orf128; homologous to RNA binding domain of *E. coli*] [LE:914] [RE:1300] [DI:direct] >gp:[GI:e1181996:g2632330]
[LN:BSUB0001] [AC:Z99104:AL009126] [GN:yabR] [FN:unknown] [OR:*Bacillus subtilis*] [DB:genpept-bct1] [DE:*Bacillus subtilis* complete genome (section 1
of 21): from 1 to 213080.] [NT:similar to polyribonucleotide] [SP:P37560]
[LE:69624] [RE:70010] [DI:direct]

| ORF Name | NT ID | AA ID | NT LN | AA LN | Score | P-Value |
|---|---|---|---|---|---|---|
| AI7503000980__4884625__c1__189 | 193 | 3965 | 549 | 182 | 445 | 5.2e-42 |

Description
sp:[LN:YABF_BACSU] [AC:P37547] [GN:YABF] [OR:*BACILLUS SUBTILIS*]
[DE:HYPOTHETICAL 20.7 KD PROTEIN IN METS-KSGA INTERGENIC REGION] [SP:P37547]
[DB:swissprot] >pir:[LN:S66070] [AC:S66070:G69738] [PN:conserved
hypothetical protein yabF] [GN:yabF] [OR:*Bacillus subtilis*] [DB:pir2]
>gp:[GI:d1005818:g467430] [LN:BAC180K] [AC:D26185] [PN:unknown] [OR:*Bacillus subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:113687] [RE:114247] [DI:direct] >gp:[GI:e1181974:g2632308]
[LN:BSUB0001] [AC:Z99104:AL009126] [GN:yabF] [FN:unknown] [OR:*Bacillus subtilis*] [DB:genpept-bct1] [DE:*Bacillus subtilis* complete genome (section 1
of 21): from 1 to 213080.] [NT:similar to hypothetical proteins] [SP:P37547]
[LE:50085] [RE:50645] [DI:direct]

| ORF Name | NT ID | AA ID | NT LN | AA LN | Score | P-Value |
|---|---|---|---|---|---|---|
| AI7503000980__5317151__c3__264 | 194 | 3966 | 177 | 58 | | |

Description
NO-HIT

| ORF Name | NT ID | AA ID | NT LN | AA LN | Score | P-Value |
|---|---|---|---|---|---|---|
| AI7503000980__5344015__c3__255 | 195 | 3967 | 1281 | 426 | 849 | 8.0e-85 |

Description
sp:[LN:YABN_BACSU] [AC:P37556] [GN:YABN] [OR:*BACILLUS SUBTILIS*]
[DE:HYPOTHETICAL 56.1 KD PROTEIN IN MFD-DIVIC INTERGENIC REGION] [SP:P37556]
[DB:swissprot] >pir:[LN:S66088] [AC:S66088:E69739] [PN:conserved
hypothetical protein yabN:beta-lactamase regulatory protein homolog yabN]
[GN:yabN] [CL:beta-lactamase regulatory protein homolog:beta-lactamase
regulatory protein homology] [OR:*Bacillus subtilis*] [DB:pir2]
>gp:[GI:d1005835:g467447] [LN:BAC180K] [AC:D26185] [PN:unknown] [OR:*Bacillus subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:130005] [RE:131474] [DI:direct] >gp:[GI:e1181991:g2632325]
[LN:BSUB0001] [AC:Z99104:AL009126] [GN:yabN] [FN:unknown] [OR:*Bacillus subtilis*] [DB:genpept-bct1] [DE:*Bacillus subtilis* complete genome (section 1
of 21): from 1 to 213080.] [NT:similar to hypothetical proteins] [SP:P37556]
[LE:66403] [RE:67872] [DI:direct]

| ORF Name | NT ID | AA ID | NT LN | AA LN | Score | P-Value |
|---|---|---|---|---|---|---|
| AI7503000980__5367813__c3__244 | 196 | 3968 | 543 | 180 | 432 | 1.2e-40 |

Description
sp:[LN:ATDA_ECOLI] [AC:P37354] [GN:SPEG] [OR:*ESCHERICHIA COLI*] [EC:2.3.1.57]
[DE:ACETYLTRANSFERASE) (SAT)] [SP:P37354] [DB:swissprot]
>gp:[GI:d1016007:g1742583] [LN:D90799] [AC:D90799:AB001340] [PN:Spermidine
N1-acetyltransferase (EC 2.3.1.57)] [GN:speG] [OR:*Escherichia coli*]
[SR:*Escherichia coli* (strain:K12) DNA, clone_lib:Kohara lambda minise]
[DB:genpept-bct1] [DE:*E. coli* genomic DNA, Kohara clone #308(35.3–35.7
min.).] [NT:ORF ID:o309#16; similar to [SwissProt Accession] [LE:<18154]
[RE:18711] [DI:direct] >gp:[GI:d1016029:g1742606] [LN:D90800]
[AC:D90800:AB001340] [PN:Spermidine N1-acetyltransferase (EC 2.3.1.57)]
[GN:speG] [OR:*Escherichia coli*] [SR:*Escherichia coli* (strain:K12) DNA,
clone_lib:Kohara lambda minise) [DB:genpept-bct1] [DE:*E. coli* genomic DNA,
Kohara clone #309(35.4–35.7 min.).] [NT:ORF_ID:o309#16; similar to
[SwissProt Accession] [LE:<14930] [RE:15487] [DI:direct]
>gp:[GI:d1016031:g1742609] [LN:D90801] [AC:D90801:AB001340] [PN:Spermidine
N1-acetyltransferase (EC 2.3.1.57)] [GN:speG] [OR:*Escherichia coli*]

-continued

[SR:*Escherichia coli* (strain:K12) DNA, clone_lib:Kohara lambda minise]
[DB:genpept-bct1] [DE:*E. coli* genomic DNA, Kohara clone #310(35.7–36.0
min).] [NT:ORF_ID:o309#16; similar to [SwissProt Accession] [LE:<814]
[RE:1371] [DI:direct]

| ORF Name | NT ID | AA ID | NT LN | AA LN | Score | P-Value |
|---|---|---|---|---|---|---|
| AI7503000980_581260_f3_137 | 197 | 3969 | 183 | 60 | | |

Description
NO-HIT

| ORF Name | NT ID | AA ID | NT LN | AA LN | Score | P-Value |
|---|---|---|---|---|---|---|
| AI7503000980_6015842_c3_249 | 198 | 3970 | 900 | 299 | 750 | 2.5e-74 |

Description
sp:[LN:YABH_BACSU] [AC:P37550] [GN:YABH] [OR:*BACILLUS SUBTILIS*]
[DE:HYPOTHETICAL 31.7 KD PROTEIN IN SSPF-PURR INTERGENIC REGION (ORF1)]
[SP:P37550] [DB:swissprot] >pir:[LN:S66075] [AC:S66075:A69739]
[PN:conserved hypothetical protein yabH] [GN:yabH] [OR:*Bacillus subtilis*]
[DB:pir2] >gp:[GI:d1005823:g467435] [LN:BAC180K] [AC:D26185] [PN:unknown]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:117116] [RE:117985] [DI:direct]
>gp:[GI:e1181979:g2632313] [LN:BSUB0001] [AC:Z99104:AL009126] [GN:yabH]
[FN:unknown] [OR:*Bacillus subtilis*] [DB:genpept-bct1] [DE:*Bacillus subtilis*
complete genome (section 1 of 21): from 1 to 213080.] [NT:similar to
hypothetical proteins] [SP:P37550] [LE:53514] [RE:54383] [DI:direct]

| ORF Name | NT ID | AA ID | NT LN | AA LN | Score | P-Value |
|---|---|---|---|---|---|---|
| AI7503000980_6136562_c2_223 | 199 | 3971 | 402 | 133 | 361 | 4.1e-33 |

Description
sp:[LN:YABJ_BACSU] [AC:P37552] [GN:YABJ] [OR:*BACILLUS SUBTILIS*]
[DE:HYPOTHETICAL 13.7 KD PROTEIN IN PURR-SPOVG INTERGENIC REGION (ORF2)]
[SP:P37552] [DB:swissprot] >pir:[LN:S66077] [AC:S66077:B69739]
[PN:conserved hypothetical protein yabJ] [GN:yabJ] [CL:hypothetical protein
HI0719] [OR:*Bacillus subtilis*] [DB:pir2] >gp:[GI:d1005825:g467437]
[LN:BAC180K] [AC:D26185] [PN:unknown] [OR:*Bacillus subtilis*] [SR:*Bacillus
subtilis* (sub_species:Marburg, strain:168) DNA] [DB:genpept-bct1] [DE:*B.
subtilis* DNA, 180 kilobase region of replication origin.] [LE:118895]
[RE:119272] [DI:direct] >gp:[GI:e1181981:g2632315] [LN:BSUB0001]
[AC:Z99104:AL009126] [GN:yabJ] [FN:unknown] [OR:*Bacillus subtilis*]
[DB:genpept-bct1] [DE:*Bacillus subtilis* complete genome (section 1 of 21):
from 1 to 213080.] [NT:similar to hypothetical proteins] [SP:P37552]
[LE:55293] [RE:55670] [DI:direct]

| ORF Name | NT ID | AA ID | NT LN | AA LN | Score | P-Value |
|---|---|---|---|---|---|---|
| AI7503000980_6742943_c2_217 | 200 | 3972 | 1983 | 660 | 2292 | 9.8e-238 |

Description
sp:[LN:SYM_BACSU] [AC:P37465] [GN:METS] [OR:*BACILLUS SUBTILIS*] [EC:6.1.1.10]
[DE:[METRS]] [SP:P37465] [DB:swissprot] >pir:[LN:S66067] [AC:S66067:E69657]
[PN:methionine- -tRNA ligase, metS:methionyl-tRNA synthetase mets] [GN:metS]
[CL:methionine- -tRNA ligase] [OR:*Bacillus subtilis*] [EC:6.1.1.10] [DB:pir2]
>gp:[GI:d1005815:g467427] [LN:BAC180K] [AC:D26185] [PN:methionyl-tRNA
synthetase] [GN:metS] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:109233] [RE:111227]
[DI:direct] >gp:[GI:e1181971:g2632305] [LN:BSUB0001] [AC:Z99104:AL009126]
[PN:methionyl-tRNA synthetase] [GN:metS] [OR:*Bacillus subtilis*]
[DB:genpept-bct1] [EC:6.1.1.10] [DE:*Bacillus subtilis* complete genome
(section 1 of 21): from 1 to 213080.] [SP:P37465] [LE:45631] [RE:47625]
[DI:direct]

| ORF Name | NT ID | AA ID | NT LN | AA LN | Score | P-Value |
|---|---|---|---|---|---|---|
| AI7503000980_6834427_c2_227 | 201 | 3973 | 150 | 49 | 93 | 0.00010 |

Description
sp:[LN:YABO_BACSU] [AC:P37557] [GN:YABO] [OR:*BACILLUS SUBTILIS*]
[DE:HYPOTHETICAL 9.7 KD PROTEIN IN MFD-DIVIC INTERGENIC REGION] [SP:P37557]
[DB:swissprot] >pir:[LN:S66089] [AC:S66089:F69739] [PN:conserved
hypothetical protein yabO] [GN:yabO] [OR:*Bacillus subtilis*] [DB:pir2]
>gp:[GI:d1005836:g467448] [LN:BAC180K] [AC:D26185] [PN:unknown] [OR:*Bacillus
subtilis*] [SR:*Bacillus subtilis* (sub_species:Marburg, strain:168) DNA]

-continued

[DB:genpept-bct1] [DE:*B. subtilis* DNA, 180 kilobase region of replication origin.] [LE:131477] [RE:131737] [DI:direct] >gp:[GI:e1181992:g2632326] [LN:BSUB0001] [AC:Z99104:AL009126] [GN:yabO] [FN:unknown] [OR:*Bacillus subtilis*] [DB:genpept-bct1] [DE:*Bacillus subtilis* complete genome (section 1 of 21): from 1 to 213080.] [NT:similar to hypothetical proteins] [SP:P37557] [LE:67875] [RE:68135] [DI:direct]

| ORF Name | NT ID | AA ID | NT LN | AA LN | Score | P-Value |
|---|---|---|---|---|---|---|
| AI7503000980_7036526_c1_212 | 202 | 3974 | 159 | 52 | 86 | 0.00057 |

Description
pir:[LN:C64571] [AC:C64571] [PN:hypothetical protein HP0411] [OR:*Helicobacter pylori*] [DB:pir2] >gp:[GI:g2313526] [LN:AE000557] [AC:AE000557:AE000511] [PN:*H. pylori* predicted coding region HP0411] [GN:HP0411] [OR:*Helicobacter pylori* 26695] [DB:genpept-bct2] [DE:*Helicobacter pylori* 26695 section 35 of 134 of the complete genome.] [NT:hypothetical protein; identified by GeneMark;] [LE:3068] [RE:3385] [DI direct]

| ORF Name | NT ID | AA ID | NT LN | AA LN | Score | P-Value |
|---|---|---|---|---|---|---|
| AI7503000980_761_c1_187 | 203 | 3975 | 750 | 249 | 919 | 3.1e-92 |

Description
gp:[GI:e1386911:g44554321] [LN:SAU132803] [AC:AJ132803] [PN:hypothetical protein] [OR:*Staphylococcus aureus*] [DB:genpept-bct1] [DE *Staphylococcus aureus* ORF1 and ORF2 (partial).] [NT:ORF1] [LE:434] [RE:1159] [DI:direct]

| ORF Name | NT ID | AA ID | NT LN | AA LN | Score | P-Value |
|---|---|---|---|---|---|---|
| AI7503000980_829800_c1_201 | 204 | 3976 | 1575 | 524 | 700 | 4.9e-69 |

Description
gp:[GI:g4090864] [LN:AF023181] [AC:AF023181] [PN:low temperature requirement B protein] [GN:ltrB] [OR:*Listeria monocytogenes*] [DB:genpept-bct2] [DE:*Listeria monocytogenes* transcription-repair coupling factor (mfdL), low temperature requirement B protein (ltrB), and DivIC homolog(divL) genes, complete cds.] [LE:3972] [RE:5546] [DI:direct]

| ORF Name | NT ID | AA ID | NT LN | AA LN | Score | P-Value |
|---|---|---|---|---|---|---|
| AI7503000980_976638_c1_183 | 205 | 3977 | 1371 | 456 | 556 | 9.0e-54 |

Description
sp:[LN:YAAO_BACSU] [AC:P37536] [GN:YAAO] [OR:*BACILLUS SUBTILIS*] [DE:HYPOTHETICAL 53.2 KD PROTEIN IN XPAC-ABRB INTERGENIC REGION] [SP:P375363] [DB:swissprot] >pir:[LN:S66057] [AC:S66057:F69737] [PN:lysine decarboxylase homolog yaaO] [GN:yaaO] [OR:*Bacillus subtilis*] [DB:pir2] >gp:[GI:d1005805:g467417] [LN:BAC180K] [AC:D26185] [PN:similar to lysine decarboxylase] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:101320] [RE:102762] [DI:direct] >gp:[GI:e1181960:g2632294] [LN:BSUB0001] [AC:Z99104:AL009126] [GN:yaaO] [FN:unknown] [OR:*Bacillus subtilis*] [DB:genpept-bct1] [DE:*Bacillus subtilis* complete genome (section 1 of 21): from 1 to 213080.] [NT:similar to lysine decarboxylase] [SP:P37536] [LE:37718] [RE:39160] [DI:direct]

| ORF Name | NT ID | AA ID | NT LN | AA LN | Score | P-Value |
|---|---|---|---|---|---|---|
| AI7503000980_9876005_f3_159 | 206 | 3978 | 126 | 41 | | |

Description
NO-HIT

| ORF Name | NT ID | AA ID | NT LN | AA LN | Score | P-Value |
|---|---|---|---|---|---|---|
| AI7503000981_10392555_f3_17 | 207 | 3979 | 180 | 59 | | |

Description
NO-HIT

| ORF Name | NT ID | AA ID | NT LN | AA LN | Score | P-Value |
|---|---|---|---|---|---|---|
| AI7503000981_134392_f3_23 | 208 | 3980 | 153 | 50 | | |

Description
NO-HIT

-continued

| ORF Name | NT ID | AA ID | NT LN | AA LN | Score | P-Value |
|---|---|---|---|---|---|---|
| AI7503000981__1385927__f3__22 | 209 | 3981 | 369 | 122 | 85 | 0.039 |

Description
gp:[GI:e1332543:g3763999] [LN:PFMAL3P4] [AC:AL008970] [GN:MAL3P4.1]
[OR:*Plasmodium falciparum*] [SR:malaria parasite *P. falciparum*]
[DB:genpept-inv1] [DE:*Plasmodium falciparum* MAL3P4, complete sequence.]
[NT:predicted using hexExon; MAL3P4.1 (PFC0570c),] [LE:106887:107747]
[RE:107641:108206] [DI:complementJoin]

| ORF Name | NT ID | AA ID | NT LN | AA LN | Score | P-Value |
|---|---|---|---|---|---|---|
| AI7503000981__14882135__f2__11 | 210 | 3982 | 2112 | 703 | 167 | 1.6e-09 |

Description
sp:[LN:MELR__ECOLI] [AC:P10411] [GN:MELR] [OR:*ESCHERICHIA COLI*] [DE:MELIBIOSE
OPERON REGULATORY PROTEIN] [SP:P10411] [DB:swissprot] >pir:[LN:RGECMB]
[AC:A29625:S56347:E6522] [PN:melibiose operon regulatory protein] [GN:melR]
[CL:arabinose operon regulatory protein] [OR:*Escherichia coli*] [DB:pir1]
[MP:93 mm ] >gp:[GI:g536963] [LN:ECOUW93] [AC:U14003] [GN:melR]
[FN:regulatory gene] [OR:*Escherichia coli*] [DB:genpept-bct1] [DE:*Escherichia coli* K-12 chromosomal region from 92.8 to 00.1 minutes.] [NT:CG Site No.
18166] [LE:31548] [RE:32456] [DI:complement] >gp:[GI:g1790559] [LN:AE000484]
[AC:AE000484:U00096] [PN:regulator of melibiose operon] [GN:melR]
[FN:regulator; Degradation of small molecules:] [OR:*Escherichia coli*]
[DB:genpept-bct2] [DE:*Escherichia coli* K-12 MG1655 section 374 of 400 of the
complete genome.] [NT:f302; CG Site No. 18166] [LE:5093] [RE:6001]
[DI:complement]

| ORF Name | NT ID | AA ID | NT LN | AA LN | Score | P-Value |
|---|---|---|---|---|---|---|
| AI7503000981__23634578__f3__18 | 211 | 3983 | 150 | 49 | | |

Description
NO-HIT

| ORF Name | NT ID | AA ID | NT LN | AA LN | Score | P-Value |
|---|---|---|---|---|---|---|
| AI7503000981__23860887__f2__13 | 212 | 3984 | 141 | 46 | | |

Description
NO-HIT

| ORF Name | NT ID | AA ID | NT LN | AA LN | Score | P-Value |
|---|---|---|---|---|---|---|
| AI7503000981__25634627__f2__12 | 213 | 3985 | 468 | 155 | 290 | 1.4e-25 |

Description
sp:[LN:GS26__BACSU] [AC:P80238:P96580] [GN:YDAG] [OR:*BACILLUS SUBTILIS*]
[DE:GENERAL STRESS PROTEIN 26 (GSP26)] [SP:P80238:P96580] [DB:swissprot]
>pir:[LN:G69768] [AC:G69768] [PN:general stress protein homolog ydaG]
[GN:ydaG] [OR:*Bacillus subtilis*] [DB:pir2] >gp:[GI:d1020013:g1881233]
[LN:AB001488] [AC:AB001488] [GN:ydaG] [OR:*Bacillus subtilis*] [SR:*Bacillus subtilis* (strain:168) DNA] [DB:genpept-bct1] [DE:*Bacillus subtilis* genome
sequence, 148 kb sequence of the region between 35 and 47 degree.]
[NT:FUNCTION UNKNOWN.] [LE:6862] [RE:7284] [DI:direct]
>gp:[GI:e1182388:g2632722] [LN:BSUB0003] [AC:Z99106:AL00912G] [GN:ydaG]
[FN:unknown] [OR:*Bacillus subtilis*] [DB:genpept-bct1] [DE:*Bacillus subtilis*
complete genome (section 3 of 21): from 402751 to 611850.] [NT:alternate gene
name:yzzA; similar to general] [SP:P80238] [LE:70606] [RE:71028]
[DI:direct]

| ORF Name | NT ID | AA ID | NT LN | AA LN | Score | P-Value |
|---|---|---|---|---|---|---|
| AI7503000981__2584538__c1__29 | 214 | 3986 | 132 | 43 | | |

Description
NO-HIT

| ORF Name | NT ID | AA ID | NT LN | AA LN | Score | P-Value |
|---|---|---|---|---|---|---|
| AI7503000981__29352342__c2__36 | 215 | 3987 | 1296 | 431 | 1218 | 6.3e-124 |

Description
sp:[LN:GLTT__BACST] [AC:P24943] [GN:GLTT] [OR:*BACILLUS STEAROTHERMOPHILUS*]
[DE:PROTEIN)] [SP:P24943] [DB:swissprot) >pir:[LN:S26247] [AC:S26247]
[PN:glutamate/aspartate transport protein:sodium/proton-glutamate symport
protein] [GN:gltP] [OR:*Bacillus stearothermophilus*] [DB:pir2]

-continued

>gp:[GI:g143000] [LN:BACGLTPA] [AC:M86508] [PN:proton glutamate symport
protein] [GN:gltP] [OR:*Bacillus stearothermophilus*] [SR:*Bacillus
stearothermophilus* (library:ATCC 7954) DNA] [DB:genpept-bct1] [DE:*Bacillus
stearothermophilus* proton glutamate symport protein (gltP)gene, complete
cds.] [LE:110] [RE:1375] [DI:direct]

| ORF Name | NT ID | AA ID | NT LN | AA LN | Score | P-Value |
|---|---|---|---|---|---|---|
| AI7503000981__30081465__c2__37 | 216 | 3988 | 147 | 48 | | |

Description
NO-HIT

| ORF Name | NT ID | AA ID | NT LN | AA LN | Score | P-Value |
|---|---|---|---|---|---|---|
| AI7503000981__32242200__f1__2 | 217 | 3989 | 378 | 125 | | |

Description
NO-HIT

| ORF Name | NT ID | AA ID | NT LN | AA LN | Score | P-Value |
|---|---|---|---|---|---|---|
| AI7503000981__3396042__c1__34 | 218 | 3990 | 315 | 104 | | |

Description
NO-HIT

| ORF Name | NT ID | AA ID | NT LN | AA LN | Score | P-Value |
|---|---|---|---|---|---|---|
| AI7503000981__34179828__c2__35 | 219 | 3991 | 129 | 42 | | |

Description
NO-HIT

| ORF Name | NT ID | AA ID | NT LN | AA LN | Score | P-Value |
|---|---|---|---|---|---|---|
| AI7503000981__4100336__f2__10 | 220 | 3992 | 153 | 50 | | |

Description
NO-HIT

| ORF Name | NT ID | AA ID | NT LN | AA LN | Score | P-Value |
|---|---|---|---|---|---|---|
| AI7503000981__6511652__c3__51 | 221 | 3993 | 138 | 45 | | |

Description
NO-HIT

| ORF Name | NT ID | AA ID | NT LN | AA LN | Score | P-Value |
|---|---|---|---|---|---|---|
| AI7503000981__822786__c1__33 | 222 | 3994 | 132 | 43 | | |

Description
NO-HIT

| ORF Name | NT ID | AA ID | NT LN | AA LN | Score | P-Value |
|---|---|---|---|---|---|---|
| AI7503000982__10031712__c1__1057 | 223 | 3995 | 990 | 329 | 597 | 4.1e-58 |

Description
sp:[LN:YQJA__BACSU] [AC:P54538] [GN:YQJA] [OR:*BACILLUS SUBTILIS*]
[DE:HYPOTHETICAL 37.1 KD PROTEIN IN BMRU-ANSR INTERGENIC REGION] [SP:P54538]
[DB:swissprot] >pir:[LN:A69963] [AC:A69963] [PN:hypothetical protein yqjA]
[GN:yqjA] [OR:*Bacillus subtilis*] [DB:pir2] >gp:[GI:d1013287:g1303952]
[LN:BACJH642] [AC:D84432:D82370] [PN:YqjA] [OR:*Bacillus subtilis*]
[SR:*Bacillus subtilis* (strain:JH642(trpC2 PheA1)) DNA] [DB:genpept-bct1]
[DE:*Bacillus subtilis* DNA, 283 Kb region containing skin element.]
[LE:229147] [RE:230115] [DI:direct] >gp:[GI:e1185663:g2634829] [LN:BSUB0013]
[AC:Z99116:AL009126] [GN:yqjA] [FN:unknown] [OR:*Bacillus subtilis*]
[DB:genpept-bct1] [DE:*Bacillus subtilis* complete genome (section 13 of 21):
from 2395261 to 2613730.] [SP:P54538] [LE:93504] [RE:94472] [DI:complement]

| ORF Name | NT ID | AA ID | NT LN | AA LN | Score | P-Value |
|---|---|---|---|---|---|---|
| AI7503000982__10312561__c3__1455 | 224 | 3996 | 1236 | 411 | 996 | 2.1e-100 |

Description
sp:[LN:RS1H__BACSU] [AC:P38494] [GN:YPFD:JOFD] [OR:*BACILLUS SUBTILIS*] [DE:30S
RIBOSOMAL PROTEIN S1 HOMOLOG] [SP:P38494] [DB:swissprot] >pir:[LN:B69935]

-continued

[AC:B69935] [PN:ribosomal protein S1 homolog homolog ypfD] [GN:ypfD]
[CL:Synechocystis ribosomal protein S1] [OR:*Bacillus subtilis*] [DB:pir2]
>gp:[GI:g533106] [LN:BSU11687] [AC:U11687] [PN:unknown] [GN:jofD]
[OR:*Bacillus subtilis*] [DB:genpept-bct1] [DE:*Bacillus subtilis* 168 jofA,
jofB, MssA homolog (jofC) and ribosomal protein S1 homolog (jofD) genes,
complete cds, and joeB gene, partial cds.] [NT:similar to the *Escherichia
coli* S1 ribosomal] [LE:2651] [RE:3799] [DI:direct]
>gp:[GI:e1183733:g2634706] [LN:BSUB0012] [AC:Z99115:AL009126] [GN:ypfD]
[FN:unknown] [OR:*Bacillus subtilis*] [DB:genpept-bct1] [DE:*Bacillus subtilis*
complete genome (section 12 of 21): from 2195541 to 2409220.] [NT:alternate
gene name:jofD; similar to ribosomal] [SP:P38494] [LE:198361] [RE:199509]
[DI:complement] >gp:[GI:g1146215] [LN:BACSERA] [AC:L47648] [GN:ypfD]
[OR:*Bacillus subtilis*] [DB:genpept-bct2] [DE:*Bacillus subtilis*
phosphoglycerate dehydrogenase (serA), ypaA, ferredoxin (fer), ypbB, recS,
ypbD, ypbE, ypbF, ypbG, ypbH, glutamate dehydrogenase (ypcA), ypdA, ypdB,
ypdC, spore cortexlytic enzyme (sleB), ypeB, ypfA, ypfB, cytidine
monophosphatekinase (cmk), ypfD, ypgA, yphA, yphB, yphC, NAD+
dependentglycerol-3-phosphate dehydrogenase (glyc), yphE and yphF
genes, complete cds.] [NT:similar to *Escherichia coli* Si ribosomal protein;]
[LE:16888] [RE:18036] [DI:direct]

| ORF Name | NT ID | AA ID | NT LN | AA LN | Score | P-Value |
|---|---|---|---|---|---|---|
| AI7503000982__10334752__f1__178 | 225 | 3997 | 192 | 63 | | |

Description
NO-HIT

| ORF Name | NT ID | AA ID | NT LN | AA LN | Score | P-Value |
|---|---|---|---|---|---|---|
| AI7503000982__10588877__f3__947 | 226 | 3998 | 162 | 53 | | |

Description
NO-HIT

| ORF Name | NT ID | AA ID | NT LN | AA LN | Score | P-Value |
|---|---|---|---|---|---|---|
| AI7503000982__10635918__c2__1290 | 227 | 3999 | 123 | 40 | | |

Description
NO-HIT

| ORF Name | NT ID | AA ID | NT LN | AA LN | Score | P-Value |
|---|---|---|---|---|---|---|
| AI7503000982__10642180__c3__1513 | 228 | 4000 | 186 | 61 | | |

Description
NO-HIT

| ORF Name | NT ID | AA ID | NT LN | AA LN | Score | P-Value |
|---|---|---|---|---|---|---|
| AI7503000982__10666068__c2__1228 | 229 | 4001 | 330 | 109 | 196 | 1.3e-15 |

Description
sp:[LN:CMG3_BACSU] [AC:P25955] [GN:COMGC:COMG3] [OR:*BACILLUS SUBTILIS*]
[DE:COMG OPERON PROTEIN 3 PRECURSOR] [SP:P25955] [DB:swissprot]
>pir:[LN:D30338] [AC:D30338:A35133:D69603] [PN:exogenous DNA-binding
protein comGC:comG operon protein 3] [GN:comGC] [OR:*Bacillus subtilis*]
[DB:pir2] >gp:[GI:g142708] [LN:BACCOMGA] [AC:M29691:M22854] [GN:comG3]
[OR:*Bacillus subtilis*] [SR:*Bacillus subtilis* (strain 168) (clone:pED4) DNA]
[DB:genpept-bct1] [DE:*Bacillus subtilis* (clone pED4) comG- (1, 2, 3, 4, 5, 6, and
7) proteins incomG operon, complete cds.] [LE:3405] [RE:3701] [DI:direct]
>gp:[GI:d1013214:g1303879] [LN:BACJHG42] [AC:D84432:D82370] [PN:ComGC]
[OR:*Bacillus subtilis*] [SR:*Bacillus subtilis* (strain:JH642(trpC2 PheA1)]
DNA] [DB:genpept-bct1] [DE:*Bacillus subtilis* DNA, 283 Kb region containing
skin element.] [LE:161635] [RE:161931] [DI:direct]
>gp:[GI:e1185739:g2634905] [LN:BSUB0013] [AC:Z99116:AL009126] [GN:comGC]
[FN:exogenous DNA-binding (competence)] [OR:*Bacillus subtilis*]
[DB:genpept-bct1] [DE:*Bacillus subtilis* complete genome (section 13 of 21):
from 2395261 to 2613730.] [SP:P25955] [LE:161690] [RE:161986] [DI:complement]

| ORF Name | NT ID | AA ID | NT LN | AA LN | Score | P-Value |
|---|---|---|---|---|---|---|
| AI7503000982__1070437__c3__1482 | 230 | 4002 | 894 | 297 | 727 | 6.8e-72 |

Description
sp:[LN:YPCP_BACSU] [AC:P54161] [GN:YPCP] [OR:*BACILLUS SUBTILIS*]
[EC:3.1.11.-] [DE:POTENTIAL 5'-3' EXONUCLEASE,] [SP:P54161] [DB:swissprot]
>pir:[LN:H69933] [AC:H69933] [PN:5'-3' exonuclease homolog ypcP] [GN:ypcP]

-continued

[OR:*Bacillus subtilis*] [DB:pir2] >gp:[GI:g1256623] [LN:BACYACA] [AC:L77246] [PN:exodeoxyribonuclease] [GN:ypcP] [OR:*Bacillus subtilis*] [DB:genpept-bct1] [DE:*Bacillus subtilis* (YAC10-9 clone) DNA region between the serA and kdg loci.] [NT:36.1% identity with 219 aa at the 5' end of the] [LE:9565] [RE:10455] [DI:direct] >gp:[GI:e1183647:g2634620] [LN:BSUB0012] [AC:Z99115:AL009126] [GN:ypcP] [FN:unknown] [OR:*Bacillus subtilis*] [DB:genpept-bct1] [DE:*Bacillus subtilis* complete genome (section 12 of 21): from 2195541 to 2409220.] [NT:similar to 5'-3' exonuclease] [SP:P54161] [LE:114697] [RE:115587] [DI:complement]

| ORF Name | NT ID | AA ID | NT LN | AA LN | Score | P-Value |
|---|---|---|---|---|---|---|
| AI7503000982__10938927__f2__492 | 231 | 4003 | 132 | 43 | | |

Description
NO-HIT

| ORF Name | NT ID | AA ID | NT LN | AA LN | Score | P-Value |
|---|---|---|---|---|---|---|
| AI7503000982__10969050__c2__1193 | 232 | 4004 | 1596 | 531 | 1815 | 3.5e-187 |

Description
sp:[LN:LEPA_BACSU] [AC:P37949] [GN:LEPA] [OR:*BACILLUS SUBTILIS*] [DE:GTP-BINDING PROTEIN LEPA] [SP:P37949] [DB:swissprot] >pir:[LN:G69649] [AC:G69649] [PN:GTP-binding protein lepA] [GN:lepA] [CL:GTP-binding membrane protein lepA:translation elongation factor Tu homology] [OR:*Bacillus subtilis*] [DB:pir2] >gp:[GI:d1013139:g1303804] [LN:BACJHG42] [AC:D84432:D82370] [PN:YqeQ] [OR:*Bacillus subtilis*] [SR:Bacillus subtilis (strain:JH642(trpC2 PheA1)) DNA] [DB:genpept-bct1] [DE:*Bacillus subtilis* DNA, 283 Kb region containing skin element.] [LE:86866] [RE:88704] [DI:direct] >gp:[GI:e200671:g1122398] [LN:BSLEPORF] [AC:X91655] [GN:lepA] [OR:*Bacillus subtilis*] [DB:genpept-bct1] [DE:*B. subtilis* lepA and hemN genes.] [SP:P37949] [LE:128] [RE:1966] [DI:direct] >gp:[GI:e1183781:g2634997] [LN:BSUB0014] [AC:Z99117:AL009126] [PN:GTP-binding protein] [GN:lepA] [OR:*Bacillus subtilis*] [DB:genpept-bct1] [DE:*Bacillus subtilis* complete genome (section 14 of 21): from 2599451 to 2812870.] [NT:alternate gene name:yqxB, yqeQ] [SP:P37949] [LE:30726] [RE:32564] [DI:complement]

| ORF Name | NT ID | AA ID | NT LN | AA LN | Score | P-Value |
|---|---|---|---|---|---|---|
| AI7503000982__11194067__c3__1378 | 233 | 4005 | 747 | 248 | 431 | 1.6e-40 |

Description
sp:[LN:YQEM_BACSU] [AC:P54458] [GN:YQEM] [OR:*BACILLUS SUBTILIS*] [DE:HYPOTHETICAL 28.3 KD PROTEIN IN AROD-COMER INTERGENIC REGION] [SP:P54458] [DB:swissprot] >pir:[LN:A69952] [AC:A69952] [PN:conserved hypothetical protein yqeM] [GN:yqeM] [CL:bioC homology] [OR:*Bacillus subtilis*] [DB:pir2] >gp:[GI:d1013129:g1303794] [LN:BACJH642] [AC:D84432:D82370] [PN:YqeM] [OR:*Bacillus subtilis*] [SR:Bacillus subtilis (strain:JH642(trpC2 PheAl)) DNA] [DB:genpept-bct1] [DE:*Bacillus subtilis* DNA, 283 Kb region containing skin element.] [LE:76770] [RE:77513] [DI:direct] >gp:[GI:e1183791:g2635007] [LN:BSUB0014] [AC:Z99117:AL009126] [GN:yqeM] [FN:unknown] [OR:*Bacillus subtilis*] [DB:genpept-bct1] [DE:*Bacillus subtilis* complete genome (section 14 of 21): from 2599451 to 2812870.] [NT:similar to hypothetical proteins] [LE:41917] [RE:42660] [DI:complement]

| ORF Name | NT ID | AA ID | NT LN | AA LN | Score | P-Value |
|---|---|---|---|---|---|---|
| AI7503000982__11203763__c1__985 | 234 | 4006 | 132 | 43 | | |

Description
NO-HIT

| ORF Name | NT ID | AA ID | NT LN | AA LN | Score | P-Value |
|---|---|---|---|---|---|---|
| AI7503000982__11881313__f1__285 | 235 | 4007 | 174 | 57 | | |

Description
NO-HIT

| ORF Name | NT ID | AA ID | NT LN | AA LN | Score | P-Value |
|---|---|---|---|---|---|---|
| AI7503000982__12116562__f2__354 | 236 | 4008 | 123 | 40 | | |

Description
NO-HIT

| ORF Name | NT ID | AA ID | NT LN | AA LN | Score | P-Value |
|---|---|---|---|---|---|---|
| AI7503000982__1218750__c1__996 | 237 | 4009 | 681 | 226 | 336 | 1.8e-30 |

Description
gp:[GI:g3211753] [LN:AF052208] [AC:AF052208] [PN:competence protein]
[GN:celA] [OR:Streptococcus pneumoniae] DB:genpept-bct2] [DE:Streptococcus
pneumoniae competence protein (celA) and competence protein (celB) genes,
complete cds; and unknown gene.] [LE:266] [RE:916] [DI:direct

| ORF Name | NT ID | AA ID | NT LN | AA LN | Score | P-Value |
|---|---|---|---|---|---|---|
| AI7503000982__1226553__c2__1270 | 238 | 4010 | 141 | 46 | | |

Description
NO-HIT

| ORF Name | NT ID | AA ID | NT LN | AA LN | Score | P-Value |
|---|---|---|---|---|---|---|
| AI7503000982__1229750__c3__1419 | 239 | 4011 | 468 | 155 | 505 | 2.3e-48 |

Description
gp:[GI:e1363305:g4127534] [LN:BSAJ10954] [AC:AJ010954] [PN:arginine
repressor] [GN:argR] [FN:ADN binding protein] [OR:*Bacillus
stearothermophilus*] *[DB:genpept-bct1]* *[DE:Bacillus stearothermophilus* argR
gene and partial recN gene.] [LE:196] [RE:645] [DI:direct]

| ORF Name | NT ID | AA ID | NT LN | AA LN | Score | P-Value |
|---|---|---|---|---|---|---|
| AI7503000982__1345752__f3__780 | 240 | 4012 | 945 | 314 | 720 | 3.8e-71 |

Description
sp:[LN:YQKF__BACSU] [AC:P54569] [GN:YQKF] [OR:*BACILLUS SUBTILIS*]
[DE:HYPOTHETICAL OXIDOREDUCTASE IN ANSR-BMRU INTERGENIC REGION] [SP:P54569]
[DB:swissprot] >pir:[LN:H69966] [AC:H69966] [PN:conserved hypothetical
protein yqkF] [GN:yqkF] [OR:*Bacillus subtilis*] [DB:pir2]
>gp:[GI:d1013318:g1303983] [LN:BACJHG42] [AC:D84432:D82370] [PN:YqkF]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:259404] [RE:260324] [DI:complement]
>gp:[GI:e1185631:g2634797] [LN:BSUB0013] [AC:Z99116:AL009126] [GN:yqkF]
[FN:unknown] [OR:*Bacillus subtilis*] [DB:genpept-bct1] [DE:*Bacillus subtilis*
complete genome (section 13 of 21): from 2395261 to 2613730.] [NT:similar to
hypothetical proteins] [SP:P54569] [LE:63295] [RE:64215] [DI:direct]

| ORF Name | NT ID | AA ID | NT LN | AA LN | Score | P-Value |
|---|---|---|---|---|---|---|
| AI7503000982__1359450__f2__544 | 241 | 4013 | 144 | 47 | | |

Description
NO-HIT

| ORF Name | NT ID | AA ID | NT LN | AA LN | Score | P-Value |
|---|---|---|---|---|---|---|
| AI7503000982__136068__f1__227 | 242 | 4014 | 1404 | 467 | 1201 | 4.0e-122 |

Description
pir:[LN:D70585] [AC:D70585] [PN:probable glyS protein] [GN:glyS]
[CL:Mycoplasma genitalium glycine- -tRNA ligase] [OR:Mycobacterium
tuberculosis] [DB:pir2] >gp:[GI:e315164:g20780432 [LN:MTCY27]
[AC:Z95208:AL123456] [PN:glyS] [GN:glyS] [OR:Mycobacterium tuberculosis]
[DB:genpept-bct1] [DE:Mycobacterium tuberculosis H37Rv complete genome;
segment 104/162.] [NT:Rv2357c, (MTCY27.23-MTCY98.26), len:463 aa. glyS,]
[LE:19] [RE:1410] [DI:complement]

| ORF Name | NT ID | AA ID | NT LN | AA LN | Score | P-Value |
|---|---|---|---|---|---|---|
| AI7503000982__13674130__f3__703 | 243 | 4015 | 129 | 42 | | |

Description
NO-HIT

| ORF Name | NT ID | AA ID | NT LN | AA LN | Score | P-Value |
|---|---|---|---|---|---|---|
| AI7503000982__13853500__f2__374 | 244 | 4016 | 246 | 81 | | |

Description
NO-HIT

-continued

| ORF Name | NT ID | AA ID | NT LN | AA LN | Score | P-Value |
|---|---|---|---|---|---|---|
| AI7503000982_13876943_c1_1122 | 245 | 4017 | 1488 | 495 | 882 | 2.6e-88 |

Description
pir:[LN:B69610] [AC:B69610:JC5744] [PN:carboxy-terminal processing proteinase ctpA,:tail-specific endopeptidase Prc] [GN:ctpA] [CL:carboxyl-terminal processing proteinase] [OR:*Bacillus subtilis*] [EC:3.4.99.-] [DB:pir2] >gp:[GI:g2529476] [LN:AF006665] [AC:AF006665] [PN:OrfRM1] [GN:orfRM1] [FN:unknown] [OR:*Bacillus subtilis*] [DB:genpept-bct1] [DE:*Bacillus subtilis* 168 region at 182 min containing the cge genecluster.] [NT:similar to the *E. coli* Prc and carboxyl-terminal] [LE:22886] [RE:24286] [DI:direct] >gp:[GI:g2415395] [LN:AF015775] [AC:AF015775] [PN:proteinase] [GN:ctpA] [OR:*Bacillus subtilis*] [DB:genpept-bct1] [DE:*Bacillus subtilis* YodA (yodA), YodB (yodB), YodC (yodC), YodD(yodD), ABC-transporter (yodE), permease (yodF), proteinase (ctpA), YodH (yodH), YodI (yodI), carboxypeptidase (yodJ), purinenucleoside phosphorylase (deoD), YodL (yodL), YodN (yodM), YodN(yodN), YodO CyodO), YodP (yodP), acetylornitine deacetylase (argE), butirate-acetoacetate CoA transferase (yodR) , butyrateace toacetate-CoA transferase (yodS), YodT (yodT), CgeE (cgeE), CgeD(cgeD), CgeC (cgeC), CgeA (cgeA), CgeB (cgeB), YzxA (yzxA), UDP-glucose epimerase (yodU), YodV CyodV), and YodW (yodW) genes, complete cds; and YodZ (yodZ) gene, partial cds.] [NT:similar to Synechocystis sp. PCC6803] [LE:5846] [RE:7246] [DI:complement] >gp:[GI:e1185430:g2634351] [LN:BSUB0011] [AC:Z99114:AL009126] [PN:carboxy-terminal processing protease] [GN:ctpA] [OR:*Bacillus subtilis*] [DB:genpept-bct1] [DE:*Bacillus subtilis* complete genome (section 11 of 21): from 2000171 to 2207900.] [NT:alternate gene name:yzbD] [LE:130976] [RE:132376] [DI:complement]

| ORF Name | NT ID | AA ID | NT LN | AA LN | Score | P-Value |
|---|---|---|---|---|---|---|
| AI7503000982_14097011_c3_1411 | 246 | 4018 | 612 | 203 | 522 | 3.6e-50 |

Description
sp:[LN:ARGJ_BACST] [AC:Q07908] [GN:ARGJ] [OR:*BACILLUS STEAROTHERMOPHILUS*] [EC:2.3.1.35:2.3.1.1] [DE:ACETYLTRANSFERASE, (N-ACETYLGLUTAMATE SYNTHASE) (AGS)] [SP:Q07908] [DB:swissprot] >pir:[LN:I39766] [AC:I39766] [PN:glutamate N-acetyltransferase,] [GN:argJ] [CL:glutamate N-acetyltransferase argJ] [OR:*Bacillus stearothermophilus*] [EC:2.3.1.35] [DB:pir2] >gp:LGI:g304135] [LN:BACACETYL] [AC:L06036] [PN:ornithine acetyltransferase] [GN:argJ] [OR:*Bacillus stearothermophilus*] [SR:*Bacillus stearothermophilus* (strain NCIB 8224) DNA] [DB:genpept-bct1] [EC:2.3.1.35] [DE:*Bacillus stearothermophilus* ornithine acetyltransferase (argJ) and acetylglutamate kinase (argB) genes, complete cds's, argC gene, 3' end, and argD gene, 5' end.] [NT:also bears acetyl-CoA:L-glutamate] [LE:902] [RE:2134] [DI:direct]

| ORF Name | NT ID | AA ID | NT LN | AA LN | Score | P-Value |
|---|---|---|---|---|---|---|
| AI7503000982_14259631_c1_967 | 247 | 4019 | 1068 | 355 | 1207 | 9.3e-123 |

Description
sp:[LN:QUEA_BACSU] [AC:O32054] [GN:QUEA] [OR:*BACILLUS SUBTILIS*] [EC:5.-.-.-] [DE:[QUEUOSINE BIOSYNTHESIS PROTEIN QUEA)] [SP:O32054] [DB:swissprot] >pir:[LN:A69688] [AC:A69688] [PN:S-adenosylmethionine:tRNA ribosyltransferase-isomerase, queuosine biosynthesis-related protein queA] [GN:queA] [CL:S-adenosylmethionine:tRNA ribosyltransferase-isomerase] [OR:*Bacillus subtilis*] [EC:5.-.-.-] [DB:pir2] >gp:[GI:e1184021:g2635237] [LN:BSUB0015] [AC:Z99118:AL009126] [PN:S-adenosylmethionine tRNA ribosyltransferase] [GN:queA] [FN:queuosine biosynthesis] [OR:*Bacillus subtilis*] [DB:genpept-bct1] [DE:*Bacillus subtilis* complete genome (section 15 of 21): from 2795131 to 3013540.] [SP:O32054] [LE:38030] [RE:39058] [DI complement]

| ORF Name | NT ID | AA ID | NT LN | AA LN | Score | P-Value |
|---|---|---|---|---|---|---|
| AI7503000982_14460932_f1_322 | 248 | 4020 | 177 | 58 | 226 | 8.4e-19 |

Description
gp:[GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000982_14507827_f1_87 | 249 | 4021 | 150 | 49 | | |

| ORF Name | NT ID | AA ID | NT LN | AA LN | Score | P-Value |
|---|---|---|---|---|---|---|
| AI7503000982__14508567__c3__1357 | 250 | 4022 | 276 | 91 | 184 | 2.4e-14 |

Description
NO-HIT

| ORF Name | NT ID | AA ID | NT LN | AA LN | Score | P-Value |
|---|---|---|---|---|---|---|
| AI7503000982__14881687__c2__1226 | 251 | 4023 | 993 | 330 | 1448 | 2.7e-148 |

Description
pir:[LN:E69972] [AC:E69972] [PN:conserved hypothetical protein yrbF]
[GN:yrbF] [CL:yajC protein] [OR:*Bacillus subtilis*] [DB:pir2]
>gp:[GI:e1184019:g2635235] [LN:BSUB0015] [AC:Z99118:AL009126] [GN:yrbF]
[FN:unknown] [OR:*Bacillus subtilis*] [DB:genpept-bct1] [DE:*Bacillus subtilis*
complete genome (section 15 of 21): from 2795131 to 3013540.] [NT:similar to
hypothetical proteins] [LE:36555] [RE:36824] [DI:complement]

| ORF Name | NT ID | AA ID | NT LN | AA LN | Score | P-Value |
|---|---|---|---|---|---|---|
| AI7503000982__15031535__f2__658 | 252 | 4024 | 156 | 51 | | |

Description
sp:[LN:GLK__STAXY] [AC:Q56198] [GN:GLKA] [OR:*STAPHYLOCOCCUS XYLOSUS*]
[EC:2.7.1.2] [DE:GLUCOKINASE, (GLUCOSE KINASE)] [SP:Q56198] [DB:swissprot]
>pir:[LN:S52352] [AC:S52352] [PN:glucose kinase] [CL:glucose kinase:glucose
kinase homology] [OR:*Staphylococcus xylosus*] [DB:pir2] >gp:[GI:g666116]
[LN:SXGKG2] [AC:X84332] [PN:glucose kinase] [GN:glkA] [OR:*Staphylococcus
xylosus*] [DB:genpept-bct1] [DE:*S. xylosus* glucose kinase gene.] [SP:Q5G198]
[LE:973] [RE:1959] [DI:direct]

| ORF Name | NT ID | AA ID | NT LN | AA LN | Score | P-Value |
|---|---|---|---|---|---|---|
| AI7503000982__15031535__f2__658 | 252 | 4024 | 156 | 51 | | |

Description
NO-HIT

| ORF Name | NT ID | AA ID | NT LN | AA LN | Score | P-Value |
|---|---|---|---|---|---|---|
| AI7503000982__15728386__c3__1356 | 253 | 4025 | 1143 | 380 | 1542 | 2.9e-158 |

Description
sp:[LN:TGT__BACSU] [AC:O32053] [GN:TGT] [OR:*BACILLUS SUBTILIS*] [EC:2.4.2.29]
[DE:TRANSGLYCOSYLASE) (GUANINE INSERTION ENZYME)] [SP:O32053] [DB:swissprot]
>pir:[LN:B69722] [AC:B69722] [PN:queuine tRNA-ribosyltransferase,] [GN:tgt]
[CL:queuine tRNA-ribosyltransferase] [OR:*Bacillus subtilis*] [EC:2.4.2.29]
[DB:pir2] >gp:[GI:e1184020:g2635236] [LN:BSUB0015] [AC:Z99118:AL009126]
[PN:tRNA-guanine transglycosylase] [GN:tgt] [FN:queuosine biosynthesis]
[OR:*Bacillus subtilis*] [DB:genpept-bct1] [EC:2.4.2.29] [DE:*Bacillus subtilis*
complete genome (section 15 of 21): from 2795131 to 3013540.] [SP:O32053]
[LE:36858] [RE:38003] [DI:complement]

| ORF Name | NT ID | AA ID | NT LN | AA LN | Score | P-Value |
|---|---|---|---|---|---|---|
| AI7503000982__16205035__c1__1036 | 254 | 4026 | 135 | 44 | | |

Description
NO-HIT

| ORF Name | NT ID | AA ID | NT LN | AA LN | Score | P-Value |
|---|---|---|---|---|---|---|
| AI7503000982__16610088__c2__1261 | 255 | 4027 | 645 | 214 | 405 | 9.0e-38 |

Description
sp:[LN:YPAA__BACSU] [AC:P50726] [GN:YPAA] [OR:*BACILLUS SUBTILIS*]
[DE:HYPOTHETICAL 20.5 KD PROTEIN IN SERA-FER INTERGENIC REGION] [SP:P50726]
[DB:swissprot] >pir:[LN:E69932] [AC:E69932] [PN:hypothetical protein ypaA]
[GN:ypaA] [OR:*Bacillus subtilis*] [DB:pir2] >gp:[GI:e1185574:g2634740]
[LN:BSUB0013] [AC:Z99116:AL009126] [GN:ypaA] [FN:unknown] [OR:*Bacillus
subtilis*] [DB:genpept-bct1] [DE:*Bacillus subtilis* complete genome (section
13 of 21): from 2395261 to 2613730.] [SP:P50726] [LE:13991] [RE:14563]
[DI:complement] >gp:[GI:g1146197] [LN:BACSERA] [AC:L47648] [GN:ypaA]
[OR:*Bacillus subtilis*] [DB:genpept-bct2] [DE:*Bacillus subtilis*
phosphoglycerate dehydrogenase (serA), ypaA, ferredoxin (fer), ypbB, recS,
ypbD, ypbE, ypbF, ypbG, ypbH, glutamate dehydrogenase (ypcA), ypdA, ypdB,
ypdC, spore cortexlytic enzyme (sleB), ypeB, ypfA, ypfB, cytidine
monophosphatekinase (cmk), ypfD, ypgA, yphA, yphB, yphC, NAD-+
dependentglycerol-3-phosphate dehydrogenase (glyc), yphE and yphF
genes complete cds.] [NT:putative] [LE:2114] [RE:2686] [DI:direct]

-continued

| ORF Name | NT ID | AA ID | NT LN | AA LN | Score | P-Value |
|---|---|---|---|---|---|---|
| AI7503000982_16828175_c3_1395 | 256 | 4028 | 606 | 201 | 1021 | 4.8e-103 |

Description
gp:[GI:g4325247] [LN:AF121672] [AC:AF121672] [PN:superoxide dismutase SodA]
[GN:sodA] [OR:*Staphylococcus aureus*] [DB:genpept-bct2] [DE:*Staphylococcus
aureus* superoxide dismutase SodA (sodA) gene, complete cds.]
[NT:manganese-dependent] [LE:246] [RE:845] [DI:direct]

| ORF Name | NT ID | AA ID | NT LN | AA LN | Score | P-Value |
|---|---|---|---|---|---|---|
| AI7503000982_16923383_c2_1252 | 257 | 4029 | 339 | 112 | 156 | 3.1e-11 |

Description
sp:[LN:YQJQ_BACSU] [AC:P54554] [GN:YQJQ] [OR:*BACILLUS SUBTILIS*] [EC:1.-.-.-]
[DE:[EC 1.-.-.-)] [SP:P54554] [DB:swissprot] >pir:[LN:A69965] [AC:A69965]
[PN:ketoacyl reductase homology qjQ] [GN:yqjQ] [CL:short-chain alcohol
dehydrogenase homology] [OR:*Bacillus subtilis*] [DB:pir2]
>gp:[GI:d1013303:g1303968] [LN:BACJH642] [AC:D84432:D82370] [PN:YqjQ]
[OR:*Bacillus subtilis*] [SR:*Bacillus subtilis* (strain:JHG42CtrpC2 PheAl))
DNA] [DB:genpept-bct1] [DE:*Bacillus subtilis* DNA, 283 Kb region containing
skin element.] [LE:247869] [RE:248648] [DI:direct]
>gp:[GI:e1185647:g2634813] [LN:BSUB0013] [AC:Z99116:AL009126] [GN:yqjQ]
[FN:unknown] [OR:*Bacillus subtilis*] [DB:genpept-bct1] [DE:*Bacillus subtilis*
complete genome (section 13 of 21): from 2395261 to 2613730.] [NT:similar to
ketoacyl reductase] [SP:P54554] [LE:74971] [RE:75750] [DI:complement]

| ORF Name | NT ID | AA ID | NT LN | AA LN | Score | P-Value |
|---|---|---|---|---|---|---|
| AI7503000982_17002217_c2_1254 | 258 | 4030 | 465 | 154 | 587 | 4.7e-57 |

Description
sp:[LN:FUR2_BACSU] [AC:P54574] [GN:YQKL] [OR:*BACILLUS SUBTILIS*] [DE:FERRIC
UPTAKE REGULATION PROTEIN HOMOLOG 2] [SP:P54574] [DB:swissprot]
>pir:[LN:E69967] [AC:E69967] [PN:transcription regulator Fur family homolog
yqkL] [GN:yqkL] [CL:ferric uptake regulator] [OR:*Bacillus subtilis*]
[DB:pir2] >gp:[GI:d1013328:g1303993] [LN:BACJH642] [AC:D84432:D82370]
[PN:YqkL] [OR:*Bacillus subtilis*] [SR:*Bacillus subtilis* (strain:JH642(trpC2
PheA1)) DNA] [DB:genpept-bct1] [DE:*Bacillus subtilis* DNA, 283 Kb region
containing skin element.] [LE:269361] [RE:269810] [DI:direct]
>gp:[GI:e1185621:g2634787] [LN:BSUB0013] [AC:Z99116:AL009126] [GN:yqkL]
[FN:unknown] [OR:*Bacillus subtilis*] [DB:genpept-bct1] [DE:*Bacillus subtilis*
complete genome (section 13 of 21): from 2395261 to 2613730.] [NT:similar to
transcriptional regulator (Fur family)] [SP:P545742 [LE:53809] [RE:54258]
[DI complement]

| ORF Name | NT ID | AA ID | NT LN | AA LN | Score | P-Value |
|---|---|---|---|---|---|---|
| AI7503000982_187593_c1_1074 | 259 | 4031 | 972 | 323 | 177 | 3.8e-12 |

Description
sp:[LN:YPBB_BACSU] [AC:P50728] [GN:YPBB] [OR:*BACILLUS SUBTILIS*]
[DE:HYPOTHETICAL 40.7 KD PROTEIN IN FER-RECQ INTERGENIC REGION] [SP:P50728]
[DB:swissprot] >pir:[LN:F69932] [AC:F69932] [PN:hypothetical protein ypbB]
[GN:ypbB] [OR:*Bacillus subtilis*] [DB:pir2] >gp:GI:e1183748:g2634721]
[LN:BSUB0012] [AC:Z99115:AL009126] [GN:ypbB] [FN:unknown] [OR:*Bacillus
subtilis*] [DB:genpept-bct1] [DE:*Bacillus subtilis* complete genome (section
12 of 21): from 2195541 to 2409220.] [SP:P50728] [LE:212099] [RE:213157]
[DI:complement] >gp:[GI:e1185572:g2634738] [LN:BSUB0013]
[AC:Z99116:AL009126] [GN:ypbB] [FN:unknown] [OR:*Bacillus subtilis*]
[DB:genpept-bct1] [DE:*Bacillus subtilis* complete genome (section 13 of 21):
from 2395261 to 2613730.] [SP:P50728] [LE:12379] [RE:13437] [DI:complement]
>gp:[GI:g1146199] [LN:BACSERA] [AC:L47648] [GN:ypbB] [OR:*Bacillus subtilis*]
[DB:genpept-bct2] [DE:*Bacillus subtilis* phosphoglycerate dehydrogenase
(serA), ypaA, ferredoxin (fer), ypbB, recS, ypbD, ypbE, ypbF, ypbG,
ypbH, glutamate dehydrogenase (ypcA), ypdA, ypdB, ypdC, spore cortexlytic
enzyme (sleB), ypeB, ypfA, ypfB, cytidine monophosphatekinase (cmk), ypfD,
ypgA, yphA, yphB, yphC, NAD+ dependentglycerol-3-phosphate dehydrogenase
(glyc), yphE and yphF genes, complete cds.] [NT:putative] [LE:3240] [RE:4298]
[DI direct]

| ORF Name | NT ID | AA ID | NT LN | AA LN | Score | P-Value |
|---|---|---|---|---|---|---|
| AI7503000982_189203_c2_1199 | 260 | 4032 | 762 | 253 | 550 | 3.9e-53 |

Description
sp:[LN:YQEU_BACSU] [AC:P54461] [GN:YQEU] [OR:*BACILLUS SUBTILIS*]
[DE:HYPOTHETICAL 28.8 KD PROTEIN IN DNAJ-RPSU INTEREGENIC REGION]

-continued

[SP:P54461] [DB:swissprot] >pir:[LN:D69952] [AC:D69952] [PN:conserved
hypothetical protein yqeU] [GN:yqeU] [OR:*Bacillus subtilis*] [DB:pir2]
>gp:[GI:d1013146:g1303811] [LN:BACJHG42] [AC:D84432:D82370] [PN:YqeU]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:95803] [RE:96573] [DI:direct] >gp:[GI:e1183774:g2634990]
[LN:BSUB0014] [AC:Z99117:AL009126] [GN:yqeU] [FN:unknown] [OR:*Bacillus
subtilis*] [DB:genpept-bct1] [DE:*Bacillus subtilis* complete genome (section
14 of 21): from 2599451 to 2812870.] [NT:similar to hypothetical proteins]
[SP:P54461] [LE:22857] [RE:23627] [DI:complement] >gp:[GI:d1012752:g1890060]
[LN:D83717] [AC:D83717] [PN:YqeU] [OR:*Bacillus subtilis*] [SR:*Bacillus
subtilis* (strain:JH642 (trpC2 pheA1)) DNA] [DB:genpept-bct1] [DE:*Bacillus
subtilis* DNA for DnaJ, YqeT, YqeU, YqeV, YqeW, YqeX, YqeY, complete and
partial cds.] [NT:Similar to 26.9 kDa protein (YggJ) of *E. coli*] [LE:1334]
[RE:2104] [DI:direct]

| ORF Name | NT ID | AA ID | NT LN | AA LN | Score | P-Value |
|---|---|---|---|---|---|---|
| AI7503000982__19540931__c2__1191 | 261 | 4033 | 2220 | 739 | 647 | 2.0e-63 |

Description
sp:[LN:CME3_BACSU] [AC:P39695] [GN:COMEC:COME3] [OR:*BACILLUS SUBTILIS*]
[DE:COME OPERON PROTEIN 3] [SP:P39695] [DB:swissprot] >pir:[LN:S39865]
[AC:S39865:E69602] [PN:late competence protein 3 (comE operon)] [GN:comEC]
[OR:*Bacillus subtilis*] [DB:pir2] >gp:[GI:g289262] [LN:BACCOME] [AC:L15202]
[OR:*Bacillus subtilis*] [SR:*Bacillus subtilis* DNA] [DB:genpept-bct2]
[DE:*Bacillus subtilis* comE operon encoding ORF1, ORF2, ORF3 and Reverse-ORF
genes, complete cds.] [LE:2603] [RE:4933] [DI:direct]

| ORF Name | NT ID | AA ID | NT LN | AA LN | Score | P-Value |
|---|---|---|---|---|---|---|
| AI7503000982__19567588__c3__1496 | 262 | 4034 | 513 | 170 | 443 | 8.5e-42 |

Description
sp:[LN:PTGA_BACST] [AC:P42015] [GN:PTSG] [OR:*BACILLUS STEAROTHERMOPHILUS*]
[EC:2.7.1.69] [DE:COMPONENT), (EII-GLC/EIII-GLC) (FRAGMENT)] [SP:P42015]
[DB:swissprot] >gp:[GI:g529001] [LN:BSU12340] [AC:U12340] [PN:PTS
glucose-specific permease] [GN:ptsG'] [OR:*Bacillus stearothermophilus*]
[DB:genpept-bct1] [DE:*Bacillus stearothermophilus* XL-65-6
phosphoenolpyruvate-dependentphosphotransferase system glucose-specific
permease (ptsG') gene, partial cds, HPr (ptsH), enzyme I (ptsI), and PtsT
(ptsT) genes, complete cds, and wall associated protein precursor (wapA')
gene, complete cds.] [NT:thermophilic, cytoplasmic protein] [LE:<1] [RE:976]
[DI direct]

| ORF Name | NT ID | AA ID | NT LN | AA LN | Score | P-Value |
|---|---|---|---|---|---|---|
| AI7503000982__19567812__c3__1495 | 263 | 4035 | 465 | 154 | 478 | 1.7e-45 |

Description
sp:[LN:YPPQ_BACSU] [AC:P54155] [GN:YPPQ] [OR:*BACILLUS SUBTILIS*]
[DE:HYPOTHETICAL 16.6 KD PROTEIN IN ILVA 3'REGION] [SP:P54155]
[DB:swissprot] >pir:[LN:F69940] [AC:F69940] [PN:transcription regulator
PilB family homolog yppQ] [GN:yppQ] [CL:hypthetical protein YCL033c]
[OR:*Bacillus subtilis*] [DB:pir2] >gp:[GI:g1256654] [LN:BACYACA] [AC:L77246]
[GN:yppQ] [OR:*Bacillus subtilis*] [DB:genpept-bct1] [DE:*Bacillus subtilis*
[YAC10-9 clone) DNA region between the serA and kdg loci.] [NT:54.8% identity
with Neisseria gonorrhoeae] [LE:33923] [RE:34354] [DI:direct]
>gp:[GI:e1183615:g2634588] [LN:BSUB0012] [AC:Z99115:AL009126] [GN:yppQ]
[FN:unknown] [OR:*Bacillus subtilis*] [DB:genpept-bct1] [DE:*Bacillus subtilis*
complete genome (section 12 of 21): from 2195541 to 2409220.] [NT:similar to
transcriptional regulator (PilB family)] [SP:P54155] [LE:90798] [RE:91229]
[DI:complement]

| ORF Name | NT ID | AA ID | NT LN | AA LN | Score | P-Value |
|---|---|---|---|---|---|---|
| AI7503000982__1960017__f3__809 | 264 | 4036 | 135 | 44 | | |

Description
NO-HIT

| ORF Name | NT ID | AA ID | NT LN | AA LN | Score | P-Value |
|---|---|---|---|---|---|---|
| AI7503000982__19804838__f2__385 | 265 | 4037 | 717 | 238 | 549 | 5.0e-53 |

Description
sp:[LN:YPDP_BACSU] [AC:P54163] [GN:YPDP] [OR:*BACILLUS SUBTILIS*]
[DE:HYPOTHETICAL 25.7 KD PROTEIN IN BCSA-DEGR INTERGENIC REGION] [SP:P54163]
[DB:swissprot] >pir:[LN:C69934] [AC:C69934] [PN:conserved hypothetical -continued protein ypdP] [GN:ypdP] [CL:*Archaeoglobus fulgidus* conserved hypothetical
protein AF2110] [OR:*Bacillus subtilis*] [DB:pir2] >gp:[GI:g1256625]
[LN:BACYACA] [AC:L77246] [GN:ypdP] [OR:*Bacillus subtilis*] [DB:genpept-bct1]
[DE:*Bacillus subtilis* (YAC10-9 clone) DNA region between the serA and kdg
loci.] [NT:putative] [LE:11031] [RE:11720] [DI:complement]
>gp:[GI:e1183645:g2634618] [LN:BSUB0012] [AC:Z99115:AL009126] [GN:ypdP]
[FN:unknown] [OR:*Bacillus subtilis*] [DB:genpept-bct1] [DE:*Bacillus subtilis*
complete genome (section 12 of 21): from 2195541 to 2409220.] [NT:similar to
hypothetical proteins] [SP:P54163] [LE:113432] [RE:114121] [DI:direct]

| ORF Name | NT ID | AA ID | NT LN | AA LN | Score | P-Value |
|---|---|---|---|---|---|---|
| AI7503000982__20006377__c3__1392 | 266 | 4038 | 732 | 243 | 432 | 1.2e-40 |

Description
sp:[LN:YQFN_BACSU] [AC:P54471] [GN:YQFN] [OR:*BACILLUS SUBTILIS*]
[DE:HYPOTHETICAL 23.7 KD PROTEIN IN CCCA-SODA INTERGENIC REGION] [SP:P54471]
[DB:swissprot] >pir:[LN:H69953] [AC:H69953] [PN:conserved hypothetical
protein yqfN] [GN:yqfN] [OR:*Bacillus subtilis*] [DB:pir2]
>gp:[GI:d1013170:g1303835] [LN:BACJH642] [AC:D84432:D82370] [PN:YqfN]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:120338] [RE:120988] [DI:direct]
>gp:[GI:e1185785:g2634951] [LN:BSUB0013] [AC:Z99116:AL009126] [GN:yqfN]
[FN:unknown] [OR:*Bacillus subtilis*] [DB:genpept-bct1] [DE:*Bacillus subtilis*
complete genome (section 13 of 21): from 2395261 to 2613730.] [NT:similar to
hypothetical proteins] [SP:P54471] [LE:202632] [RE:203282] [DI:complement]

| ORF Name | NT ID | AA ID | NT LN | AA LN | Score | P-Value |
|---|---|---|---|---|---|---|
| AI7503000982__20035967__c1__1082 | 267 | 4039 | 1059 | 352 | 922 | 1.5e-92 |

Description
pir:[LN:H69636] [AC:H69636] [PN:glycerol-3-phosphate dehydrogenase (NAD+),
gpsA] [GN:gpsA] [CL:glycerol-3-phosphate dehydrogenase] [OR:*Bacillus
subtilis*] [EC:1.1.1.8] [DB:pir2] >gp:[GI:e1183728:g2634701] [LN:BSUB0012]
[AC:Z99115:AL009126] [PN:NAD(P)H-dependent glycerol-3-phosphate] [GN:gpsA]
[FN:synthesis of the sn-glycerol 3-phosphate] [OR:*Bacillus subtilis*]
[DB:genpept-bct1] [EC:1.1.1.94] [DE:*Bacillus subtilis* complete genome
(section 12 of 21): from 2195541 to 2409220.] [SP:P46919] [LE:192848]
[RE:193885] [DI:complement] >gp:[GI:g1146220] [LN:BACSERA] [AC:L47648]
[PN:NAD+dependent glycerol-3-phosphate] [GN:glyC] [OR:*Bacillus subtilis*]
[DB:genpept-bct2] [EC:1.1.1.94] [DE:*Bacillus subtilis* phosphoglycerate
dehydrogenase (serA), ypaA, ferredoxin (fer), ypbB, recS, ypbD, ypbE, ypbF,
ypbG, ypbH, glutamate dehydrogenase (ypcA), ypdA, ypdB, ypdC, spore
cortexlytic enzyme (sleB), ypeB, ypfA, ypfB, cytidine monophosphatekinase
(cmk), ypfD, ypgA, yphA, yphB, yphC, NAD+dependentglycerol-3-phosphate
dehydrogenase (glyc), yphE and yphF genes, complete cds.] [LE:22512]
[RE:23549] [DI:direct]

| ORF Name | NT ID | AA ID | NT LN | AA LN | Score | P-Value |
|---|---|---|---|---|---|---|
| AI7503000982__20054642__f2__341 | 268 | 4040 | 138 | 45 | | |

Description
NO-HIT

| ORF Name | NT ID | AA ID | NT LN | AA LN | Score | P-Value |
|---|---|---|---|---|---|---|
| AI7503000982__2038325__f2__381 | 269 | 4041 | 180 | 59 | | |

Description
NO-HIT

| ORF Name | NT ID | AA ID | NT LN | AA LN | Score | P-Value |
|---|---|---|---|---|---|---|
| AI7503000982__20485712__c3__1498 | 270 | 4042 | 573 | 190 | | |

Description
NO-HIT

| ORF Name | NT ID | AA ID | NT LN | AA LN | Score | P-Value |
|---|---|---|---|---|---|---|
| AI7503000982__20503437__c3__1456 | 271 | 4043 | 123 | 40 | | |

Description
NO-HIT

-continued

| ORF Name | NT ID | AA ID | NT LN | AA LN | Score | P-Value |
|---|---|---|---|---|---|---|
| AI7503000982__20507937_c2__1280 | 272 | 4044 | 1317 | 438 | 1823 | 4.9e-188 |

Description
sp:[LN:SYN__BACSU] [AC:P39772] [GN:ASNS] [OR:*BACILLUS SUBTILIS*] [EC:6.1.1.22]
[DE:(ASNRS)] [SP:P39772] [DB:swissprot] >pir:[LN:B69591] [AC:B69591:I40523]
[PN:asparagine- -tRNA ligase, asnS:asparaginyl-tRNA synthetase asnS] [GN:asnS]
[CL:lysine- -tRNA ligase] [OR:*Bacillus subtilis*] [EC:6.1.1.22] [DB:pir2]
>gp:[GI:g1146247] [LN:BACYPIA] [AC:L47709] [PN:asparaginyl-tRNA synthetase]
[GN:asnS] [OR:*Bacillus subtilis*] [DB:genpept-bct1] [EC:6.1.1.22]
[DE:*Bacillus subtilis* (clone YAC15-6B) ypiABF genes, qcrABC
genes, ypjABCDEFGHI genes, birA gene, panBCD genes, dinG gene, ypmB gene, aspB
gene, asnS gene, dnaD gene, nth gene and ypoC gene, complete cds's.]
[NT:41.1% of identity to the *Escherichia coli*] [LE:20449] [RE:21741]
[DI:direct] >gp:[GI:e1183681:g2634654] [LN:BSUB0012] [AC:Z99115:AL009126]
[PN:asparaginyl-tRNA synthetase] [GN:asnS] [OR:*Bacillus subtilis*]
[DB:genpept-bct1] [EC:6.1.1.22] [DE:*Bacillus subtilis* complete genome
(section 12 of 21): from 2195541 to 2409220.] [SP:P39772] [LE:149926]
[RE:151218] [DI:complement]

| ORF Name | NT ID | AA ID | NT LN | AA LN | Score | P-Value |
|---|---|---|---|---|---|---|
| AI7503000982__20517135_c3__1457 | 273 | 4045 | 315 | 104 | 361 | 4.1e-33 |

Description
sp:[LN:DBH__BACST] [AC:P02346:P08822] [GN:HBS:HBSU] [OR:*BACILLUS
STEAROTHERMOPHILUS:BACILLUS CALDOLYTICUS:BACILLUS CALDOTENAX*]
[DE:DNA-BINDING PROTEIN II (HB) (HU)] [SP:P02346:P08822] [DB:swissprot]
>pir:[LN:DNBS2F] [AC:JC1205:A02690:JC2509] [PN:DNA-binding protein
HU:DNA-binding protein II] [GN:hup] [CL:bacterial DNA-binding protein]
[OR:*Bacillus stearothermophilus*] [DB:pir1] >pir:[LN:JC1207] [AC:JC1207]
[PN:DNA-binding protein HU] [GN:hup] [CL:bacterial DNA-binding protein]
[OR:*Bacillus caldolyticus*] [DB:pir2] >pir:[LN:JC1206] [AC:JC1206]
[PN:DNA-binding protein HU] [GN:hup] [CL:bacterial DNA-binding protein]
[OR:*Bacillus caldotenax*] [DB:pir2] >gp:[GI:d1007851:g1065992] [LN:BACDBPHU]
[AC:D38080] [PN:DNA binding protein HU] [OR:*Bacillus stearothermophilus*]
[SR:*Bacillus stearothermophilus* (strain:1503) DNA] [DB:genpept-bct1]
[DE:*Bacillus stearothermophilus* gene for DNA binding protein HU, complete
cds.] [LE:13] [RE:285] [DI:direct] >gp:[GI:g143065] [LN:BACHUB1] [AC:M73500]
[PN:hubst] [GN:hubst] [OR:*Bacillus stearothermophilus*] [SR:*Bacillus
stearothermophilus* DNA] [DB:genpept -bct1] [DE:*B. stearothermophilus* hubst
gene, complete cds.] [LE:1] [RE:>270] [DI:direct] >gp:[GI:g143067]
[LN:BACHUB2] [AC:M73501] [PN:hubcalx] [GN:hubcalx] [OR:*Bacillus caldotenax*]
[SR:*Bacillus caldotenax* DNA] [DB:genpept-bct1] [DE:*B. caldotenax* hubcalx
gene, 5' end.] [LE:1] [RE:>270] [DI:direct] >gp:[GI:g143069] [LN:BACHUB3]
[AC:M73502] [PN:hubcald] [GN:hubcald] [OR:*Bacillus caldolyticus*]
[SR:*Bacillus caldolyticus* DNA] [DB:genpept-bct1] [DE:*B. caldolyticus* hubcald
gene, 5' end.] [LE:1] [RE:>270] [DI:direct]

| ORF Name | NT ID | AA ID | NT LN | AA LN | Score | P-Value |
|---|---|---|---|---|---|---|
| AI7503000982__20587536_f1__4 | 274 | 4046 | 630 | 209 | 241 | 2.2e-20 |

Description
sp:[LN:XPAC__BACSU] [AC:P37467] [GN:XPAC] [OR:*BACILLUS SUBTILIS*] [DE:XPAC
PROTEIN] [SP:P37467] [DB:swissprot] >pir:[LN:527526]
[AC:S27526:S66055:C69734] [PN:5-bromo-4-chloroindolyl phosphate hydrolysis
protein xpaC:xpaC protein] [GN:xpaC] [OR:*Bacillus subtilis*] [DB:pir2]
>gp:[GI:d1005803:g467415] [LN:BAC180K] [AC:D26185] [PN:hydrolysis of
5-bromo-4-chloroindolyl phosphate] [GN:xpaC] [OR:*Bacillus subtilis*]
[SR:*Bacillus subtilis* (sub__species:Marburg, strain:168) DNA]
[DB:genpept-bct1] [DE:*B. subtilis* DNA, 180 kilobase region of replication
origin.] [LE:99445] [RE:100059] [DI:direct] >gp:[GI:g143830] [LN:BACXPAC]
[AC:M96156] [GN:xpaC] [OR:*Bacillus subtilis*] [SR:*Bacillus subtilis* (strain
W168) DNA] [DB:genpept-bct1] [DE:*Bacillus subtilis* ORF1 and xpaC gene,
complete cds's; ssrRNA gene,3' end; ORF3C 5' end.] [LE:532] [RE:1146]
[DI:direct] >gp:[GI:e1181958:g2632292] [LN:BSUB0001] [AC:Z99104:AL009126]
[GN:xpaC] [FN:hydrolysis of 5-bromo 4-chloroindolyl phosphate] [OR:*Bacillus
subtilis*] [DB:genpept-bct1] [DE:*Bacillus subtilis* complete genome (section 1
of 21): from 1 to 213080.] [SP:P37467] [LE:35843] [RE:36457] [DI:direct]

| ORF Name | NT ID | AA ID | NT LN | AA LN | Score | P-Value |
|---|---|---|---|---|---|---|
| AI7503000982__20594688_c2__1331 | 275 | 4047 | 1725 | 574 | 126 | 6.2e-08 |

Description
sp:[LN:LPLA__BACSU] [AC:P37966] [GN:LPLA] [OR:*BACILLUS SUBTILIS*]
[DE:LIPOPROTEIN LPLA PRECURSOR] [SP:P37966] [DB:swissprot] >pir:LN:I39876]

-continued

[AC:I39876:H69652] [PN:lipoprotein lplA:lysis protein lplA] [GN:lplA]
[CL:*Bacillus subtilis* lipoprotein lplA] [OR:*Bacillus subtilis*] [DB:pir2]
>gp:[GI:e1182689:g2633023] [LN:BSUB0004] [AC:Z99107:AL009126]
[PN:lipoprotein] [IGN:lplA] [OR:*Bacillus subtilis*] [DB:genpept-bct1]
[DE:*Bacillus subtilis* complete genome (section 4 of 21): from 600701
to 813890.] [SP:P37966] [LE:178337] [RE:179845] [DI:direct] >gp:[GI:g431272]
[LN:BACLPLA] [AC:L03376] [PN:lysis protein] [GN:lplA] [OR:*Bacillus subtilis*]
[SR:*Bacillus subtilis* (strain Marburg 168) DNA] [DB:genpept-bct2]
[DE:*Bacillus subtilis* lysis protein (lplA) gene, complete cds.] [LE:482]
[RE:1990] [DI:direct]

| ORF Name | NT ID | AA ID | NT LN | AA LN | Score | P-Value |
|---|---|---|---|---|---|---|
| AI7503000982__20734677__c1__1135 | 276 | 4048 | 774 | 257 | 297 | 2.5e-26 |

Description
gp:[GI:g4981613] [LN:AE001767] [AC:AE001767:AE000512] [PN:transcriptional
regulator, DeoR family] [GN:TM1069] [OR:*Thermotoga maritima*]
[DB:genpept-bct2] [DE:*Thermotoga maritima* section 79 of 136 of the complete
genome.] [NT:similar to GB:AL009126 percent identity:55.02;] [LE:1578]
[RE:2336] [DI:complement]

| ORF Name | NT ID | AA ID | NT LN | AA LN | Score | P-Value |
|---|---|---|---|---|---|---|
| AI7503000982__20791068__c3__1370 | 277 | 4049 | 273 | 90 | 71 | 0.041 |

Description
gp:[GI:g294060] [LN:PAPMPL146A] [AC:L06467] [PN:major latex protein]
[GN:MLP14G] [OR:*Papaver somniferum*] [SR:*Papaver somniferum* (strain UNL186)
(library:EMBL) DNA] [DB:genpept-plnl] [DE:*Papaver somniferum* major latex
protein (MLP146) gene, complete cds.] [LE:963:1290] [RE:1167:1564]
[DI:directJoin]

| ORF Name | NT ID | AA ID | NT LN | AA LN | Score | P-Value |
|---|---|---|---|---|---|---|
| AI7503000982__20876263__f1__159 | 278 | 4050 | 171 | 56 | | |

Description
NO-HIT

| ORF Name | NT ID | AA ID | NT LN | AA LN | Score | P-Value |
|---|---|---|---|---|---|---|
| AI7503000982__2148387__c1__1089 | 279 | 4051 | 1278 | 425 | 1794 | 5.8e-185 |

Description
sp:[LN:AROC__STAAU] [AC:Q59803] [GN:AROC] [OR:*STAPHYLOCOCCUS AUREUS*]
[EC:4.6.1.4] [DE:PHOSPHOLYASE)] [SP:Q59803] [DB:swissprot] >gp:[GI:g987498]
[LN:SAU31979] [AC:U31979] [PN:chorismate synthase] [GN:aroC]
[QR:*Staphylococcus aureus*] [DB:genpept-bct1] [EC:4.6.1.4] [DE:*Staphylococcus
aureus* chorismate synthase (aroC) and nucleosidediphosphate kinase (ndk)
genes, complete cds, dehydroauinatesynthase (aroB) and geranylgeranyl
pyrophosphate synthetase homolog(gerCC) genes, partial cds.]
[NT:5-enolpyruvyishikimate 3-phosphate phospho-lyase] [LE:1142] [RE:2308]
[DI:direct]

| ORF Name | NT ID | AA ID | NT LN | AA LN | Score | P-Value |
|---|---|---|---|---|---|---|
| AI7503000982__21501550__c1__1127 | 280 | 4052 | 1116 | 371 | 999 | 1.0e-100 |

Description
gp:[GI:g3688811] [LN:AF084104] [AC:AF084104] [PN:maltose transportor
ATP-binding protein] [GN:malK] [OR:*Bacillus firmus*] [DB:genpept-bct2]
[DE:*Bacillus firmus* AcsA (acsA) gene, partial cds; SspA CsspA), hypothetical
protein, maltose transportor ATP-binding protein(malK), leucine-rich protein
transcriptional regulator (lrpR), hypothetical proteins, ABC transporter
ATP-binding protein (natC) ,NatA (natA), NatB (natB), and hypothetical
protein genes, complete cds; and SpoIIIJ (spoIIIJ) gene, partial cds.]
[NT:MalK; Orf4; similar to MsmX from *Bacillus subtilis*,] [LE:2390] [RE:3490]
[DI:complement]

| ORF Name | NT ID | AA ID | NT LN | AA LN | Score | P-Value |
|---|---|---|---|---|---|---|
| AI7503000982__21526562__c2__1206 | 281 | 4053 | 138 | 45 | | |

Description
NO-HIT

| ORF Name | NT ID | AA ID | NT LN | AA LN | Score | P-Value |
|---|---|---|---|---|---|---|

-continued

| AI7503000982_21531627_c3_1483 | 282 | 4054 | 132 | 43 | | |

Description
NO-HIT

| ORF Name | NT ID | AA ID | NT LN | AA LN | Score | P-Value |
|---|---|---|---|---|---|---|
| AI7503000982_21537962_c1_1093 | 283 | 4055 | 612 | 203 | 357 | 1.1e-32 |

Description
sp:[LN:YPJA_BACSU] [AC:P543921] [GN:YPJA] [OR:*BACILLUS SUBTILIS*]
[DE:HYPOTHETICAL 21.3 KD PROTEIN IN QCRC-DAPB INTERGENIC REGION] [SP:P54392]
[DB:swissprot] >pir:[LN:A69937] [AC:A69937] [PN:hypothetical protein ypjA]
[GN:ypjA] [OR:*Bacillus subtilis*] [DB:pir2] >gp:[GI:g1146230] [LN:BACYPIA]
[AC:L47709] [GN:ypjA] [FN:hypothetical] [OR:*Bacillus subtilis*]
[DB:genpept-bct1] [DE:*Bacillus subtilis* (clone YAC15-6B) ypiABF genes,
qcrABC genes,ypjABCDEFGHI genes, birA gene, panBCD genes, dinG gene, ypmB
gene, aspB gene, asnS gene, dnaD gene, nth gene and ypoC gene,
complete cds's.] [NT:putative] [LE:5002] [RE:5559] [DI:direct]
>gp:[GI:e1183698:g2634671] [LN:BSUB0012] [AC:Z99115:AL009126] [GN:ypjA]
[FN:unknown] [OR:*Bacillus subtilis*] [DB:genpept-bct1] [DE:*Bacillus subtilis*
complete genome (section 12 of 21): from 2195541 to 2409220.] [SP:P54392]
[LE:166108] [RE:166665] [DI:complement]

| ORF Name | NT ID | AA ID | NT LN | AA LN | Score | P-Value |
|---|---|---|---|---|---|---|
| AI7503000982_21568762_c1_1013 | 284 | 4056 | 1005 | 334 | 992 | 5.6e-100 |

Description
gp:[GI:e1356351:g3947511] [LN:BMAJ4B29] [AC:AJ224829] [GN:ORF4] [OR:*Bacillus
megaterium*] [DB:genpept-bct1] [DE:*Bacillus megaterium* DSM319 spoIV operon,
5' flanking region, 3' flanking region.] [LE:3056] [RE:4030] [DI:direct]

| ORF Name | NT ID | AA ID | NT LN | AA LN | Score | P-Value |
|---|---|---|---|---|---|---|
| AI7503000982_21600325_f1_228 | 285 | 4057 | 141 | 46 | | |

Description
NO-HIT

| ORF Name | NT ID | AA ID | NT LN | AA LN | Score | P-Value |
|---|---|---|---|---|---|---|
| AI7503000982_21640636_f1_136 | 286 | 4058 | 276 | 91 | 366 | 1.2e-33 |

Description
pir:[LN:D69621] [AC:D69621] [PN:ferredoxin fer] [GN:fer] [CL:ferredoxin
2[4Fe-4S]:ferredoxin 2[4Fe-4S] homology] [OR:*Bacillus subtilis*] [DB:pir2]
>gp:[GI:e1183749:g2634722] [LN:BSUB0012] [AC:Z99115:AL009126]
[PN:ferredoxin] [GN:fer] [OR:*Bacillus subtilis*] [DB:genpept-bct1]
[DE:*Bacillus subtilis* complete genome (section 12 of 21): from 2195541 to
2409220.] [NT:alternate gene name:ypbA] [SP:P50727] [LE:213423] [RE:213671]
[DI:direct] >gp:[GI:e1185573:g2634739] [LN:BSUB0013] [AC:Z99116:AL009126]
[PN:ferredoxin] [GN:fer] [OR:*Bacillus subtilis*] [DB:genpept-bct2.]
[DE:*Bacillus subtilis* complete genome (section 13 of 21): from 2395261 to
2613730.] [NT:alternate gene name:ypbA] [SP:P50727] [LE:13703] [RE:13951]
[DI:direct] >gp:[GI:g1146198] [LN:BACSERA] [AC:L47648] [PN:ferredoxin]
[GN:fer] [OR:*Bacillus subtilis*] [DB:genpept-bct2] [DE:*Bacillus subtilis*
phosphoglycerate dehydrogenase (serA), ypaA, ferredoxin (fer), ypbB, recS,
ypbD, ypbE, ypbF, ypbG, ypbH, glutamate dehydrogenase (ypcA), ypdA, ypdB,
ypdC, spore cortexlytic enzyme (sleB), ypeB, ypfA, ypfB, cytidine
monophosphatekinase (cmk), ypfD, ypgA, yphA, yphB, yphC, NAD+
dependentglycerol-3-phosphate dehydrogenase (glyc), yphE and yphF
genes, complete cds.] [NT:ypbA; similar to *B. stearothermophilus* ferredoxin;)
[LE:2726] [RE:2974] [DI:complement]

| ORF Name | NT ID | AA ID | NT LN | AA LN | Score | P-Value |
|---|---|---|---|---|---|---|
| AI7503000982_21667676_c1_975 | 287 | 4059 | 888 | 295 | 590 | 2.2e-57 |

Description
pir:[LN:C69981] [AC:C69981] [PN:conserved hypothetical protein yrvM]
[GN:yrvM] [OR:*Bacillus subtilis*] [DB:pir2] >gp:[GI:e1184002:g2635218]
[LN:BSUB0015] [AC:Z99118:AL009126] [GN:yrvM] [FN:unknown] [OR:*Bacillus
subtilis*] [DB:genpept-bct1] [DE:*Bacillus subtilis* complete genome (section
15 of 21): from 2795131 to 3013540.] [NT:similar to hypothetical proteins)]
[LE:17779] [RE:18264] [DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000982__21674067_f1__8 | 288 | 4060 | 198 | 65 | | |

Description
NO-HIT

| ORF Name | NT ID | AA ID | NT LN | AA LN | Score | P-Value |
|---|---|---|---|---|---|---|
| AI7503000982__21678187_c3__1486 | 289 | 4061 | 240 | 79 | | |

Description
NO-HIT

| ORF Name | NT ID | AA ID | NT LN | AA LN | Score | P-Value |
|---|---|---|---|---|---|---|
| AI7503000982__21730443_c1__1055 | 290 | 4062 | 1332 | 443 | 904 | 1.2e-90 |

Description
sp:[LN:ODB2__BACSU] [AC:P37942] [GN:BFMBB:BFMB2:BFMB] [OR:*BACILLUS SUBTILIS*]
[EC:2.3.1.-] [DE:CHAIN TRANSACYLASE)] [SP:P37942] [DB:swissprot]
pir:[LN:S32488] [AC:S32488:E69593] [PN:dihydrolipoamide
S-acyltransferase,, alpha-oxo acid dehydrogenase complex
(bfmBB):branched-chain alpha-oxo acid dehydrogenase complex E2
component:dihydrolipoyl acyltransferase] [GN:bfmBB] [CL:dihydrolipoamide
acetyltransferase:lipoyl/biotin-binding homology] [OR:*Bacillus subtilis*]
[EC:2.3.1.-] [DB:pir2] >gp:[GI:g142613] [LN:BACBRANCH] [AC:M97391:M96937]
[PN:branched chain alpha-keto acid dehydrogenase E2] [OR:*Bacillus subtilis*]
[SR:*Bacillus subtilis* DNA] [DB:genpept-bct1] [DE:*Bacillus subtilis* branched
chain alpha-keto acid dehydrogenaseE1-alpha, branched chain alpha-keto acid
dehydrogenase E1-beta, and branched chain alpha-keto acid dehydrogenase E2,
complete cds.] [LE:2228] [RE:3502] [DI:direct] >gp:[GI:d1013279:g1303944]
[LN:BACJH642] [AC:D84432:D823701] [PN:BfmBB] [OR:*Bacillus subtilis*]
[SR:*Bacillus subtilis* (strain:JH642(trpC2 PheA1)) DNA] [DB:genpept-bct1]
[DE:*Bacillus subtilis* DNA, 283 Kb region containing skin element.]
[LE:221574] [RE:222848] [DI:direct] >gp:[GI:e1185671:g2634837] [LN:BSUB0013]
[AC:Z99116:AL009126] [PN:branched-chain alpha-keto acid dehydrogenase E2]
[GN:bfmBB] [OR:*Bacillus subtilis*] [DB:genpept-bct1] [EC:2.3.1.-]
[DE:*Bacillus subtilis* complete genome (section 13 of 21): from 2395261 to
2613730.] [NT:alternate gene name:bfmB2] [SP:P37942] [LE:100771]
[RE:102045] [DI:complement]

| ORF Name | NT ID | AA ID | NT LN | AA LN | Score | P-Value |
|---|---|---|---|---|---|---|
| AI7503000982__21756562_c2__1289 | 291 | 4063 | 696 | 231 | 162 | 5.1e-12 |

Description
pir:[LN:G69828] [AC:G69828] [PN:calcium-binding protein homolog yheG]
[GN:yheG] [OR:*Bacillus subtilis*] [DB:pir2] >gp:[GI:e1182974:g2633308]
[LN:BSUB0006] [AC:Z99109:AL009126] [GN:yheG] [FN:unknown] [OR:*Bacillus
subtilis*] [DB:genpept-bct1] [DE:*Bacillus subtilis* complete genome (section 6
of 21): from 999501 to 1209940.] [NT:similar to calcium-binding protein]
[LE:49122] [RE:49742] [DI:complement] >gp:[GI:e325187:g2226164]
[LN:BSY14080] [AC:Y14080] [PN:hypothetical protein] [GN:yheG] [OR:*Bacillus
subtilis*] [DB:genpept-bct1] [DE:*Bacillus subtilis* chromosomal DNA, region 75
degrees:sspB upstream of glyB.] [NT:similarity to bovine flavin reductase
[PID =] [LE:11988] [RE:12608] [DI:direct]

| ORF Name | NT ID | AA ID | NT LN | AA LN | Score | P-Value |
|---|---|---|---|---|---|---|
| AI7503000982__21759427_c3__1407 | 292 | 4064 | 1350 | 449 | 1396 | 8.7e-143 |

Description
sp:[LN:GCS1__BACSU] [AC:P54376] [GN:YQHJ] [OR:*BACILLUS SUBTILIS*] [EC:1.4.4.2]
[DE:PROTEIN)] [SP:P54376] [DB:swissprot] >pir:[LN:A69959] [AC:A69959]
[PN:glycine dehydrogenase homolog yqhJ] [GN:yqhJ] [OR:*Bacillus subtilis*]
[DB:pir2] >gp:[GI:d1013226:g1303891] [LN:BACJH642] [AC:D84432:D82370]
[PN:YqhJ] [OR:*Bacillus subtilis*] [SR:*Bacillus subtilis* (strain:JH642(trpC2
PheA1)) DNA] [DB:genpept-bct1] [DE:*Bacillus subtilis* DNA, 283 Kb region
containing skin element.] [LE:171390] [RE:172736] [DI:direct]
>gp:[GI:e1185724:g2634890] [LN:BSUB0013] [AC:Z99116:AL009126] [GN:yqhJ]
[FN:unknown] [OR:*Bacillus subtilis*] [DB:genpept-bct1] [DE:*Bacillus subtilis*
complete genome (section 13 of 21): from 2395261 to 2613730.] [NT:similar to
glycine dehydrogenase] [SP:P54376] [LE:150885] [RE:152231] [DI:complement]

| ORF Name | NT ID | AA ID | NT LN | AA LN | Score | P-Value |
|---|---|---|---|---|---|---|
| AI7503000982__21914067_c3__1512 | 293 | 4065 | 1416 | 471 | 532 | 3.1e-51 |

Description
gp:[GI:g2182835] [LN:LLU81166] [AC:U81166] [PN:histidine kinase LlkinA]

-continued

[GN:llkinA] [OR:*Lactococcus lactis* subsp. *cremoris*] [DB:genpept-bct2]
[DE:*Lactococcus lactis* subsp. *cremoris* MG1363 histidine kinase (llkinA)gene,
complete cds.] [LE:1] [RE:1473] [DI:direct]

| ORF Name | NT ID | AA ID | NT LN | AA LN | Score | P-Value |
|---|---|---|---|---|---|---|
| AI7503000982__2195307__c3__1402 | 294 | 4066 | 1095 | 364 | 348 | 9.9e-32 |

Description
sp:[LN:CMG2__BACSU] [AC:P25954] [GN:COMGB:COMG2] [OR:*BACILLUS SUBTILIS*]
[DE:COMG OPERON PROTEIN 2] [SP:P25954] [DB:swissprot] >pir:[LN:C30338]
[AC:C30338:C69603] [PN:DNA transport machinery protein comGB:comG operon
protein 2] [GN:comGB] [OR:*Bacillus subtilis*] [DB:pir2] >gp:[GI:g142707]
[LN:BACCOMGA] [AC:M29691:M22854] [GN:comG2] [OR:*Bacillus subtilis*]
[SR:*Bacillus subtilis* (strain 168) (clone:pED4) DNA] [DB:genpept-bct1]
[DE:*Bacillus subtilis* (clone pED4) comG-(1, 2, 3, 4, 5, 6, and 7) proteins incomG
operon, complete cds.] [LE:2420] [RE:3391] [DI:direct]
>gp:[GI:d1013213:g1303878] [LN:BACJHG42] [AC:D84432:D82370] [PN:ComGB]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:160650] [RE:161621] [DI:direct]
>gp:[GI:e1185740:g2634906] [LN:BSUB0013] [AC:Z99116:AL009126] [PN:probably
part of the DNA transport machinery] [GN:comGB] [FN:competence] [OR:*Bacillus
subtilis*] [DB:genpept-bct1] [DE:*Bacillus subtilis* complete genome (section
13 of 21): from 2395261 to 2613730.] [SP:P25954] [LE:162000] [RE:162971]
[DI:complement]

| ORF Name | NT ID | AA ID | NT LN | AA LN | Score | P-Value |
|---|---|---|---|---|---|---|
| AI7503000982__21962762__c1__1139 | 295 | 4067 | 732 | 243 | 615 | 5.0e-60 |

Description
gp:[GI:g143267] [LN:BACODHAB] [AC:M27141] [OR:*Bacillus subtilis*]
[SR:*B. subtilis* (strain 3G18) DNA] [DB:genpept-bct1] [DE:*B. subtilis*
2-oxoglutarate dehydrogenase (odhA) gene 3' end, and dihydrolipoamide
transsuccinylase (odhB) gene, complete cds.] [NT:2-oxoglutarate
dehydrogenase (odhA; EC 1.2.4.2)] [LE:<1] [RE:883] [DI:direct]

| ORF Name | NT ID | AA ID | NT LN | AA LN | Score | P-Value |
|---|---|---|---|---|---|---|
| AI7503000982__22031307__f3__906 | 296 | 4068 | 150 | 49 | | |

Description
NO-HIT

| ORF Name | NT ID | AA ID | NT LN | AA LN | Score | P-Value |
|---|---|---|---|---|---|---|
| AI7503000982__2227312__c1__974 | 297 | 4069 | 1782 | 593 | 2019 | 8.4e-209 |

Description
sp:[LN:SYD__BACSU] [AC:O32038] [GN:ASPS] [OR:*BACILLUS SUBTILIS*] [EC:6.1.1.12]
[DE:[ASPRS)] [SP:O32038] [DB:swissprot] >pir:[LN:D69591] [AC:D69591]
[PN:aspartate- -tRNA ligase, aspS:aspartyl-tRNA synthetase] [GN:aspS]
[CL:lysine- -tRNA ligase] [OR:*Bacillus subtilis*] [EC:6.1.1.12] [DB:pir2]
>gp:[GI:e1184003:g2635219] [LN:BSUB0015] [AC:Z99118:AL009126]
[PN:aspartyl-tRNA synthetase] [GN:aspS] [OR:*Bacillus subtilis*]
[DB:genpept-bct1] [EC:6.1.1.12] [DE:*Bacillus subtilis* complete genome
(section 15 of 21): from 2795131 to 3013540.] [SP:O32038] [LE:18878]
[RE:20656] [DI:complement]

| ORF Name | NT ID | AA ID | NT LN | AA LN | Score | P-Value |
|---|---|---|---|---|---|---|
| AI7503000982__22459462__c2__1275 | 298 | 4070 | 138 | 45 | | |

Description
NO-HIT

| ORF Name | NT ID | AA ID | NT LN | AA LN | Score | P-Value |
|---|---|---|---|---|---|---|
| AI7503000982__22661088__c3__1363 | 299 | 4071 | 150 | 49 | | |

Description
NO-HIT

| ORF Name | NT ID | AA ID | NT LN | AA LN | Score | P-Value |
|---|---|---|---|---|---|---|
| AI7503000982__23392__f2__366 | 300 | 4072 | 147 | 48 | | |

Description

-continued

NO-HIT

| ORF Name | NT ID | AA ID | NT LN | AA LN | Score | P-Value |
|---|---|---|---|---|---|---|
| AI7503000982__23445266__c1__1120 | 301 | 4073 | 567 | 188 | 579 | 3.3e-56 |

Description
sp:[LN:PMSR_BACSU] [AC:P54154] [GN:YPPP] [OR:*BACILLUS SUBTILIS*]
[DE:REDUCTASE)] [SP:P54154] [DB:swissprot] >pir:[LN:E69940] [AC:E69940
[PN:peptide methionine sulfoxide reductase homolog yppP] [GN:yppP]
[CL:peptide methionine sulfoxide reductase] [OR:*Bacillus subtilis*] [DB:pir2]
>gp:[GI:g1256653] [LN:BACYACA] [AC:L77246] [PN:DNA-binding protein]
[GN:yppP] [OR:*Bacillus subtilis*] [DB:genpept-bct1] [DE:*Bacillus subtilis*
(YAC10-9 clone) DNA region between the serA and kdg loci.] [NT:42.4% identity
with the *Lycopersicon esculentum*] [LE:33389] [RE:33922] [DI:direct]
>gp:[GI:e1183616:g2634589] [LN:BSUB0012] [AC:Z99115:AL009126] [GN:yppP]
[FN:unknown] [OR:*Bacillus subtilis*] [DB:genpept-bct1] [DE:*Bacillus subtilis*
complete genome (section 12 of 21): from 2195541 to 2409220.] [NT:similar to
peptide methionine sulfoxide reductase] [SP:P54154] [LE:91230] [RE:91763]
[DI complement]

| ORF Name | NT ID | AA ID | NT LN | AA LN | Score | P-Value |
|---|---|---|---|---|---|---|
| AI7503000982__23445762__c3__1397 | 302 | 4074 | 144 | 47 | | |

Description
NO-HIT

| ORF Name | NT ID | AA ID | NT LN | AA LN | Score | P-Value |
|---|---|---|---|---|---|---|
| AI7503000982__23468938__f1__258 | 303 | 4075 | 168 | 55 | | |

Description
NO-HIT

| ORF Name | NT ID | AA ID | NT LN | AA LN | Score | P-Value |
|---|---|---|---|---|---|---|
| AI7503000982__23470327__c2__1225 | 304 | 4076 | 1461 | 486 | 446 | 4.1e-42 |

Description
pir:[LN:552351] [AC:S52351] [PN:hypothetical protein 1] [OR:*Staphylococcus
xylosus*] [DB:pir2] >gp:[GI:g666115] [LN:SXGKG2] [AC:X84332] [GN:ugl]
[OR:*Staphylococcus xylosus*] [DB:genpept-bct1] [DE:*S. xylosus* glucose kinase
gene.] [NT:orf1 upstream of glucose kinase] [LE:<1] [RE:406] [DI:direct]

| ORF Name | NT ID | AA ID | NT LN | AA LN | Score | P-Value |
|---|---|---|---|---|---|---|
| AI7503000982__23470452__c2__1183 | 305 | 4077 | 441 | 146 | 214 | 1.6e-17 |

Description
pir:[LN:F71860] [AC:F71860] [PN:biotin carboxyl carrier protein] [GN:accB]
[CL:biotin carboxyl carrier protein:lipoyl/biotin-binding homology]
[OR:*Helicobacter pylori*] [SR:strain J99, , strain J99] [SR:strain J99,]
[DB:pir2] >gp:[GI:g4155592] [LN:AE001529] [AC:AE001529:AE001439] [PN:BIOTIN
CARBOXYL CARRIER PROTEIN] [GN:accB] [OR:*Helicobacter pylori* J99]
[DB:genpept-bct2] [DE:*Helicobacter pylori*, strain J99 section 90 of 132 of
the complete genome.] [NT:similar to *H. pylori* 26695 gene HP0371] [LE:5447]
[RE:5932] [DI:direct]

| ORF Name | NT ID | AA ID | NT LN | AA LN | Score | P-Value |
|---|---|---|---|---|---|---|
| AI7503000982__23476676__c2__1204 | 306 | 4078 | 369 | 122 | 227 | 6.6e-19 |

Description
gp:[GI:g902055] [LN:BSU29177] [AC:U29177] [PN:diacylglycerol kinase]
[GN:dgk] [OR:*Bacillus subtilis*] [DB:genpept-bct1] [DE:*Bacillus subtilis* PhoH
(phoH) gene, partial cds, diacylglycerolkinase (dgk) gene, complete cds, and
cytidine deaminase (cdd) gene, partial cds.] [LE:2793] [RE:3197] [DI:direct]

| ORF Name | NT ID | AA ID | NT LN | AA LN | Score | P-Value |
|---|---|---|---|---|---|---|
| AI7503000982__23595137__c2__1185 | 307 | 4079 | 558 | 185 | 522 | 3.6e-50 |

Description
sp:[LN:YQEG_BACSU] [AC:P54452] [GN:YQEG] [OR:*BACILLUS SUBTILIS*]
[DE:HYPOTHETICAL 20.1 KD PROTEIN IN NUCB-AROD INTERGENIC REGION] [SP:P54452]
[DB:swissprot] >pir:[LN:C69951] [AC:C69951] [PN:conserved hypothetical
protein yqeG] [GN:yqeG] [OR:*Bacillus subtilis*] [DB:pir2]
>gp:[GI:d1013122:g1303787] [LN:BACJH642] [AC:D84432:D82370] [PN:YqeG]
[OR:*Bacillus subtilis*] [SR:*Bacillus subtilis* (strain:JH642(trpC2 PheA1))

-continued

DNA] [DB:genpept-bct1] [DE:*Bacillus subtilis* DNA, 283 Kb region containing skin element.] [LE:72502] [RE:73020] [DI:direct] >gp:[GI:e1183798:g2635014] [LN:BSUB0014] [AC:Z99117:AL009126] [GN:yqeG] [FN:unknown] [OR:*Bacillus subtilis*] [DB:genpept-bct1] [DE:*Bacillus subtilis* complete genome (section 14 of 21): from 2599451 to 2812870.] [NT:similar to hypothetical proteins] [SP:P54452] [LE:46410] [RE:46928] [DI:complement]

| ORF Name | NT ID | AA ID | NT LN | AA LN | Score | P-Value |
|---|---|---|---|---|---|---|
| AI7503000982_23597252_f2_557 | 308 | 4080 | 168 | 55 | | |

Description
NO-HIT

| ORF Name | NT ID | AA ID | NT LN | AA LN | Score | P-Value |
|---|---|---|---|---|---|---|
| AI7503000982_23620205_f2_640 | 309 | 4081 | 138 | 45 | | |

Description
NO-HIT

| ORF Name | NT ID | AA ID | NT LN | AA LN | Score | P-Value |
|---|---|---|---|---|---|---|
| AI7503000982_23625000_c2_1246 | 310 | 4082 | 1683 | 560 | 2374 | 2.0e-246 |

Description
pir:[LN:S44188] [AC:S44188] [PN:alpha-glucosidase,] [CL:alpha-glucosidase:alpha-amylase core homology] [OR:*Staphylococcus xylosus*] [EC:3.2.1.20] [DB:pir2] >gp:[GI:g474177] [LN:SXMALRAG] [AC:X78853] [PN:alpha-D-1,4-glucosidase] [GN:malA] [OR:*Staphylococcus xylosus*] [DB:genpept-bct1] [EC:3.2.1.20] [DE:*S. xylosus* malR gene and malA gene.] [LE:1454] [RE:3103] [DI:direct]

| ORF Name | NT ID | AA ID | NT LN | AA LN | Score | P-Value |
|---|---|---|---|---|---|---|
| AI7503000982_23626383_f3_761 | 311 | 4083 | 132 | 43 | | |

Description
NO-HIT

| ORF Name | NT ID | AA ID | NT LN | AA LN | Score | P-Value |
|---|---|---|---|---|---|---|
| AI7503000982_23626425_c1_1042 | 312 | 4084 | 1056 | 351 | 763 | 1.0e-75 |

Description
pir:[LN:S72490] [AC:S72490:I39765] [PN:N-acetyl-gamma-glutamyl-phosphate reductase,] [GN:argC] [CL:N-acetyl-gamma-glutamyl-phosphate reductase] [OR:*Bacillus stearothermophilus*] [EC:1.2.1.38] [DB:pir2]

| ORF Name | NT ID | AA ID | NT LN | AA LN | Score | P-Value |
|---|---|---|---|---|---|---|
| AI7503000982_23642942_c1_1012 | 313 | 4085 | 696 | 231 | 142 | 3.6e-07 |

Description
pir:[LN:B71609] [AC:B71609] [PN:hypothetical protein PFB0680w] [GN:PFB0680w] [OR:*Plasmodium falciparum*] [DB:pir2] >gp:[GI:g3845248] [LN:AE001410] [AC:AE001410:AE001362] [PN:hypothetical protein] [GN:PFB0680w] [OR:*Plasmodium falciparum*] [SR:malaria parasite *P. falciparum*] [DB:genpept-inv2] [DE:*Plasmodium falciparum* chromosome 2, section 47 of 73 of the complete sequence.] [NT:predicted by GlimmerM] [LE:10507:10754:12646] [RE:10567:12528:12807] [DI:directJoin]

| ORF Name | NT ID | AA ID | NT LN | AA LN | Score | P-Value |
|---|---|---|---|---|---|---|
| AI7503000982_23703452_c1_1037 | 314 | 4086 | 1509 | 502 | 1808 | 1.9e-186 |

Description
sp:[LN:GCS2_BACSU] [AC:P54377] [GN:YQHK] [OR:*BACILLUS SUBTILIS*] [EC:1.4.4.2] [DE:PROTEIN)] [SP:P54377] [DB:swissprot] >pir:[LN:B69959] [AC:B69959] [PN:glycine dehydrogenase homolog yqhK] [GN:yqhK] [OR:*Bacillus subtilis*] [DB:pir2] >gp:[GI:g1013227:g1303892] [LN:BACJH642] [AC:D84432:D82370] [PN:YqhK] [OR:*Bacillus subtilis*] [SR:*Bacillus subtilis* (strain:JH642(trpC2 PheA1)) DNA] [DB:genpept-bct1] [DE:*Bacillus subtilis* DNA, 283 Kb region containing skin element.] [LE:172729] [RE:174195] [DI:direct] >gp:[GI:e1185723:g2634889] [LN:BSUB0013] [AC:Z99116:AL009126] [GN:yqhK] [FN:unknown] [OR:*Bacillus subtilis*] [DB:genpept-bct1] [DE:*Bacillus subtilis* complete genome (section 13 of 21): from 2395261 to 2613730.] [NT:similar to glycine dehydrogenase] [SP:P54377] [LE:149426] [RE:150892] [DI:complement]

-continued

| ORF Name | NT ID | AA ID | NT LN | AA LN | Score | P-Value |
|---|---|---|---|---|---|---|
| AI7503000982__23707890__c2__1322 | 315 | 4087 | 240 | 79 | 123 | 6.9e-08 |

Description
pir:[LN:A69931] [AC:A69931] [PN:hypothetical protein yozE] [GN:yozE]
[OR:*Bacillus subtilis*] [DB:pir2] >gp:[GI:e1185439:g2634360] [LN:BSUB0011]
[AC:Z99114:AL009126] [GN:yozE] [FN:unknown] [OR:*Bacillus subtilis*]
[DB:genpept-bct1] [DE:*Bacillus subtilis* complete genome (section 11 of 21):
from 2000171 to 2207900.] [LE:137942] [RE:138166] [DI:complement]

| ORF Name | NT ID | AA ID | NT LN | AA LN | Score | P-Value |
|---|---|---|---|---|---|---|
| AI7503000982__2381885__c1__988 | 316 | 4088 | 1272 | 423 | 1066 | 8.1e-108 |

Description
pir:[LN:E69765] [AC:E69765:I39896:I39895] [PN:branched chain amino acids
transporter homolog ycsG] [GN:ycsG] [OR:*Bacillus subtilis*] [DB:pir2]
>gp:[GI:e1182373:g2632707] [LN:BSUB0003] [AC:Z99106:AL009126] [GN:ycsG]
[FN:unknown] [OR:*Bacillus subtilis*] [DB:genpept-bct1] [DE:*Bacillus subtilis*
complete genome (section 3 of 21): from 402751 to 611850.] [NT:alternate gene
name: ycsH; similar to branched] [LE:54666] [RE:55826] [DI:direct]

| ORF Name | NT ID | AA ID | NT LN | AA LN | Score | P-Value |
|---|---|---|---|---|---|---|
| AI7503000982__23836052__f2__497 | 317 | 4089 | 849 | 282 | 392 | 2.1e−36 |

Description
sp:[LN:PROI_BACSU] [AC:P54552] [GN:YQJO] [OR:*BACILLUS SUBTILIS*]
[DE:PYRROLINE-5-CARBOXYLATE REDUCTASE HOMOLOG 2] [SP:P54552] [DB:swissprot]
>pir:[LN:G69964] [AC:G69964] [PN:pyrroline-5-carboxylate reductase homolog
yqjO] [GN:yqjO] [CL:pyrroline-5-carboxylate reductase] [OR:*Bacillus
subtilis*] [DB:pir2] >gp:[GI:d1013301:g1303966] [LN:BACJH642]
[AC:D84432:D82370] [PN:YqjO] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:245663] [RE:246499]
[DI:complement] >gp:[GI:e1185649:g2634815] [LN:BSUB0013]
[AC:Z99116:AL009126] [GN:yqjO] [FN:unknown] [OR:*Bacillus subtilis*]
[DB:genpept-bct1] [DE:*Bacillus subtilis* complete genome (section 13 of 21):
from 2395261 to 2613730.] [NT:similar to pyrroline-5-carboxylate reductase]
[SP:P54552] [LE:77120] [RE:77956] [DI:direct]

| ORF Name | NT ID | AA ID | NT LN | AA LN | Score | P-Value |
|---|---|---|---|---|---|---|
| AI7503000982__23850302__c3__1369 | 318 | 4090 | 2694 | 897 | 2695 | 1.9e−280 |

Description
sp:[LN:SYA_BACSU] [AC:O34526] [GN:ALAS] [OR:*BACILLUS SUBTILIS*] [EC:6.1.1.7]
[DE:ALANYL-TRNA SYNTHETASE, (ALANINE--TRNA LIGASE) (ALARS)] [SP:O34526]
[DB:swissprot] >pir:[LN:A69584] [AC:A69584] [PN:alanine--tRNA ligase,
alaS:alanyl-tRNA synthetase] [GN:alaS] [CL:alanine--tRNA ligase]
[OR:*Bacillus subtilis*] [EC:6.1.1.7] [DB:pir2] >gp:[GI:e1183970:g2635186]
[LN:BSUB0014] [AC:Z99117:AL009126] [PN:alanyl-tRNA synthetase] [GN:alaS]
[OR:*Bacillus subtilis*] [DB:genpept-bct1] [EC:6.1.1.7] [DE:*Bacillus subtilis*
complete genome (section 14 of 21):from 2599451 to 2812870.] [SP:O34526]
[LE:197994] [RE:200630] [DI:complement] >gp:[GI:e1183988:g2635204]
[LN:BSUB0015] [AC:Z99118:AL009126] [PN:alanyl-tRNA synthetase] [GN:alaS)
[OR:*Bacillus subtilis*] [DB:genpept-bct1] [EC:6.1.1.7] [DE:*Bacillus subtilis*
complete genome (section 15 of 21):from 2795131 to 3013540.] [SP:O34526]
[LE:2314] [RE:4950] [DI:complement]

| ORF Name | NT ID | AA ID | NT LN | AA LN | Score | P-Value |
|---|---|---|---|---|---|---|
| AI7503000982__23884692__c3__1415 | 319 | 4091 | 366 | 121 | 217 | 7.5e−18 |

Description
sp:[LN:YQHY_BACSU] [AC:P54519] [GN:YQHY] [OR:*BACILLUS SUBTILIS*]
[DE:HYPOTHETICAL 14.7 KD PROTEIN IN ACCC-FOLD INTERGENIC REGION] [SP:P54519]
[DB:swissprot] >pir:[LN:E69960] [AC:E69960] [PN:conserved hypothetical
protein yqhY] [GN:yqhY] [OR:*Bacillus subtilis*] [DB:pir2]
>gp:[GI:d1013249:g1303914] [LN:BACJH642] [AC:D84432:D82370] [PN:YqhY]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:189273] [RE:189680] [DI:direct]

-continued

>gp:[GI:e1185701:g2634867] [LN:BSUB0013] [AC:Z99116:AL009126] [GN:yqhY]
[FN:unknown] [OR:*Bacillus subtilis*] [DB:genpept-bct1] [DE:*Bacillus subtilis*
complete genome (section 13 of 21):from 2395261 to 2613730.] [NT:similar to
hypothetical proteins from *B. subtilis*] [SP:P54519] [LE:133941] [RE:134348]
[DI:complement]

| ORF Name | NT ID | AA ID | NT LN | AA LN | Score | P-Value |
|---|---|---|---|---|---|---|
| AI7503000982__23912502__f2__605 | 320 | 4092 | 138 | 45 | | |

Description
NO-HIT

| ORF Name | NT ID | AA ID | NT LN | AA LN | Score | P-Value |
|---|---|---|---|---|---|---|
| AI7503000982__23964011__f2__352 | 321 | 4093 | 195 | 64 | | |

Description
NO-HIT

| ORF Name | NT ID | AA ID | NT LN | AA LN | Score | P-Value |
|---|---|---|---|---|---|---|
| AI7503000982__24042212__c3__1403 | 322 | 4094 | 498 | 165 | 72 | 0.034 |

Description
sp:[LN:CMG3_BACSU] [AC:P25955] [GN:COMGC:COMG3] [OR:*BACILLUS SUBTILIS*]
[DE:COMG OPERON PROTEIN 3 PRECURSOR] [SP:P25955] [DB:swissprot]
>pir:[LN:D30338] [AC:D30338:A35133:D69603] [PN:exogenous DNA-binding
protein comGC:comG operon protein 3] [GN:comGC] [OR:*Bacillus subtilis*]
[DB:pir2] >gp:[GI:g142708] [LN:BACCOMGA] [AC:M29691:M22854] [GN:comG3]
[OR:*Bacillus subtilis*] [SR:*Bacillus subtilis* (strain 168) (clone:pED4) DNA]
[DB:genpept-bct1] [DE:*Bacillus subtilis* (clone pED4) comG-(1, 2, 3, 4, 5, 6, and
7) proteins incomG operon, complete cds.] [LE:3405] [RE:3701] [DI:direct]
>gp:[GI:d1013214:g1303879] [LN:BACJH642] [AC:D84432:D82370] [PN:ComGC]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:161635] [RE:161931] [DI:direct]
>gp:[GI:e1185739:g2634905] [LN:BSUB0013] [AC:Z99116:AL009126] [GN:comGC]
[FN:exogenous DNA-binding (competence)] [OR:*Bacillus subtilis*]
[DB:genpept-bct1] [DE:*Bacillus subtilis* complete genome (section 13 of 21):
from 2395261 to 2613730.] [SP:P25955] [LE:161690] [RE:161986] [DI:complement]

| ORF Name | NT ID | AA ID | NT LN | AA LN | Score | P-Value |
|---|---|---|---|---|---|---|
| AI7503000982__24071068__f1__186 | 323 | 4095 | 399 | 132 | 308 | 1.7e−27 |

Description
sp:[LN:YQHL_BACSU] [AC:P54510] [GN:YQHL] [OR:*BACILLUS SUBTILIS*]
[DE:HYPOTHETICAL 14.6 KD PROTEIN IN GCVT-SPOIIIAA INTERGENIC REGION]
[SP:P54510] [DB:swissprot] >pir:[LN:C69959] [AC:C69959] [PN:glpE protein
homolog yqhL] [GN:yqhL] [CL:glpE protein] [OR:*Bacillus subtilis*] [DB:pir2]
>gp:[GI:d1013228:g1303893] [LN:BACJH642] [AC:D84432:D82370] [PN:YqhL]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:174230] [RE:174610] [DI:complement]
>gp:[GI:e1185722:g2634888] [LN:BSUB0013] [AC:Z99116:AL009126] [GN:yqhL]
[FN:unknown] [OR:*Bacillus subtilis*] [DB:genpept-bct1] [DE:*Bacillus subtilis*
complete genome (section 13 of 21):from 2395261 to 2613730.] [NT:similar to
hypothetical proteins] [SP:P54510] [LE:149011] [RE:149391] [DI:direct]

| ORF Name | NT ID | AA ID | NT LN | AA LN | Score | P-Value |
|---|---|---|---|---|---|---|
| AI7503000982__24094090__c1__986 | 324 | 4096 | 957 | 318 | 927 | 4.4e−93 |

Description
pir:[LN:G69979] [AC:G69979] [PN:proteinase homolog yrrN] [GN:yrrN]
[OR:*Bacillus subtilis*] [DB:pir2] >gp:[GI:e1183965:g2635181] [LN:BSUB0014]
[AC:Z99117:AL009126] [GN:yrrN] [FN:unknown] [OR:*Bacillus subtilis*]
[DB:genpept-bct1] [DE:*Bacillus subtilis* complete genome (section 14 of 21):
from 2599451 to 2812870.] [NT:similar to protease] [LE:193967] [RE:194896]
[DI:complement]

| ORF Name | NT ID | AA ID | NT LN | AA LN | Score | P-Value |
|---|---|---|---|---|---|---|
| AI7503000982__24100715__c3__1422 | 325 | 4097 | 1035 | 344 | 888 | 5.9e−89 |

Description
sp:[LN:ODBA_BACSU] [AC:P37940] [GN:BFMBAA:BFMB1A] [OR:*BACILLUS SUBTILIS*]
[EC:1.2.4.4] [DE:(BCKDH E1-ALPHA)] [SP:P37940] [DB:swissprot]

-continued

>pir:[LN:C69593] [AC:C69593:S32486] [PN:3-methyl-2-oxobutanoate
dehydrogenase (lipoamide), E1 alpha chain bfmBAA:branched-chain alpha-oxo
acid dehydrogenase E1 alpha chain] [GN:bfmBAA] [CL:pyruvate dehydrogenase
(lipoamide) alpha chain:thiamine pyrophosphate-binding domain homology]
[OR:*Bacillus subtilis*] [EC:1.2.4.4] [DB:pir2] >gp:[GI:g142611]
[LN:BACBRANCH] [AC:M97391:M96937] [PN:branched chain alpha-keto acid
dehydrogenase] [OR:*Bacillus subtilis*] [SR:*Bacillus subtilis* DNA]
[DB:genpept-bct1] [DE:*Bacillus subtilis* branched chain alpha-keto acid
dehydrogenase E1-alpha, branched chain alpha-keto acid dehydrogenase E1-beta,
and branched chain alpha-keto acid dehydrogenase E2, complete cds.] [LE:216]
[RE:1208] [DI:direct] >gp:[GI:d1013277:g1303942] [LN:BACJH642]
[AC:D84432:D82370] [PN:BfmBAA] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:219562] [RE:220554]
[DI:direct] >gp:[GI:e1185673:g2634839] [LN:BSUB0013] [AC:Z99116:AL009126]
[PN:branched-chain alpha-keto acid dehydrogenase E1] [GN:bfmBAA]
[OR:*Bacillus subtilis*] [DB:genpept-bct1] [EC:1.2.4.4] [DE:*Bacillus subtilis*
complete genome (section 13 of 21):from 2395261 to 2613730.] [NT:alternate
gene name:bfmB1a] [SP:P37940] [LE:103065] [RE:104057] [DI:complement]

| ORF Name | NT ID | AA ID | NT LN | AA LN | Score | P-Value |
|---|---|---|---|---|---|---|
| AI7503000982__24104702__c1__1109 | 326 | 4098 | 30612 | 10, 20 | 618 | 1.1e−54 |

Description
gp:[GI:g1041785] [LN:PYU36927] [AC:U36927] [PN:rhoptry protein]
[FN:erythrocyte invasion and possible binding] [OR:*Plasmodium yoelii*]
[DB:genpept-inv1] [DE:*Plasmodium yoelii* rhoptry protein gene, partial cds.]
[LE:<1] [RE:7206] [DI:direct]

| ORF Name | NT ID | AA ID | NT LN | AA LN | Score | P-Value |
|---|---|---|---|---|---|---|
| AI7503000982__24117777__f3__858 | 327 | 4099 | 174 | 57 | | |

Description
NO-HIT

| ORF Name | NT ID | AA ID | NT LN | AA LN | Score | P-Value |
|---|---|---|---|---|---|---|
| AI7503000982__24225000__c1__1152 | 328 | 4100 | 651 | 216 | 365 | 1.6e−33 |

Description
gp:[GI:g2194195] [LN:SGU61158] [AC:U61158] [PN:GdmF] [GN:gdmF]
[OR:*Staphylococcus gallinarum*] [DB:genpept-bct1] [DE:*Staphylococcus
gallinarum* Tue3928 GdmF (gdmF), putative membrane protein (gdmH), ABC
transporter (gdmT), and antibiotic gallidermin precursor (gdmA) genes,
complete cds, putative membrane protein(gdmE) and modifying enzyme (gdmB)
genes, partial cds.] [NT:proposed ABC transporter subunit (ATP-binding]
[LE:179] [RE:874] [DI:complement]

| ORF Name | NT ID | AA ID | NT LN | AA LN | Score | P-Value |
|---|---|---|---|---|---|---|
| AI7503000982__24226412__c3__1436 | 329 | 4101 | 570 | 189 | 437 | 3.7e−41 |

Description
sp:[LN:YQKG_BACSU] [AC:P54570] [GN:YQKG] [OR:*BACILLUS SUBTILIS*]
[DE:HYPOTHETICAL 21.0 KD PROTEIN IN GLNQ-ANSR INTERGENIC REGION] [SP:P54570]
[DB:swissprot] >pir:[LN:A69967] [AC:A69967] [PN:conserved hypothetical
protein yqkG] [GN:yqkG] [CL:yffH protein:mutT domain homology] [OR:*Bacillus
subtilis*] [DB:pir2] >gp:[GI:d1013319:g1303984] [LN:BACJH642]
[AC:D84432:D82370] [PN:YqkG] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:260584] [RE:261141]
[DI:direct] >gp:[GI:e1185630:g2634796] [LN:BSUB0013] [AC:Z99116:AL009126]
[GN:yqkG] [FN:unknown] [OR:*Bacillus subtilis*] [DB:genpept-bct1] [DE:*Bacillus
subtilis* complete genome (section 13 of 21):from 2395261 to 2613730.]
[NT:similar to hypothetical proteins] [SP:P54570] [LE:62478] [RE:63035]
[DI:complement]

| ORF Name | NT ID | AA ID | NT LN | AA LN | Score | P-Value |
|---|---|---|---|---|---|---|
| AI7503000982__24226635__f2__499 | 330 | 4102 | 156 | 51 | | |

Description
NO-HIT

| ORF Name | NT ID | AA ID | NT LN | AA LN | Score | P-Value |
|---|---|---|---|---|---|---|

-continued

| | | | | | |
|---|---|---|---|---|---|
| AI7503000982_24228452_f3_942 | 331 | 4103 | 138 | 45 | |

Description
NO-HIT

| ORF Name | NT ID | AA ID | NT LN | AA LN | Score | P-Value |
|---|---|---|---|---|---|---|
| AI7503000982_24229515_c3_1423 | 332 | 4104 | 1170 | 389 | 980 | 1.1e−98 |

Description
sp:[LN:YQJE_BACSU] [AC:P54542] [GN:YQJE] [OR:*BACILLUS SUBTILIS*]
[DE:HYPOTHETICAL 39.7 KD PROTEIN IN GLNQ-ANSR INTERGENIC REGION] [SP:P54542]
[DB:swissprot] >pir:[LN:E69963] [AC:E69963] [PN:tripeptidase homolog yqjE]
[GN:yqjE] [OR:*Bacillus subtilis*] [DB:pir2] >gp:[GI:d1013291:g1303956]
[LN:BACJH642] [AC:D84432:D82370] [PN:YqjE] [OR:*Bacillus subtilis*]
[SR:*Bacillus subtilis* (strain:JH642(trpC2 PheA1)) DNA] [DB:genpept-bct1]
[DE:*Bacillus subtilis* DNA, 283 Kb region containing skin element.]
[LE:232856] [RE:233971] [DI:direct] >gp:[GI:e1185659:g2634825] [LN:BSUB0013]
[AC:Z99116:AL009126] [GN:yqjE] [FN:unknown] [OR:*Bacillus subtilis*]
[DB:genpept-bct1] [DE:*Bacillus subtilis* complete genome (section 13 of 21):
from 2395261 to 2613730.] [NT:similar to tripeptidase] [SP:P54542] [LE:89648]
[RE:90763] [DI:complement]

| ORF Name | NT ID | AA ID | NT LN | AA LN | Score | P-Value |
|---|---|---|---|---|---|---|
| AI7503000982_24229805_c3_1376 | 333 | 4105 | 1386 | 461 | 1133 | 6.4e−115 |

Description
pir:[LN:A69581] [AC:A69581] [PN:acetyl-CoA carboxylase (biotin carboxylase
subunit) accC] [GN:accC] [CL:biotin carboxylase:biotin carboxylase
homology] [OR:*Bacillus subtilis*] [DB:pir2] >gp:[GI:d1013248:g1303913]
[LN:BACJH642] [AC:D84432:D82370] [PN:YqhX] [OR:*Bacillus subtilis*]
[SR:*Bacillus subtilis* (strain:JH642(trpC2 PheA1)) DNA] [DB:genpept-bct1]
[DE:*Bacillus subtilis* DNA, 283 Kb region containing skin element.]
[LE:187900] [RE:189252] [DI:direct] >gp:[GI:e1185702:g2634868] [LN:BSUB0013]
[AC:Z99116:AL009126] [PN:acetyl-CoA carboxylase subunit (biotin] [GN:accC]
[FN:long-chain fatty acid biosynthesis] [OR:*Bacillus subtilis*]
[DB:genpept-bct1] [EC:6.4.1.2] [DE:*Bacillus subtilis* complete genome
(section 13 of 21):from 2395261 to 2613730.] [NT:alternate gene name:yqhX]
[SP:P49787] [LE:134369] [RE:135721] [DI:complement]

| ORF Name | NT ID | AA ID | NT LN | AA LN | Score | P-Value |
|---|---|---|---|---|---|---|
| AI7503000982_24257658_f1_309 | 334 | 4106 | 162 | 53 | | |

Description
NO-HIT

| ORF Name | NT ID | AA ID | NT LN | AA LN | Score | P-Value |
|---|---|---|---|---|---|---|
| AI7503000982_24260061_c3_1353 | 335 | 4107 | 348 | 115 | 214 | 1.6e−17 |

Description
sp:[LN:YSXB_BACSU] [AC:P26942:Q45629] [GN:YSXB] [OR:*BACILLUS SUBTILIS*]
[DE:HYPOTHETICAL 12.3 KD PROTEIN IN RPLU-RPMA INTERGENIC REGION (ORF X)]
[SP:P26942:Q45629] [DB:swissprot] >pir:[LN:S18440] [AC:S18440:D21895:B69987]
[PN:conserved hypothetical protein ysxB] [GN:ysxB ] [OR:*Bacillus subtilis*]
[DB:pir2] >gp:[GI:g40174] [LN:BSSPOIVFO] [AC:X59528:S61796] [OR:*Bacillus
subtilis*] [DB:genpept-bct1] [DE:*B. subtilis* spoIVFA, spoIVFB, L20, orfX and
L24 genes.] [NT:ORF X] [SP:P26942] [LE:2270] [RE:2608] [DI:direct]
>gp:[GI:e1184044:g2635260] [LN:BSUB0015] [AC:Z99118:AL009126] [GN:ysxB]
[FN:unknown] [OR:*Bacillus subtilis*] [DB:genpept-bct1] [DE:*Bacillus subtilis*
complete genome (section 15 of 21):from 2795731 to 3013540.] [NT:similar to
hypothetical proteins] [SP:P26942] [LE:59308] [RE:59646] [DI:complement]

| ORF Name | NT ID | AA ID | NT LN | AA LN | Score | P-Value |
|---|---|---|---|---|---|---|
| AI7503000982_24261692_c3_1518 | 336 | 4108 | 1902 | 633 | 995 | 2.7e−100 |

Description
pir:[LN:D69907] [AC:D69907] [PN:hypothetical protein yojO] [GN:yojO]
[OR:*Bacillus subtilis*] [DB:pir2] >gp:[GI:e1185410:g2634331] [LN:BSUB0011]
[AC:Z99114:AL009126] [GN:yojO] [FN:unknown] [OR:*Bacillus subtilis*]
[DB:genpept-bct1] [DE:*Bacillus subtilis* complete genome (section 11 of 21):
from 2000171 to 2207900.] [LE:110914] [RE:112899] [DI:complement]
>gp:[GI:g3169331] [LN:AF026147] [AC:AF026147] [PN:YojO] [GN:yojO]
[FN:unknown] [OR:*Bacillus subtilis*] [DB:genpept-bct2] [DE:*Bacillus subtilis*
YojA (yojA), YojB (yojB), YojC (yojC), YojD (yojD), YojE (yojE), YojF (yojF),
YojG (yojG), YojH (yojH), YojI (yojI), YojJ (yojJ), YojK (yojK), YojL (yojL), -continued YojM (yojM), YojN (yojN), and YojO (yojO) genes, complete cds; and OdhA (odhA) gene, partial cds.] [LE:12366] [RE:14351] [DI:direct]

| ORF Name | NT ID | AA ID | NT LN | AA LN | Score | P-Value |
|---|---|---|---|---|---|---|
| AI7503000982__24266502__f3__675 | 337 | 4109 | 180 | 59 | | |

Description
NO-HIT

| ORF Name | NT ID | AA ID | NT LN | AA LN | Score | P-Value |
|---|---|---|---|---|---|---|
| AI7503000982__24274192__f2__386 | 338 | 4110 | 411 | 136 | 233 | 1.5e−19 |

Description
sp:[LN:EBSB__ENTFA] [AC:P36921] [OR:*ENTEROCOCCUS FAECALIS*] [SR:,*STREPTOCOCCUS FAECALIS*] [DE:CELL WALL ENZYME EBSB] [SP:P36921] [DB:Swissprot] >pir:[LN:B49939] [AC:B49939] [PN:ebsB protein] [CL:*Enterococcus faecalis* ebsB protein] [OR:*Enterococcus faecalis*] [DB:pir2] >gp:[GI:g388108] [LN:ENEEBSA] [AC:L23802] [PN:cell wall enzyme] [GN:ebsB] [OR:*Enterococcus faecalis*] [SR:*Enterococcus faecalis* (strain OG1SSp) DNA] [DB:genpept-bct2] [DE:*Enterococcus faecalis* pore forming, cell wall enzyme, regulatory, and dehydroquinase homologue proteins (ebsA, ebsB, ebsC, and ebsD)genes, complete cds with repeat region.] [NT:putative] [LE:734] [RE:1141] [DI:direct]

| ORF Name | NT ID | AA ID | NT LN | AA LN | Score | P-Value |
|---|---|---|---|---|---|---|
| AI7503000982__24275927__f2__622 | 339 | 4111 | 189 | 62 | | |

Description
NO-HIT

| ORF Name | NT ID | AA ID | NT LN | AA LN | Score | P-Value |
|---|---|---|---|---|---|---|
| AI7503000982__24306263__c1__1034 | 340 | 4112 | 297 | 98 | | |

Description
NO-HIT

| ORF Name | NT ID | AA ID | NT LN | AA LN | Score | P-Value |
|---|---|---|---|---|---|---|
| AI7503000982__24410300__c3__1439 | 341 | 4113 | 759 | 252 | 686 | 1.5e−67 |

Description
sp:[LN:RLUB__BACSU] [AC:P35159] [GN:RLUB] [OR:*BACILLUS SUBTILIS*] [EC:4.2.1.70] [DE:(PSEUDOURIDYLATE SYNTHASE) (URACIL HYDROLYASE)] [SP:P35159] [DB:swissprot] >pir:[LN:S45555] [AC:S45555:A69943] [PN:conserved hypothetical protein ypuL] [GN:ypuL] [CL:conserved hypothetical protein HI1243] [OR:*Bacillus subtilis*] [DB:pir2] >gp:[GI:g410137] [LN:BACDIA] [AC:L09228] [OR:*Bacillus subtilis*] [SR:*Bacillus subtilis* (strain 168, sub__species Marburg) DNA] [DB:genpept-bct1] [DE:*Bacillus subtilis* spoVA to serA region.] [NT:ORFX13] [LE:17440] [RE:18129] [DI:direct] >gp:[GI:e1185585:g2634751] [LN:BSUB0013] [AC:Z99116:AL009126] [GN:ypuL] [FN:unknown] [OR:*Bacillus subtilis*] [DB:genpept-bct1] [DE:*Bacillus subtilis* complete genome (section 13 of 21): from 2395261 to 2613730.] [NT:similar to hypothetical proteins] [SP:P35159] [LE:25454] [RE:26143] [DI:complement]

| ORF Name | NT ID | AA ID | NT LN | AA LN | Score | P-Value |
|---|---|---|---|---|---|---|
| AI7503000982__24470317__c1__1011 | 342 | 4114 | 1020 | 339 | 1246 | 6.8e−127 |

Description
sp:[LN:YQFA__BACSU] [AC:P54466] [GN:YQFA] [OR:*BACILLUS SUBTILIS*] [DE:HYPOTHETICAL 35.6 KD PROTEIN IN RPSU-PHOH INTEREGENIC REGION] [SP:P54466] [DB:swissprot] >pir:[LN:A69953] [AC:A69953] [PN:hypothetical protein yqfA] [GN:yqfA] [OR:*Bacillus subtilis*] [DB:pir2] >gp:[GI:d1013152:g1303817] [LN:BACJH642] [AC:D84432:D82370] [PN:YqfA] [OR:*Bacillus subtilis*] [SR:*Bacillus subtilis* (strain:JH642(trpC2 PheA1)) DNA] [DB:genpept-bct1] [DE:*Bacillus subtilis* DNA, 283 Kb region containing skin element.] [LE:101161] [RE:102156] [DI:direct] >gp:[GI:e1183768:g2634984] [LN:BSUB0014] [AC:Z99117:AL009126] [GN:yqfA] [FN:unknown] [OR:*Bacillus subtilis*] [DB:genpept-bct1] [DE:*Bacillus subtilis* complete genome (section 14 of 21):from 2599451 to 2812870.] [SP:P54466] [LE:17274] [RE:18269] [DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000982__24480275_c3__1499 | 343 | 4115 | 990 | 329 | 602 | 1.2e−58 |

Description
pir:[LN:A69653] [AC:A69653] [PN:transmembrane lipoprotein lplB] [GN:lplB]
[OR:*Bacillus subtilis*] [DB:pir2] >gp:[GI:e1182690:g2633024] [LN:BSUB0004]
[AC:Z99107:AL009126] [PN:transmembrane lipoprotein] [GN:lplB] [OR:*Bacillus subtilis*] [DB:genpept-bct1] [DE:*Bacillus subtilis* complete genome (section 4 of 21):from 600701 to 813890.] [LE:179900] [RE:180856] [DI:direct]

| ORF Name | NT ID | AA ID | NT LN | AA LN | Score | P-Value |
|---|---|---|---|---|---|---|
| AI7503000982__24486330_c1__980 | 344 | 4116 | 693 | 230 | 321 | 7.2e−29 |

Description
pir:[LN:H69978] [AC:H69978] [PN:conserved hypothetical protein yrrB]
[GN:yrrB] [CL:tetratricopeptide repeat homology] [OR:*Bacillus subtilis*]
[DB:pir2] >gp:[GI:e1183978:g2635194] [LN:BSUB0014] [AC:Z99117:AL009126]
[GN:yrrB] [FN:unknown] [OR:*Bacillus subtilis*] [DB:genpept-bct1] [DE:*Bacillus subtilis* complete genome (section 14 of 21):from 2599451 to 2812870.]
[NT:similar to hypothetical proteins] LE:208527] [RE:209147]
[DI:complement] >gp:[GI:e1183996:g2635212] [LN:BSUB0015]
[AC:Z99118:AL009126] [GN:yrrB] [FN:unknown] [OR:*Bacillus subtilis*]
[DB:genpept-bct1] [DE:*Bacillus subtilis* complete genome (section 15 of 21):
from 2795131 to 3013540.] [NT:similar to hypothetical proteins] [LE:12847]
[RE:13467] [DI:complement]

| ORF Name | NT ID | AA ID | NT LN | AA LN | Score | P-Value |
|---|---|---|---|---|---|---|
| AI7503000982__24489062_f1__1 | 345 | 4117 | 126 | 41 | 72 | 0.017 |

Description
pir:[LN:D70083] [AC:D70083] [PN:hypothetical protein yxzC] [GN:yxzC]
[OR:*Bacillus subtilis*] [DB:pir2] >gp:[GI:e1184645:g2636466] [LN:BSUB0021]
[AC:Z99124:AL009126] [GN:yxzC] [FN:unknown] [OR:*Bacillus subtilis*]
[DB:genpept-bct1] [DE:*Bacillus subtilis* complete genome (section 21 of 21):
from 3999281 to 4214814.] [LE:21405] [RE:21773] [DI:complement]

| ORF Name | NT ID | AA ID | NT LN | AA LN | Score | P-Value |
|---|---|---|---|---|---|---|
| AI7503000982__24511676_c1__1140 | 346 | 4118 | 246 | 81 | 251 | 4.3e−21 |

Description
sp:[LN:ODO2_BACSU] [AC:P16263] [GN:ODHB:CITM] [OR:*BACILLUS SUBTILIS*]
[EC:2.3.1.61] [DE:DEHYDROGENASE COMPLEX, (E2)] [SP:P16263] [DB:swissprot]
>pir:[LN:B32879] [AC:B32879:F69668] [PN:dihydrolipoamide
S-succinyltransferase, odhB:2-oxoglutarate dehydrogenase complex E2
component odhB:dihydrolipoamide transsuccinylase odhB] [GN:odhB]
[CL:dihydrolipoamide acetyltransferase:lipoyl/biotin-binding homology]
[OR:*Bacillus subtilis*] [EC:2.3.1.61] [DB:pir2] >gp:[GI:g143268]
[LN:BACODHAB] [AC:M27141] [OR:*Bacillus subtilis*] [SR:*B. subtilis* (strain
3G18) DNA] [DB:genpept-bct1] [DE:*B. subtilis* 2-oxoglutarate dehydrogenase
(odhA) gene 3' end, and dihydrolipoamide transsuccinylase (odhB) gene,
complete cds.] [NT:dihydrolipoamide transsuccinylase (odhB; EC] [LE:899]
[RE:2152] [DI:direct] >gp:[GI:e1185408:g2634329] [LN:BSUB0011]
[AC:Z99114:AL009126] [PN:2-oxoglutarate dehydrogenase complex] [GN:odhB]
[OR:*Bacillus subtilis*] [DB:genpept-bct1] [EC:2.3.1.61] [DE:*Bacillus subtilis*
complete genome (section 11 of 21):from 2000171 to 2207900.] [NT:alternate
gene name:citM] [SP:P16263] [LE:106590] [RE:107843] [DI:complement]

| ORF Name | NT ID | AA ID | NT LN | AA LN | Score | P-Value |
|---|---|---|---|---|---|---|
| AI7503000982__24610877_c1__1035 | 347 | 4119 | 519 | 172 | 226 | 8.4e−19 |

Description
sp:[LN:AROK_LACLA] [AC:P43906] [GN:AROK] [OR:*LACTOCOCCUS LACTIS*]
[SR:,SUBSPLACTIS:*STREPTOCOCCUS LACTIS*] [EC:2.7.1.71] [DE:SHIKIMATE KINASE,
(SK)] [SP:P43906] [DB:swissprot] >pir:[LN:S52581] [AC:S52581] [PN:shikimate
kinase,] [CL:shikimate kinase:shikimate kinase homology] [OR:*Lactococcus
lactis*] [EC:2.7.1.71] [DB:pir2] >gp:[GI:g683584] [LN:LLTYRAPH] [AC:X78413]
[PN:shikimate kinase] [GN:aroK] [OR:*Lactococcus lactis*] [DB:genpept-bct1]
[EC:2.7.1.71] [DE:*L. lactis* tyrA, aroA, aroK and pheA genes.] [SP:P43906]
[LE:2605] [RE:3093] [DI:direct]

| ORF Name | NT ID | AA ID | NT LN | AA LN | Score | P-Value |
|---|---|---|---|---|---|---|
| AI7503000982__24615915_c3__1522 | 348 | 4120 | 240 | 79 | 275 | 5.4e−24 |

Description
gp:[GI:g2226349] [LN:AF003593] [AC:AF003593] [PN:CspC] [GN:cspC]

-continued

[OR:*Staphylococcus aureus*] [DB:genpept-bct1] [DE:*Staphylococcus aureus* CspC (cspC) gene, complete cds.] [NT:similar to major cold-shock protein] [LE:444] [RE:644] [DI:direct]

| ORF Name | NT ID | AA ID | NT LN | AA LN | Score | P-Value |
|---|---|---|---|---|---|---|
| AI7503000982__24617177__c3__1433 | 349 | 4121 | 129 | 42 | | |

Description
NO-HIT

| ORF Name | NT ID | AA ID | NT LN | AA LN | Score | P-Value |
|---|---|---|---|---|---|---|
| AI7503000982__24640937__c2__1229 | 350 | 4122 | 498 | 165 | | |

Description
NO-HIT

| ORF Name | NT ID | AA ID | NT LN | AA LN | Score | P-Value |
|---|---|---|---|---|---|---|
| AI7503000982__24647187__c1__1038 | 351 | 4123 | 126 | 41 | 98 | 8.8e−05 |

Description
gp:[GI:g1022725] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF2] [LE:394] [RE:1083] [DI:complement] >gp:[GI:g295162] [LN:STAMECRA] [AC:L14017] [OR:*Staphylococcus aureus*] [SR:*Staphylococcus aureus* (strain COL) DNA] [DB:genpept-bct1] [DE:*Staphylococcus aureus* methicillin-resistance protein (mecR) gene and unknown ORF, complete cds.] [NT:unknown ORF1; putative] [LE:1492] [RE:2181] [DI:complement]

| ORF Name | NT ID | AA ID | NT LN | AA LN | Score | P-Value |
|---|---|---|---|---|---|---|
| AI7503000982__24650016__c3__1478 | 352 | 4124 | 417 | 138 | 155 | 2.8e−11 |

Description
sp:[LN:YPSB_BACSU] [AC:P50839] [GN:YPSB] [OR:*BACILLUS SUBTILIS*] [DE:HYPOTHETICAL 11.6 KD PROTEIN IN COTD-KDUD INTERGENIC REGION] [SP:P50839] [DB:swissprot] >pir:[LN:E69941] [AC:E69941] [PN:hypothetical protein ypsB] [GN:ypsB] [OR:*Bacillus subtilis*] [DB:pir2] >gp:[GI:g1146182] [LN:BACPONAYPP] [AC:L47838] [GN:ypsB] [FN:hypothetical] [OR:*Bacillus subtilis*] [DB:genpept-bct1] [DE:*Bacillus subtilis* (clone YAC15-6B) ponA gene, yppBCDEFG genes, ypqAE genes, yprAB genes, cotD gene, ypsABC genes, rnaP gene, yptAgene, ypuA gene, kduDI genes, kdgRKAT genes, ypwA gene, complete cds's.] [NT:putative] [LE:12192] [RE:12488] [DI:direct] >gp:[GI:e1183664:g2634637] [LN:BSUB0012] [AC:Z99115:AL009126] [GN:ypsB] [FN:unknown] [OR:*Bacillus subtilis*] [DB:genpept-bct1] [DE:*Bacillus subtilis* complete genome (section 12 of 21):from 2195541 to 2409220.] [SP:P50839] [LE:135481] [RE:135777] [DI:complement]

| ORF Name | NT ID | AA ID | NT LN | AA LN | Score | P-Value |
|---|---|---|---|---|---|---|
| AI7503000982__24650252__f3__731 | 353 | 4125 | 633 | 210 | 970 | 1.2e−97 |

Description
gp:[GI:e1357086:g3955030] [LN:SAU17795] [AC:Y17795] [PN:unknown] [GN:prfA] [OR:*Staphylococcus aureus*] [DB:genpept-bct1] [DE:*Staphylococcus aureus* prfA, pbp2 genes.] [LE:731] [RE:1357] [DI:direct]

| ORF Name | NT ID | AA ID | NT LN | AA LN | Score | P-Value |
|---|---|---|---|---|---|---|
| AI7503000982__24658562__f3__926 | 354 | 4126 | 1287 | 428 | 1475 | 3.7e−151 |

Description
pir:[LN:D69981] [AC:D69981] [PN:conserved hypothetical protein yrvN] [GN:yrvN] [CL:*Haemophilus influenzae* conserved hypothetical protein HI1590] [OR:*Bacillus subtilis*] [DB:pir2] >gp:[GI:e1183983:g2635199] [LN:BSUB0014] [AC:Z99117:AL009126] [GN:yrvN] [FN:unknown] [OR:*Bacillus subtilis*] [DB:genpept-bct1] [DE:*Bacillus subtilis* complete genome (section 14 of 21): from 2599451 to 2812870.] [NT:similar to hypothetical proteins] [LE:212152] [RE:213417] [DI:direct] >gp:[GI:e1184001:g2635217] [LN:BSUB0015] [AC:Z99118:AL009126] [GN:yrvN] [FN:unknown] [OR:*Bacillus subtilis*] [DB:genpept-bct1] [DE:*Bacillus subtilis* complete genome (section 15 of 21): from 2795131 to 3013540.] [NT:similar to hypothetical proteins] [LE:16472] [RE:17737] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000982__24797827__c3__1514 | 355 | 4127 | 1857 | 618 | 1242 | 1.8e−126 |

Description
sp:[LN:ODO1_BACSU] [AC:P23129] [GN:ODHA:CITK] [OR:*BACILLUS SUBTILIS*]
[EC:1.2.4.2] [DE:KETOGLUTARATE DEHYDROGENASE)] [SP:P23129] [DB:swissprot]
>pir:[LN:A32879] [AC:S25295:A32879:E69668:S14544] [PN:oxoglutarate
dehydrogenase (lipoamide),] [GN:odhA] [CL:oxoglutarate dehydrogenase
(lipoamide):thiamine pyrophosphate-binding domain homology] [OR:*Bacillus
subtilis*] [EC:1.2.4.2] [DB:pir2] >gp:[GI:g40003] [LN:BSODHA]
[AC:X54805:S43328] [PN:oxoglutarate dehydrogenase (NADP+)] [GN:odhA]
[OR:*Bacillus subtilis*] [DB:genpept-bct1] [DE:*B. subtilis* odhA gene for
2-oxoglutarate dehydrogenase.] [SP:P23129] [LE:291] [RE:3104] [DI:direct]
>gp:[GI:e1185409:g2634330] [LN:BSUB0011] [AC:Z99114:AL009126]
[PN:2-oxoglutarate dehydrogenase (E1 subunit)] [GN:odhA] [OR:*Bacillus
subtilis*] [DB:genpept-bct1] [EC:1.2.4.2] [DE:*Bacillus subtilis* complete
genome (section 11 of 21):from 2000171 to 2207900.] NT:alternate gene name:
citK] [SP:P23129] [LE:107873] [RE:110686] [DI:complement]

| ORF Name | NT ID | AA ID | NT LN | AA LN | Score | P-Value |
|---|---|---|---|---|---|---|
| AI7503000982__24800461__c1__1138 | 356 | 4128 | 231 | 76 | 235 | 1.7e−18 |

Description
sp:[LN:ODO1_BACSU] [AC:P23129] [GN:ODHA:CITK] [OR:*BACILLUS SUBTILIS*]
[EC:1.2.4.2] [DE:KETOGLUTARATE DEHYDROGENASE)] [SP:P23129] [DB:swissprot]
>pir:[LN:A32879] [AC:S25295:A32879:E69668:S14544] [PN:oxoglutarate
dehydrogenase (lipoamide),] [GN:odhA] [CL:oxoglutarate dehydrogenase
(lipoamide):thiamine pyrophosphate-binding domain homology] [OR:*Bacillus
subtilis*] [EC:1.2.4.2] [DB:pir2] >gp:[GI:g40003] [LN:BSODHA]
[AC:X54805:S43328] [PN:oxoglutarate dehydrogenase (NADP+)] [GN:odhA]
[OR:*Bacillus subtilis*] [DB:genpept-bct1] [DE:*B. subtilis* odhA gene for
2-oxoglutarate dehydrogenase.] [SP:P23129] [LE:291] [RE:3104] [DI:direct]
>gp:[GI:e1185409:g2634330] [LN:BSUB0011] [AC:Z99114:AL009126]
[PN:2-oxoglutarate dehydrogenase (E1 subunit)] [GN:odhA] [OR:*Bacillus
subtilis*] [DB:genpept-bct1] [EC:1.2.4.2] [DE:*Bacillus subtilis* complete
genome (section 11 of 21):from 2000171 to 2207900.] [NT:alternate gene name:
citK] [SP:P23129] [LE:107873] [RE:110686] [DI:complement]

| ORF Name | NT ID | AA ID | NT LN | AA LN | Score | P-Value |
|---|---|---|---|---|---|---|
| AI7503000982__24807790__c1__1048 | 357 | 4129 | 909 | 302 | 687 | 1.2e−67 |

Description
Sp:[LN:ISPA_BACST] [AC:Q08291] [OR:*BACILLUS STEAROTHERMOPHILUS*]
[EC:2.5.1.10] [DE:(FPP SYNTHASE)] [SP:Q08291] [DB:swissprot]
>pir:[LN:JX0257] [AC:JX0257]
[PN:geranyltranstransferase,:farnesyl-diphosphate synthase]
[CL:geranyltranstransferase] [OR:*Bacillus stearothermophilus*] [EC:2.5.1.10]
[DB:pir2] >gp:[GI:d1003054:g391610] [LN:BACFDPS] [AC:D13293] [PN:farnesyl
diphosphate synthase] [OR:*Bacillus stearothermophilus*] [SR:*Bacillus
stearothermophilus* (strain:ATCC10149) DNA] [DB:genpept-bct1] [EC:2.5.1.10]
[DE:*B. stearothermophilus* DNA for farnesyl diphosphate synthase, complete
cds.] [LE:85] [RE:978] [DI:direct]

| ORF Name | NT ID | AA ID | NT LN | AA LN | Score | P-Value |
|---|---|---|---|---|---|---|
| AI7503000982__24823311__c3__1404 | 358 | 4130 | 210 | 69 | 76 | 0.0065 |

Description
pir:[LN:B21124] [AC:B21124] [PN:Bkm-like sex-determining region
hypothetical protein CS314] [GN:Bkm] [OR:*Drosophila melanogaster*] [DB:pir2]

| ORF Name | NT ID | AA ID | NT LN | AA LN | Score | P-Value |
|---|---|---|---|---|---|---|
| AI7503000982__24886562__f3__771 | 359 | 4131 | 123 | 40 | | |

Description
NO-HIT

| ORF Name | NT ID | AA ID | NT LN | AA LN | Score | P-Value |
|---|---|---|---|---|---|---|
| AI7503000982__24886587__c2__1175 | 360 | 4132 | 2448 | 815 | 1981 | 2.3e−207 |

Description
pir:[LN:A69979] [AC:A69979] [PN:conjugation transfer protein homolog yrrC]
[GN:yrrC] [OR:*Bacillus subtilis*] [DB:pir2] >gp:[GI:e1183977:g2635193]
[LN:BSUB0014] [AC:Z99117:AL009126] [GN:yrrC] [FN:unknown] [OR:*Bacillus
subtilis*] [DB:genpept-bct1] [DE:*Bacillus subtilis* complete genome (section
14 of 21):from 2599451 to 2812870.] [NT:similar to conjugation transfer -continued protein] [LE:206106] [RE:208502] [DI:complement] >gp:[GI:e1183995:g2635211] [LN:BSUB0015] [AC:Z99118:AL009126] [GN:yrrC] [FN:unknown] [OR:*Bacillus subtilis*] [DB:genpept-bct1] [DE:*Bacillus subtilis* complete genome (section 15 of 21):from 2795131 to 3013540.] [NT:similar to conjugation transfer protein] [LE:10426] [RE:12822] [DI:complement]

| ORF Name | NT ID | AA ID | NT LN | AA LN | Score | P-Value |
|---|---|---|---|---|---|---|
| AI7503000982__2542188__c1__1026 | 361 | 4133 | 270 | 89 | | |

Description
NO-HIT

| ORF Name | NT ID | AA ID | NT LN | AA LN | Score | P-Value |
|---|---|---|---|---|---|---|
| AI7503000982__25423425__f2__337 | 362 | 4134 | 210 | 69 | | |

Description
NO-HIT

| ORF Name | NT ID | AA ID | NT LN | AA LN | Score | P-Value |
|---|---|---|---|---|---|---|
| AI7503000982__25428378__f2__336 | 363 | 4135 | 228 | 75 | | |

Description
NO-HIT

| ORF Name | NT ID | AA ID | NT LN | AA LN | Score | P-Value |
|---|---|---|---|---|---|---|
| AI7503000982__25502217__c2__1157 | 364 | 4136 | 615 | 204 | 410 | 2.7e−38 |

Description
sp:[LN:RUVA__BACSU] [AC:O05392] [GN:RUVA] [OR:*BACILLUS SUBTILIS*] [DE:PROBABLE HOLLIDAY JUNCTION DNA HELICASE RUVA] [SP:O05392] [DB:swissprot]
>pir:[LN:E69702] [AC:E69702] [PN:Holliday junction DNA helicase ruvA] [GN:ruvA] [CL:holliday junction DNA helicase ruvA] [OR:*Bacillus subtilis*] [DB:pir2] >gp:[GI:e1184023:g2635239] [LN:BSUB0015] [AC:Z99118:AL009126] [PN:Holliday junction DNA helicase] [GN:ruvA] [OR:*Bacillus subtilis*] [DB:genpept-bct1] [DE:*Bacillus subtilis* complete genome (section 15 of 21): from 2795131 to 3013540.] [SP:O05392] [LE:40296] [RE:40901] [DI:complement]

| ORF Name | NT ID | AA ID | NT LN | AA LN | Score | P-Value |
|---|---|---|---|---|---|---|
| AI7503000982__25595186__c2__1177 | 365 | 4137 | 651 | 216 | 736 | 7.6e−73 |

Description
pir:[LN:G69728] [AC:G69728] [PN:uridine kinase udk] [GN:udk] [CL:uridine kinase] [OR:*Bacillus subtilis*] [DB:pir2] >gp:[GI:e1183963:g2635179] [LN:BSUB0014] [AC:Z99117:AL009126] [PN:uridine kinase] [GN:udk] [FN:pyrimidine salvage] [OR:*Bacillus subtilis*] [DB:genpept-bct1] [EC:2.7.1.48] [DE:*Bacillus subtilis* complete genome (section 14 of 21):from 2599451 to 2812870.] [LE:192038] [RE:192673] [DI:complement]

| ORF Name | NT ID | AA ID | NT LN | AA LN | Score | P-Value |
|---|---|---|---|---|---|---|
| AI7503000982__25598818__c3__1420 | 366 | 4138 | 1692 | 563 | 1195 | 1.7e−121 |

Description
sp:[LN:RECN__BACSU] [AC:P17894:P19671] [GN:RECN] [OR:*BACILLUS SUBTILIS*] [DE:DNA REPAIR PROTEIN RECN (RECOMBINATION PROTEIN N)] [SP:P17894:P19671] [DB:swissprot] >pir:[LN:B35128] [AC:B35128:PS0054:H69690] [PN:DNA repair and genetic recombination protein recN] [GN:recN] [CL:recN protein] [OR:*Bacillus subtilis*] [DB:pir2] >gp:[GI:d1013258:g1303923] [LN:BACJH642] [AC:D84432:D82370] [PN:RecN] [OR:*Bacillus subtilis*] [SR:*Bacillus subtilis* (strain:JH642(trpC2 PheA1)) DNA] [DB:genpept-bct1] [DE:*Bacillus subtilis* DNA, 283 Kb region containing skin element.] [LE:197319] [RE:199049] [DI:direct] >gp:[GI:g143402] [LN:BACRECN] [AC:M30297] [OR:*Bacillus subtilis*] [SR:*B. subtilis* (strain 168) DNA] [DB:genpept-bct1] [DE:*B. subtilis* recombination and sporulation protein (recN, spoIVB)genes, complete cds, arginine hydroxamate resistance (ahrC) gene, 3' end.] [NT:recombination protein (ttg start codon)] [LE:131] [RE:1861] [DI:direct]
>gp:[GI:e1185692:g2634858] [LN:BSUB0013] [AC:Z99116:AL009126] [GN:recN] [FN:DNA repair and genetic recombination] [OR:*Bacillus subtilis*] [DB:genpept-bct1] [DE:*Bacillus subtilis* complete genome (section 13 of 21): from 2395261 to 2613730.] [SP:P17894] [LE:124572] [RE:126302] [DI:complement]

| ORF Name | NT ID | AA ID | NT LN | AA LN | Score | P-Value |
|---|---|---|---|---|---|---|

-continued

| | | | | | |
|---|---|---|---|---|---|
| AI7503000982__25652217__c3__1470 | 367 | 4139 | 348 | 115 | |

Description
NO-HIT

| ORF Name | NT ID | AA ID | NT LN | AA LN | Score | P-Value |
|---|---|---|---|---|---|---|
| AI7503000982__25672337__c1__1016 | 368 | 4140 | 780 | 259 | 371 | 3.6e−34 |

Description
sp:[LN:YQXN_BACSU] [AC:P42095] [GN:YQXN:YQFI] [OR:*BACILLUS SUBTILIS*]
[DE:(ORF3)] [SP:P42095] [DB:swissprot] >pir:[LN:H69968] [AC:H69968]
[PN:conserved hypothetical protein yqxN] [GN:yqxN] [OR:*Bacillus subtilis*]
[DB:pir2] >gp:[GI:d1013162:g1303827] [LN:BACJH642] [AC:D84432:D82370]
[PN:YqfI] [OR:*Bacillus subtilis*] [SR:*Bacillus subtilis* (strain:JH642(trpC2
PheA1)) DNA] [DB:genpept-bct1] [DE:*Bacillus subtilis* DNA, 283 Kb region
containing skin element.] [LE:109891] [RE:110658] [DI:direct]
>gp:[GI:e1185794:g2634960] [LN:BSUB0013] [AC:Z99116:AL009126] [GN:yqxN]
[FN:unknown] [OR:*Bacillus subtilis*] [DB:genpept-bct1] [DE:*Bacillus subtilis*
complete genome (section 13 of 21):from 2395261 to 2613730.] [NT:alternate
gene name:yqfI; similar to hypothetical] [SP:P42095] [LE:212962]
[RE:213729] [DI:complement] >gp:[GI:e1183758:g2634974] [LN:BSUB0014]
[AC:Z99117:AL009126] [GN:yqxN] [FN:unknown] [OR:*Bacillus subtilis*]
[DB:genpept-bct1] [DE:*Bacillus subtilis* complete genome (section 14 of 21):
from 2599451 to 2812870.] [NT:alternate gene name:yqfI; similar to
hypothetical] [SP:P42095] [LE:8772] [RE:9539] [DI:complement]

| ORF Name | NT ID | AA ID | NT LN | AA LN | Score | P-Value |
|---|---|---|---|---|---|---|
| AI7503000982__25680218__c2__1201 | 369 | 4141 | 726 | 241 | 425 | 6.8e−40 |

Description
sp:[LN:YQEZ_BACSU] [AC:P54465] [GN:YQEZ] [OR:*BACILLUS SUBTILIS*]
[DE:HYPOTHETICAL 46.5 KD PROTEIN IN RPSU-PHOH INTEREGENIC REGION]
[SP:P54465] [DB:swissprot] >pir:[LN:H69952] [AC:H69952 ] [PN:hypothetical
protein yqeZ] [GN:yqeZ] [OR:*Bacillus subtilis*] [DB:pir2]
>gp:[GI:d1013151:g1303816] [LN:BACJH642] [AC:D84432:D82370] [PN:YqeZ]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:99826] [RE:101139] [DI:direct] >gp:[GI:e1183769:g2634985]
[LN:BSUB0014] [AC:Z99117:AL009126] [GN:yqeZ] [FN:unknown] [OR:*Bacillus
subtilis*] [DB:genpept-bct1] [DE:*Bacillus subtilis* complete genome (section
14 of 21):from 2599451 to 2812870.] [SP:P54465] [LE:18291] [RE:19604]
[DI:complement]

| ORF Name | NT ID | AA ID | NT LN | AA LN | Score | P-Value |
|---|---|---|---|---|---|---|
| AI7503000982__26058467__c1__1064 | 370 | 4142 | 213 | 70 | 119 | 9.1e−07 |

Description
gp:[GI:g861340] [LN:CELE04F6] [AC:U28943] [GN:E04F6.7] [OR:*Caenorhabditis
elegans*] [SR:*Caenorhabditis elegans* strain=Bristol N2] [DB:genpept-inv1]
[DE:*Caenorhabditis elegans* cosmid E04F6.] [NT:similar to ribitol
dehydrogenase] [LE:20096:20706:20893] [RE:20659:20814:21152]
[DI:complementJoin]

| ORF Name | NT ID | AA ID | NT LN | AA LN | Score | P-Value |
|---|---|---|---|---|---|---|
| AI7503000982__26203942__c3__1388 | 371 | 4143 | 630 | 209 | 636 | 3.0e−62 |

Description
pir:[LN:A69969] [AC:A69969] [PN:conserved hypothetical protein yqzB]
[GN:yqzB] [OR:*Bacillus subtilis*] [DB:pir2] >gp:[GI:e1185791:g2634957]
[LN:BSUB0013] [AC:Z99116:AL009126] [GN:yqzB] [FN:unknown] [OR:*Bacillus
subtilis*] [DB:genpept-bct1] [DE:*Bacillus subtilis* complete genome (section
13 of 21):from 2395261 to 2613730.] [NT:similar to hypothetical proteins]
[LE:208975] [RE:209613] [DI:complement] >gp:[GI:e1183755:g2634971]
[LN:BSUB0014] [AC:Z99117:AL009126] [GN:yqzB] [FN:unknown] [OR:*Bacillus
subtilis*] [DB:genpept-bct1] [DE:*Bacillus subtilis* complete genome (section
14 of 21):from 2599451 to 2812870.] [NT:similar to hypothetical proteins]
[LE:4785] [RE:5423] [DI:complement]

| ORF Name | NT ID | AA ID | NT LN | AA LN | Score | P-Value |
|---|---|---|---|---|---|---|
| AI7503000982__26209425__c1__1022 | 372 | 4144 | 1068 | 355 | 1672 | 4.9e−172 |

-continued

Description
sp:[LN:RPSD_STAAU] [AC:P26766] [GN:RPOD:PLAC] [OR:*STAPHYLOCOCCUS AUREUS*]
[DE:RNA POLYMERASE SIGMA FACTOR RPOD] [SP:P26766] [DB:swissprot]
>pir:[LN:S34442] [AC:S34442] [PN:transcription initiation factor sigma
plaC] [GN:plaC] [CL:transcription initiation factor sigma 43:transcription
initiation factor sigma katF homology:transcription initiation factor sigma
region 1 homology] [OR:*Staphylococcus aureus*] [DB:pir2] >gp:[GI:g153069]
[LN:STAPLAC] [AC:M63177] [PN:sigma factor] [GN:plaC] [OR:*Staphylococcus
aureus*] [SR:*Staphylococcus aureus* (strain SA20) DNA] [DB:genpept-bct1]
[DE:*S. aureus* sigma factor (plaC) gene, complete cds.] [LE:820] [RE:1926]
[DI:direct]

| ORF Name | NT ID | AA ID | NT LN | AA LN | Score | P-Value |
|---|---|---|---|---|---|---|
| AI7503000982__26212501__c3__1394 | 373 | 4145 | 852 | 283 | 797 | 2.6e−79 |

Description
gp:[GI:g5019735] [LN:AF104349] [AC:AF104349] [PN:hydrophobic membrane
protein ZurM] [GN:zurM] [OR:*Listeria monocytogenes*] [DB:genpept-bct2]
[DE:*Listeria monocytogenes* zinc-like uptake operon, complete sequence.]
[LE:860] [RE:1747] [DI:direct]

| ORF Name | NT ID | AA ID | NT LN | AA LN | Score | P-Value |
|---|---|---|---|---|---|---|
| AI7503000982__26225463__c1__1070 | 374 | 4146 | 741 | 246 | 821 | 7.4e−82 |

Description
sp:[LN:RESD_BACSU] [AC:P35163] [GN:RESD] [OR:*BACILLUS SUBTILIS*]
[DE:TRANSCRIPTIONAL REGULATORY PROTEIN RESD] [SP:P35163] [DB:swissprot]
>pir:[LN:G69691] [AC:G69691:S45559] [PN:two-component response regulator
involved in aerobic and anaer resD] [GN:resD] [CL:ompR protein:response
regulator homology] [OR:*Bacillus subtilis*] [DB:pir2] >gp:[GI:g410141]
[LN:BACDIA] [AC:L09228] [OR:*Bacillus subtilis*] [SR:*Bacillus subtilis* (strain
168, sub_species Marburg) DNA] [DB:genpept-bct1] [DE:*Bacillus subtilis* spoVA
to serA region.] [NT:ORFX17] [LE:21706] [RE:22428] [DI:direct]
>gp:[GI:e1185581:g2634747] [LN:BSUB0013] [AC:Z99116:AL009126]
[PN:two-component response regulator] [GN:resD] [FN:activation role in
global regulation of aerobic] [OR:*Bacillus subtilis*] [DB:genpept-bct1]
[DE:*Bacillus subtilis* complete genome (section 13 of 21):from 2395261 to
2613730.] [NT:alternate gene name:ypxD] [SP:P35163] [LE:21155] [RE:21877]
[DI:complement]

| ORF Name | NT ID | AA ID | NT LN | AA LN | Score | P-Value |
|---|---|---|---|---|---|---|
| AI7503000982__26251577__c1__994 | 375 | 4147 | 354 | 117 | 372 | 2.8e−34 |

Description
sp:[LN:YQEL_BACSU] [AC:P54457] [GN:YQEL] [OR:*BACILLUS SUBTILIS*]
[DE:HYPOTHETICAL 13.3 KD PROTEIN IN AROD-COMER INTERGENIC REGION]
[SP:P54457] [DB:swissprot] >pir:[LN:H69951] [AC:H69951] [PN:ybeB protein
homolog yqeL] [GN:yqeL] [CL:*Escherichia coli* ybeB protein] [OR:*Bacillus
subtilis*] [DB:pir2] >gp:[GI:d1013128:g1303793] [LN:BACJH642]
[AC:D84432:D82370] [PN:YqeL] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:76417] [RE:76773]
[DI:direct] >gp:[GI:e1183792:g2635008] [LN:BSUB0014] [AC:Z99117:AL009126]
[GN:yqeL] [FN:unknown] [OR:*Bacillus subtilis*] [DB:genpept-bct1] [DE:*Bacillus
subtilis* complete genome (section 14 of 21):from 2599451 to 2812870.]
[NT:similar to hypothetical proteins] [SP:P54457] [LE:42657] [RE:43013]
[DI:complement]

| ORF Name | NT ID | AA ID | NT LN | AA LN | Score | P-Value |
|---|---|---|---|---|---|---|
| AI7503000982__26259657__c1__1051 | 376 | 4148 | 1425 | 474 | 1155 | 3.0e−117 |

Description
sp:[LN:DLD2_BACSU] [AC:P54533] [GN:BFMBC] [OR:*BACILLUS SUBTILIS*]
[EC:1.8.1.4] [DE:DEHYDROGENASE) (LPD-VAL)] [SP:P54533] [DB:swissprot]

| ORF Name | NT ID | AA ID | NT LN | AA LN | Score | P-Value |
|---|---|---|---|---|---|---|
| AI7503000982__26306713__c2__1332 | 377 | 4149 | 912 | 303 | 580 | 2.6e−56 |

Description
pir:[LN:S72642] [AC:S72642] [PN:probable ABC-type transport protein xynB]
[GN:xynB] [OR:*Thermoanaerobacterium thermosulfurigenes*] [DB:pir2]
>gp:[GI:g1255237] [LN:TTU50952] [AC:U50952] [PN:XynB] [GN:xynB]
[OR:*Thermoanaerobacterium thermosulfurigenes*] [DB:genpept-bct1]
[DE:*Thermoanaerobacterium thermosulfurigenes* endoxylanase precursor (XynA)

-continued and membrane component of an ABC transporter (XynB) genes, complete cds and
XynC (xynC) gene, partial cds.] [NT:Description:membrane component of an
ABC] [LE:454] [RE:1359] [DI:direct]

| ORF Name | NT ID | AA ID | NT LN | AA LN | Score | P-Value |
|---|---|---|---|---|---|---|
| AI7503000982__26368950_c2__1264 | 378 | 4150 | 1380 | 459 | 744 | 4.7e−76 |

Description
sp:[LN:RECQ_BACSU] [AC:P50729] [GN:RECQ] [OR:*BACILLUS SUBTILIS*] [EC:3.6.1.-]
[DE:ATP-DEPENDENT DNA HELICASE RECQ,] [SP:P50729] [DB:swissprot]
>pir:[LN:A69691] [AC:A69691] [PN:ATP-dependent DNA helicase
homolog:ATP-dependent DNA helicase recQ] [GN:recQ] [CL:DEAD/H box helicase
homology] [OR:*Bacillus subtilis*] [DB:pir2] >gp:[GI:e1183747:g2634720]
[LN:BSUB0012] [AC:Z99115:AL009126] [PN:ATP-dependent DNA helicase] [GN:recQ]
[OR:*Bacillus subtilis*] [DB:genpept-bct1] [EC:3.6.1.-] [DE:*Bacillus subtilis*
complete genome (section 12 of 21):from 2195541 to 2409220.] [SP:P50729]
[LE:210616] [RE:212106] [DI:complement] >gp:[GI:e1185571:g2634737]
[LN:BSUB0013] [AC:Z99116:AL009126] [PN:ATP-dependent DNA helicase] [GN:recQ]
[OR:*Bacillus subtilis*] [DB:genpept-bct1] [EC:3.6.1.-] [DE:*Bacillus subtilis*
complete genome (section 13 of 21):from 2395261 to 2613730.] [SP:P50729]
[LE:10896] [RE:12386] [DI:complement] >gp:[GI:g1146200] [LN:BACSERA]
[AC:L47648] [PN:DNA or RNA helicase, DNA-dependent ATPase] [GN:recS] [FN:DNA
repair and homologous recombination] [OR:*Bacillus subtilis*]
[DB:genpept-bct2] [DE:*Bacillus subtilis* phosphoglycerate dehydrogenase
(serA), ypaA, ferredoxin (fer), ypbB, recS, ypbD, ypbE, ypbF, ypbG,
ypbH, glutamate dehydrogenase (ypcA), ypdA, ypdB, ypdC, spore cortexlytic
enzyme (sleB), ypeB, ypfA, ypfB, cytidine monophosphatekinase (cmk), ypfD,
ypgA, yphA, yphB, yphC, NAD+ dependent glycerol-3-phosphate dehydrogenase
(glyc), yphE and yphF genes, complete cds.] [NT:similar to *Escherichia coli*
recQ gene product;] [LE:4291] [RE:5781] [DI:direct]

| ORF Name | NT ID | AA ID | NT LN | AA LN | Score | P-Value |
|---|---|---|---|---|---|---|
| AI7503000982__26384682_c1__1092 | 379 | 4151 | 1248 | 415 | 561 | 2.6e−54 |

Description
sp:[LN:YPIA_BACSU] [AC:P54389] [GN:YPIA] [OR:*BACILLUS SUBTILIS*]
[DE:HYPOTHETICAL 48.3 KD PROTEIN IN QCRA-AROE INTERGENIC REGION] [SP:P54389]
[DB:swissprot] >pir:[LN:E69936] [AC:E69936] [PN:conserved hypothetical
protein ypiA] [GN:ypiA] [CL:tetratricopeptide repeat homology] [OR:*Bacillus
subtilis*] [DB:pir2] >gp:[GI:g1146224] [LN:BACYPIA] [AC:L47709] [GN:ypiA]
[FN:hypothetical] [OR:*Bacillus subtilis*] [DB:genpept-bct1] [DE:*Bacillus
subtilis* (clone YAC15-6B) ypiABF genes, qcrABC genes, ypjABCDEFGHI genes,
birA gene, panBCD genes, dinG gene, ypmB gene, aspB gene, asnS gene, dnaD
gene, nth gene and ypoC gene, complete cds's.] [NT:putative] [LE:348]
[RE:1619] [DI:direct] >gp:[GI:e1183704:g2634677] [LN:BSUB0012]
[AC:Z99115:AL009126] [GN:ypiA] [FN:unknown] [OR:*Bacillus subtilis*]
[DB:genpept-bct1] [DE:*Bacillus subtilis* complete genome (section 12 of 21):
from 2195541 to 2409220.] [NT:similar to hypothetical proteins] [SP:P54389]
[LE:170048] [RE:171319] [DI:complement]

| ORF Name | NT ID | AA ID | NT LN | AA LN | Score | P-Value |
|---|---|---|---|---|---|---|
| AI7503000982__26597186_c1__1056 | 380 | 4152 | 444 | 147 | 544 | 1.7e−52 |

Description
sp:[LN:YQIW_BACSU] [AC:P54534] [GN:YQIW] [OR:*BACILLUS SUBTILIS*]
[DE:HYPOTHETICAL 16.2 KD PROTEIN IN BMRU-ANSR INTERGENIC REGION] [SP:P54534]
[DB:swissprot] >pir:[LN:E69962] [AC:E69962] [PN:conserved hypothetical
protein yqiW] [GN:yqiW] [OR:*Bacillus subtilis*] [DB:pir2]
>gp:[GI:d1013283:g1303948] [LN:BACJH642] [AC:D84432:D82370] [PN:YqiW]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:226148] [RE:226585] [DI:direct]
>gp:[GI:e1185667:g2634833] [LN:BSUB0013] [AC:Z99116:AL009126] [GN:yqiW]
[FN:unknown] [OR:*Bacillus subtilis*] [DB:genpept-bct1] [DE:*Bacillus subtilis*
complete genome (section 13 of 21):from 2395261 to 2613730.] [NT:similar to
hypothetical proteins from *B. subtilis*] [LE:97034] [RE:97471]
[DI:complement]

| ORF Name | NT ID | AA ID | NT LN | AA LN | Score | P-Value |
|---|---|---|---|---|---|---|
| AI7503000982__26600137_f2__493 | 381 | 4153 | 531 | 176 | 188 | 8.9e−15 |

Description
sp:[LN:YPUF_BACSU] [AC:P17617] [GN:YPUF] [OR:*BACILLUS SUBTILIS*]
[DE:HYPOTHETICAL 21.0 KD PROTEIN IN RIBT-DACB INTERGENIC REGION (ORFX6)]
[SP:P17617] [DB:swissprot] >pir:[LN:S45548] [AC:S45548:E69942]

-continued

[PN:hypothetical protein ypuF] [GN:ypuF] [OR:*Bacillus subtilis*] [DB:pir2]
>gp:[GI:g410130] [LN:BACDIA] [AC:L09228] [OR:*Bacillus subtilis*] [SR:*Bacillus subtilis* (strain 168, sub_species Marburg) DNA] [DB:genpept-bct1]
[DE*Bacillus subtilis* spoVA to serA regions.] [NT:ORFX6] [LE:12218]
[RE:12742] [DI:complement] >gp:[GI:g580916] [LN:BSRIB] [AC:X51510]
[OR:*Bacillus subtilis*] [DB:genpept-bct1] [DE:*B. subtilis* riboflavin biosynthesis operon ribG, ribB, ribA, ribH, and ribT genes.] [NT:ORF Y (AA 1–174)] [SP:P17617] [LE:5164] [RE:5688] [DI:complement]
>gp:[GI:e1185592:g2634758] [LN:BSUB0013] [AC:Z99116:AL009126] [GN:ypuF]
[FN:unknown] [OR:*Bacillus subtilis*] [DB:genpept-bct1] [DE:*Bacillus subtilis* complete genome (section 13 of 21):from 2395261 to 2613730.] [SP:P17617]
[LE:30841] [RE:31365] [DI:direct]

| ORF Name | NT ID | AA ID | NT LN | AA LN | Score | P-Value |
| --- | --- | --- | --- | --- | --- | --- |
| AI7503000982_26752312_c3_1396 | 382 | 4154 | 171 | 56 | 229 | 4.0e−19 |

Description
sp:[LN:RL33_BACST] [AC:P23375] [GN:RPMG] [OR:*BACILLUS STEAROTHERMOPHILUS*]
[DE:50S RIBOSOMAL PROTEIN L33] [SP:P23375] [DB:swissprot] >pir:[LN:B48396]
[AC:B48396] [PN:ribosomal protein L33] [CL:*Escherichia coli* ribosomal protein L33] [OR:*Bacillus stearothermophilus*] [DB:pir2]

| ORF Name | NT ID | AA ID | NT LN | AA LN | Score | P-Value |
| --- | --- | --- | --- | --- | --- | --- |
| AI7503000982_26754662_c3_1454 | 383 | 4155 | 672 | 223 | 514 | 2.5e−49 |

Description
sp:[LN:KCY_BACSU] [AC:P38493] [GN:CMK:JOFC] [OR:*BACILLUS SUBTILIS*]
[EC:2.7.4.14] [DE:(CMP KINASE)] [SP:P38493] [DB:swissprot] >pir:[LN:F69601]
[AC:F69601] [PN:cytidylate kinase cmk] [GN:cmk] [CL:cytidylate kinase cmk]
[OR:*Bacillus subtilis*] [DB:pir2] >gp:[GI:g533105] [LN:BSU11687] [AC:U11687]
[PN:unknown] [GN:jofC] [OR:*Bacillus subtilis*] [DB:genpept-bct1] [DE:*Bacillus subtilis* 168 jofA, jofB, MssA homolog (jofC) and ribosomal protein S1 homolog (jofD) genes, complete cds, and joeB gene, partial cds.] [NT:similar to the *Escherichia coli* mssA gene product] [LE:1744] [RE:2418] [DI:direct]
>gp:[GI:e1183734:g2634707] [LN:BSUB0012] [AC:Z99115:AL009126] [PN:cytidylate kinase] [GN:cmk] [OR:*Bacillus subtilis*] [DB:genpept-bct1] [EC:2.7.4.14]
[DE:*Bacillus subtilis* complete genome (section 12 of 21):from 2195541 to 2409220.] [NT:alternate gene name:jofC, ypfC] [SP:P38493] [LE:199742]
[RE:200416] [DI:complement] >gp:[GI:e1185558:g2634724] [LN:BSUB0013]
[AC:Z99116:AL009126] [PN:cytidylate kinase] [GN:cmk] [OR:*Bacillus subtilis*]
[DB:genpept-bct1] [EC:2.7.4.14] [DE:*Bacillus subtilis* complete genome (section 13 of 21):from 2395261 to 2613730.] [NT:alternate gene name:jofC, ypfC] [SP:P38493] [LE:22] [RE:696] [DI:complement] >gp:[GI:g1146214]
[LN:BACSERA] [AC:L47648] [PN:cytidine monophosphate kinase] [GN:cmk]
[FN:cytidine diphosphate biosynthesis] [OR:*Bacillus subtilis*]
[DB:genpept-bct2] [DE:*Bacillus subtilis* phosphoglycerate dehydrogenase (serA), ypaA, ferredoxin (fer), ypbB, recS, ypbD, ypbE, ypbF, ypbG, ypbH, glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependent glycerol-3-phosphate dehydrogenase (glyc), yphE and yphF genes complete cds.] [NT:similar to *Escherichia coli* smba supress; putative] [LE:15981] [RE:16655] [DI:direct]

| ORF Name | NT ID | AA ID | NT LN | AA LN | Score | P-Value |
| --- | --- | --- | --- | --- | --- | --- |
| AI7503000982_26754750_c2_1172 | 384 | 4156 | 1164 | 387 | 895 | 1.1e−89 |

Description
pir:[LN:E69981] [AC:E69981] [PN:NifS protein homolog homolog yrvO] [GN:yrvO]
[CL:nitrogen fixation protein nifS] [OR:*Bacillus subtilis*] [DB:pir2]
>gp:[GI:e1183981:g2635197] [LN:BSUB0014] [AC:Z99117:AL009126] [GN:yrvO]
[FN:unknown] [OR:*Bacillus subtilis*] [DB:genpept-bct1] [DE:*Bacillus subtilis* complete genome (section 14 of 21):from 2599451 to 2812870.] [NT:similar to NifS protein homolog] [LE:210475] [RE:211515] [DI:complement]
>gp:[GI:e1183999:g2635215] [LN:BSUB0015] [AC:Z99118:AL009126] [GN:yrvO]
[FN:unknown] [OR:*Bacillus subtilis*] [DB:genpept-bct1] [DE:*Bacillus subtilis* complete genome (section 15 of 21):from 2795131 to 3013540.] [NT:similar to NifS protein homolog] [LE:14795] [RE:15835] [DI:complement]

| ORF Name | NT ID | AA ID | NT LN | AA LN | Score | P-Value |
| --- | --- | --- | --- | --- | --- | --- |
| AI7503000982_26772135_c1_1000 | 385 | 4157 | 996 | 331 | 555 | 1.1e−53 |

Description
sp:[LN:YQEN_BACSU] [AC:P54459] [GN:YQEN] [OR:*BACILLUS SUBTILIS*]
[DE:HYPOTHETICAL 40.5 KD PROTEIN IN COMEC-RPST INTERGENIC REGION]
[SP:P54459] [DB:swissprot] >pir:[LN:B69952] [AC:B69952] [PN:conserved -continued hypothetical protein yqeN] [GN:yqeN] [OR:*Bacillus subtilis*] [DB:pir2]
>gp:[GI:d1013134:g1303799] [LN:BACJH642] [AC:D84432:D82370] [PN:YqeN]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:82475] [RE:83518] [DI:direct] >gp:[GI:e1183786:g2635002]
[LN:BSUB0014] [AC:Z99117:AL009126] [GN:yqeN] [FN:unknown] [OR:*Bacillus
subtilis*] [DB:genpept-bct1] [DE:*Bacillus subtilis* complete genome (section
14 of 21):from 2599451 to 2812870.] [NT:similar to hypothetical proteins]
[SP:P54459] [LE:35912] [RE:36955] [DI:complement]

| ORF Name | NT ID | AA ID | NT LN | AA LN | Score | P-Value |
|---|---|---|---|---|---|---|
| AI7503000982__26774062__c2__1268 | 386 | 4158 | 1332 | 443 | 1670 | 8.0e−172 |

Description
sp:[LN:YPHC__BACSU] [AC:P50743] [GN:YPHC] [OR:*BACILLUS SUBTILIS*] [DE:REGION]
[SP:P50743] [DB:swissprot] >pir:[LN:A69936] [AC:A69936] [PN:conserved
hypothetical protein yphC] [GN:yphC] [CL:*Mycobacterium leprae* probable
GTP-binding protein:translation elongation factor Tu homology] [OR:*Bacillus
subtilis*] [DB:pir2] >gp:[GI:e1183729:g2634702] [LN:BSUB0012]
[AC:Z99115:AL009126] [GN:yphC] [FN:unknown] [OR:*Bacillus subtilis*]
[DB:genpept-bct1] [DE:*Bacillus subtilis* complete genome (section 12 of 21):
from 2195541 to 2409220.] [NT:similar to hypothetical proteins] [LE:193903]
[RE:195213] [DI:complement] >gp:[GI:g1146219] [LN:BACSERA] [AC:L47648]
[GN:yphC] [OR:*Bacillus subtilis*] [DB:genpept-bct2] [DE:*Bacillus subtilis*
phosphoglycerate dehydrogenase (serA), ypaA, ferredoxin (fer), ypbB, recS,
ypbD, ypbE, ypbF, ypbG, ypbH, glutamate dehydrogenase (ypcA), ypdA, ypdB,
ypdC, spore cortexlytic enzyme (sleB), ypeB, ypfA, ypfB, cytidine
monophosphatekinase (cmk), ypfD, ypgA, yphA, yphB, yphC, NAD+
dependent glycerol-3-phosphate dehydrogenase (glyc), yphE and yphF
genes, complete cds.] [NT:similar to *Escherichia coli* GTP-binding protein]
[LE:21184] [RE:22494] [DI:direct]

| ORF Name | NT ID | AA ID | NT LN | AA LN | Score | P-Value |
|---|---|---|---|---|---|---|
| AI7503000982__2756288__c2__1257 | 387 | 4159 | 183 | 60 | | |

Description
NO-HIT

| ORF Name | NT ID | AA ID | NT LN | AA LN | Score | P-Value |
|---|---|---|---|---|---|---|
| AI7503000983__10000128__f2__399 | 388 | 4160 | 159 | 52 | | |

Description
NO-HIT

| ORF Name | NT ID | AA ID | NT LN | AA LN | Score | P-Value |
|---|---|---|---|---|---|---|
| AI7503000983__10195942__c3__1056 | 389 | 4161 | 636 | 211 | 253 | 1.2e−21 |

Description
sp:[LN:TRPF__THEMA] [AC:Q56320] [GN:TRPF] [OR:*THERMOTOGA MARITIMA*]
[EC:5.3.1.24] [DE:N-(5'-PHOSPHORIBOSYL)ANTHRANILATE ISOMERASE, (PRAI)]
[SP:Q56320] [DB:swissprot] >pir:[LN:S59048] [AC:S59048] [PN:phosphoribosyl
anthranilate isomerase trpF] [GN:trpF] [CL:phosphoribosylanthranilate
isomerase:trpF homology] [OR:*Thermotoga maritima*] [DB:pir2]
>gp:[GI:g1054860] [LN:TMTRABCDF] [AC:X92729] [PN:phosphoribosyl anthranilate
isomerase] [GN:trpF] [OR:*Thermotoga maritima*] [DB:genpept-bct1]
[DE:*T. maritima* trpD, trpC, trpF, trpB, and trpA genes.] [SP:Q56320]
[LE:1012] [RE:1629] [DI:direct] >gp:[GI:g4980631] [LN:AE001699]
[AC:AE001699:AE000512] [PN:phosphoribosylanthranilate isomerase] [GN:TM0139]
[OR:*Thermotoga maritima*] [DB:genpept-bct2] [DE:*Thermotoga maritima* section
11 of 136 of the complete genome.] [NT:similar to PID:1054860 SP:Q56320
GB:AE000512] [LE:7969] [RE:8586] [DI:complement]

| ORF Name | NT ID | AA ID | NT LN | AA LN | Score | P-Value |
|---|---|---|---|---|---|---|
| AI7503000983__10553766__f2__397 | 390 | 4162 | 195 | 64 | | |

Description
NO-HIT

| ORF Name | NT ID | AA ID | NT LN | AA LN | Score | P-Value |
|---|---|---|---|---|---|---|
| AI7503000983__1058463__c3__978 | 391 | 4163 | 2121 | 706 | 2472 | 8.3e−257 |

Description
pir:[LN:S70691] [AC:S70691:C69680] [PN:polyribonucleotide

-continued nucleotidyltransferase, alpha chain pnpA:polynucleotide phosphorylase pnpA]
[GN:pnpA] [CL:polyribonucleotide nucleotidyltransferase alpha chain]
[OR:*Bacillus subtilis*] [EC:2.7.7.8] [DB:pir2] >gp:[GI:e1185260:g2634041]
[LN:BSUB0009] [AC:Z99112:AL009126] [PN:polynucleotide phosphorylase
(PNPase)] [GN:pnpA] [FN:necessary for competence development] [OR:*Bacillus
subtilis*] [DB:genpept-bct1] [EC:2.7.7.8] [DE:*Bacillus subtilis* complete
genome (section 9 of 21):from 1598421 to 1807200.] [NT:alternate gene name:
comR] [SP:P50849] [LE:140354] [RE:142471] [DI:direct] >gp:[GI:g1184680]
[LN:BSU29668] [AC:U29668] [PN:polynucleotide phosphorylase] [GN:pnpA]
[OR:*Bacillus subtilis*] [DB:genpept-bct2] [DE:*Bacillus subtilis* ribosomal
protein RpsO (rpsO) gene, partial cds, and polynucleotide phosphorylase
(pnpA) gene, complete cds.] [LE:224] [RE:2341] [DI:direct]

| ORF Name | NT ID | AA ID | NT LN | AA LN | Score | P-Value |
| --- | --- | --- | --- | --- | --- | --- |
| AI7503000983_10657925_c3_1017 | 392 | 4164 | 948 | 315 | 573 | 1.4e−55 |

Description
pir:[LN:H69722] [AC:H69722:B25364] [PN:homoserine kinase,] [GN:thrB]
[CL:homoserine kinase thrB] [OR:*Bacillus subtilis*] [EC:2.7.1.39] [DB:pir2]
>gp:[GI:e1184303:g2635721] [LN:BSUB0017] [AC:Z99120:AL009126] [PN:homoserine
kinase] [GN:thrB] [FN:threonine biosynthesis] [OR:*Bacillus subtilis*]
[DB:genpept-bct1] [EC:2.7.1.39] [DE:*Bacillus subtilis* complete genome
(section 17 of 21):from 3197001 to 3414420.] [NT:alternate gene name:thrA]
[LE:114902] [RE:115831] [DI:complement]

| ORF Name | NT ID | AA ID | NT LN | AA LN | Score | P-Value |
| --- | --- | --- | --- | --- | --- | --- |
| AI7503000983_10667002_f2_278 | 393 | 4165 | 189 | 62 | | |

Description
NO-HIT

| ORF Name | NT ID | AA ID | NT LN | AA LN | Score | P-Value |
| --- | --- | --- | --- | --- | --- | --- |
| AI7503000983_1074090_c1_728 | 394 | 4166 | 906 | 301 | 697 | 1.0e−68 |

Description
sp:[LN:CODV_BACSU] [AC:P39776] [GN:CODV] [OR:*BACILLUS SUBTILIS*] [DE:PROBABLE
INTEGRASE/RECOMBINASE CODV] [SP:P39776] [DB:swissprot] >pir:[LN:G69601]
[AC:G69601:S61493:S72309] [PN:integrase/recombinase codV] [GN:codV]
[CL:probable site-specific integrase/recombinase XerC] [OR:*Bacillus
subtilis*] [DB:pir2] >gp:[GI:g535348] [LN:BSU13634] [AC:U13634] [PN:CodV]
[GN:codV] [OR:*Bacillus subtilis*] [DB:genpept-bct1] [DE:*Bacillus subtilis*
JH642 dipeptide permease operon regulators, codV, codW, codX, and codY genes,
complete cds.] [LE:293] [RE:1207] [DI:direct] >gp:[GI:e1185205:g2633986]
[LN:BSUB0009] [AC:Z99112:AL009126] [PN:integrase/recombinase] [GN:codV]
[OR:*Bacillus subtilis*] [DB:genpept-bct1] [DE:*Bacillus subtilis* complete
genome (section 9 of 21):from 1598421 to 1807200.] [SP:P39776] [LE:88166]
[RE:89080] [DI:direct]

| ORF Name | NT ID | AA ID | NT LN | AA LN | Score | P-Value |
| --- | --- | --- | --- | --- | --- | --- |
| AI7503000983_10975428_f2_340 | 395 | 4167 | 879 | 292 | 80 | 0.013 |

Description
sp:[LN:BICD_DROME] [AC:P16568] [GN:BICD] [OR:*DROSOPHILA MELANOGASTER*]
[SR:, FRUIT FLY] [DE:CYTOSKELETON-LIKE BICAUDAL D PROTEIN] [SP:P16568]
[DB:swissprot] >pir:[LN:A33636] [AC:A33636] [PN:bicaudal protein D]
[GN:BicD] [OR:*Drosophila melanogaster*] [DB:pir2] >gp:[GI:g157006]
[LN:DROBICD] [AC:M31684] [OR:*Drosophila melanogaster*] [SR:*D. melanogaster*
(strain DfTW119) embryo, cDNA to mRNA] [DB:genpept-inv1] [DE:*D. melanogaster*
cytoskeleton-like bicaudalD protein (BicD) mRNA, complete cds.] [NT:bicaudalD
protein] [LE:132] [RE:2480] [DI:direct]

| ORF Name | NT ID | AA ID | NT LN | AA LN | Score | P-Value |
| --- | --- | --- | --- | --- | --- | --- |
| AI7503000983_1179775_f1_70 | 396 | 4168 | 132 | 43 | 42 | 0.029 |

Description
pir:[LN:S78676] [AC:S78676:S78677] [PN:hypothetical protein Q0144]
[OR:mitochondrion *Saccharomyces cerevisiae*] [DB:pir2]
>gp:[GI:e1370708:g4160384] [LN:SCE011856] [AC:AJ011856] [OR:Mitochondrion
*Saccharomyces cerevisiae*] [SR:baker's yeast] [DB:genpept-pln1]
[DE:*Saccharomyces cerevisiae* complete mitochondrial genome.] [NT:ORF Q0144]
[LE:54109] [RE:54438] [DI:direct]

| ORF Name | NT ID | AA ID | NT LN | AA LN | Score | P-Value |
| --- | --- | --- | --- | --- | --- | --- |

-continued

| ORF Name | NT ID | AA ID | NT LN | AA LN | Score | P-Value |
|---|---|---|---|---|---|---|
| AI7503000983_11817625_f1_65 | 397 | 4169 | 129 | 42 | | |

Description
NO-HIT

| ORF Name | NT ID | AA ID | NT LN | AA LN | Score | P-Value |
|---|---|---|---|---|---|---|
| AI7503000983_1183337_c2_847 | 398 | 4170 | 447 | 148 | 303 | 5.8e−27 |

Description
sp:[LN:NUSA_BACSU] [AC:P32727] [GN:NUSA] [OR:*BACILLUS SUBTILIS*] [DE:N
UTILIZATION SUBSTANCE PROTEIN A HOMOLOG (NUSA PROTEIN)] [SP:P32727]
[DB:swissprot] >pir:[LN:C36905] [AC:C36905:B69668:S31991] [PN:transcription
termination-antitermination factor nusA] [GN:nusA] [CL:*Bacillus*
transcription termination factor nusA:transcription termination factor nusA
homology] [OR:*Bacillus subtilis*] [DB:pir2] >gp:[GI:g49316] [LN:BSORF1T7A]
[AC:Z18631] [GN:ORF2] [OR:*Bacillus subtilis*] [DB:genpept-bct1]
[DE:*B. subtilis* infB-nusA operon.] [SP:P32727] [LE:961] [RE:2076] [DI:direct]

| ORF Name | NT ID | AA ID | NT LN | AA LN | Score | P-Value |
|---|---|---|---|---|---|---|
| AI7503000983_11844802_c2_941 | 399 | 4171 | 327 | 108 | | |

Description
NO-HIT

| ORF Name | NT ID | AA ID | NT LN | AA LN | Score | P-Value |
|---|---|---|---|---|---|---|
| AI7503000983_11926627_f3_614 | 400 | 4172 | 171 | 56 | | |

Description
NO-HIT

| ORF Name | NT ID | AA ID | NT LN | AA LN | Score | P-Value |
|---|---|---|---|---|---|---|
| AI7503000983_11930317_c3_974 | 401 | 4173 | 336 | 111 | 251 | 1.9e−21 |

Description
sp:[LN:YLXQ_BACSU] [AC:P32729] [GN:YLXQ] [OR:*BACILLUS SUBTILIS*] [DE:PROBABLE
RIBOSOMAL PROTEIN IN NUSA-INFB INTERGENIC REGION (ORF4)] [SP:P32729]
[DB:swissprot] >pir:[LN:E36905] [AC:E36905:C69882:S31993] [PN:ribosomal
protein L7AE family homolog ylxQ:hypothetical protein 2 (infB 5' region)]
[GN:ylxQ] [OR:*Bacillus subtilis*] [DB:pir2] >gp:[GI:g49318] [LN:BSORF1T7A]
[AC:Z18631] [GN:ORF4] [OR:*Bacillus subtilis*] [DB:genpept-bct1]
[DE:*B. subtilis* infB-nusA operon.] [SP:P32729] [LE:2367] [RE:2669]
[DI:direct] >gp:[GI:e1185253:g2634034] [LN:BSUB0009] [AC:Z99112:AL009126]
[GN:ylxQ] [FN:unknown] [OR:*Bacillus subtilis*] [DB:genpept-bct1] [DE:*Bacillus
subtilis* complete genome (section 9 of 21):from 1598421 to 1807200.]
[NT:alternate gene name:ymxC; similar to ribosomal] [SP:P32729] [LE:134658]
[RE:134960] [DI:direct]

| ORF Name | NT ID | AA ID | NT LN | AA LN | Score | P-Value |
|---|---|---|---|---|---|---|
| AI7503000983_1212785_f1_108 | 402 | 4174 | 213 | 70 | 74 | 0.048 |

Description
pir:[LN:G70047] [AC:G70047] [PN:conserved hypothetical protein yvrM]
[GN:yvrM] [OR:*Bacillus subtilis*] [DB:pir2] >gp:[GI:e1184405:g2635823]
[LN:BSUB0017] [AC:Z99120:AL009126] [GN:yvrM] [FN:unknown] [OR:*Bacillus
subtilis*] [DB:genpept-bct1] [DE:*Bacillus subtilis* complete genome (section
17 of 21):from 3197001 to 3414420.] [NT:similar to hypothetical proteins]
[LE:214190] [RE:214951] [DI:complement] >gp:[GI:e1186014:g2635839]
[LN:BSUB0018] [AC:Z99121:AL009126] [GN:yvrM] [FN:unknown] [OR:*Bacillus
subtilis*] [DB:genpept-bct1] [DE:*Bacillus subtilis* complete genome (section
18 of 21):from 3399551 to 3609060.] [NT:similar to hypothetical proteins]
[LE:11640] [RE:12401] [DI:complement]

| ORF Name | NT ID | AA ID | NT LN | AA LN | Score | P-Value |
|---|---|---|---|---|---|---|
| AI7503000983_12694082_c2_889 | 403 | 4175 | 192 | 63 | | |

Description
NO-HIT

| ORF Name | NT ID | AA ID | NT LN | AA LN | Score | P-Value |
|---|---|---|---|---|---|---|
| AI7503000983_12703763_f3_592 | 404 | 4176 | 159 | 52 | | |

Description

-continued

NO-HIT

| ORF Name | NT ID | AA ID | NT LN | AA LN | Score | P-Value |
|---|---|---|---|---|---|---|
| AI7503000983_13087513_c2_907 | 405 | 4177 | 3033 | 1010 | 417 | 4.1e−65 |

Description
pir:[LN:D71302] [AC:D71302] [PN:probable exonuclease (sbcC)] [GN:TP0627]
[OR:*Treponema pallidum* subsp. *pallidum*] [SR:, syphilis spirochete] [DB:pir2]
>gp:[GI:g3322922] [LN:AE001237] [AC:AE001237:AE000520] [PN:exonuclease
(sbcC)] [GN:TP0627] [OR:*Treponema pallidum*] [DB:genpept-bct2] [DE:*Treponema
pallidum* section 53 of 87 of the complete genome.] [NT:similar to SP:P13458
GB:X15981 PID:145327 PID:42914] [LE:12418] [RE:15561] [DI:direct]

| ORF Name | NT ID | AA ID | NT LN | AA LN | Score | P-Value |
|---|---|---|---|---|---|---|
| AI7503000983_13179692_c1_724 | 406 | 4178 | 132 | 43 | | |

Description
NO-HIT

| ORF Name | NT ID | AA ID | NT LN | AA LN | Score | P-Value |
|---|---|---|---|---|---|---|
| AI7503000983_1360958_c2_905 | 407 | 4179 | 270 | 89 | 109 | 2.1e−06 |

Description
pir:[LN:C69891] [AC:C69891:S57406] [PN:yneJ protein:protein 160] [GN:yneJ]
[OR:*Bacillus subtilis*] [DB:pir2] >gp:[GI:e249647:g1405451] [LN:BC170DEGR]
[AC:Z73234] [PN:YneJ] [GN:yneJ] [OR:*Bacillus subtilis*] [DB:genpept-bct1]
[DE:*B. subtilis* DNA (26.2 kb fragment; 170 degree region).] [NT:identical to
yoxI (from acc. no. X87845)] [SP:P45710] [LE:6147] [RE:6638] [DI:direct]
>gp:[GI:e1183454:g2634179] [LN:BSUB0010] [AC:Z99113:AL009126] [GN:yneJ]
[FN:unknown] [OR:*Bacillus subtilis*] [DB:genpept-bct1] [DE:*Bacillus subtilis*
complete genome (section 10 of 21):from 1781201 to 2014980.] [NT:alternate
gene name:yoxI] [SP:P45710] [LE:142526] [RE:143017] [DI:direct]

| ORF Name | NT ID | AA ID | NT LN | AA LN | Score | P-Value |
|---|---|---|---|---|---|---|
| AI7503000983_13678135_f3_575 | 408 | 4180 | 159 | 52 | 84 | 0.00093 |

Description
pir:[LN:B71622] [AC:B71622] [PN:metal binding protein (DHHC domain)
PFB0140w] [GN:PFB0140w] [OR:*Plasmodium falciparum*] [DB:pir2]
>gp:[GI:g3845106] [LN:AE001375] [AC:AE001375:AE001362] [PN:metal binding
protein (DHHC domain)] [GN:PFB0140w] [OR:*Plasmodium falciparum*] [SR:malaria
parasite *P. falciparum*] [DB:genpept-inv2] [DE:*Plasmodium falciparum*
chromosome 2, section 12 of 73 of the complete sequence.] [NT:identified by
sequence similarity; putative] [LE:814] [RE:1050] [DI:direct]

| ORF Name | NT ID | AA ID | NT LN | AA LN | Score | P-Value |
|---|---|---|---|---|---|---|
| AI7503000983_13678462_f1_15 | 409 | 4181 | 564 | 187 | 303 | 5.8e−27 |

Description
sp:[LN:SPHX_SYNP7] [AC:P39665] [GN:SPHX] [OR:*SYNECHOCOCCUS* SP] [SR:PCC
7942, ANACYSTIS NIDULANS R2] [DE:SPHX PROTEIN PRECURSOR] [SP:P39665]
[DB:swissprot] >pir:[LN:S54402] [AC:S54402] [PN:SphX protein] [CL:sphX
protein] [OR:*Synechococcus* sp.] [DB:pir2] >gp:[GI:d1005689:g496319]
[LN:SYOSPHX] [AC:D26161] [PN:SphX] [GN:sphX] [OR:*Synechococcus* sp.]
[SR:*Synechococcus* sp. (strain:PCC7942) DNA] [DB:genpept-bct1]
[DE:*Synechococcus* sp. sphX gene for phosphate regulon SphX, complete cds.]
[LE:317] [RE:1330] [DI:direct]

| ORF Name | NT ID | AA ID | NT LN | AA LN | Score | P-Value |
|---|---|---|---|---|---|---|
| AI7503000983_13691280_f1_42 | 410 | 4182 | 135 | 44 | | |

Description
NO-HIT

| ORF Name | NT ID | AA ID | NT LN | AA LN | Score | P-Value |
|---|---|---|---|---|---|---|
| AI7503000983_13845300_f2_231 | 411 | 4183 | 309 | 102 | 79 | 0.0065 |

Description
sp:[LN:YCIB_BUCAP] [AC:P42397] [OR:*BUCHNERA APHIDICOLA*] [DE:HYPOTHETICAL
21.4 KD PROTEIN IN TRPA 3'REGION] [SP:P42397] [DB:swissprot]
>pir:[LN:F49897] [AC:F49897:S36433] [PN:protein VI (trpA 3'-region)]
[OR:*Buchnera aphidicola*] [DB:pir2] >gp:[GI:g396663] [LN:BATRYOPEA]

-continued

[AC:Z19055] [PN:ORF 6] [OR:*Buchnera aphidicola*] [DB:genpept-bct1]
[DE:*B. aphidicola* tryptophan operon.] [NT:homologous to *E. coli* ORF6 located
downstream of] [SP:P42397] [LE:7540] [RE:8073] [DI:direct]

| ORF Name | NT ID | AA ID | NT LN | AA LN | Score | P-Value |
|---|---|---|---|---|---|---|
| AI7503000983_13875216_c3_1046 | 412 | 4184 | 1023 | 340 | 895 | 1.1e−89 |

Description
gp:[GI:e1181777:g2632149] [LN:SCY14029] [AC:Y14029] [PN:antiterminator]
[GN:glcT] [OR:*Staphylococcus carnosus*] [DB:genpept-bct1] [DE:*Staphylococcus carnosus* glcT gene.] [LE:213] [RE:1076] [DI:direct]

| ORF Name | NT ID | AA ID | NT LN | AA LN | Score | P-Value |
|---|---|---|---|---|---|---|
| AI7503000983_14251643_f3_547 | 413 | 4185 | 309 | 102 | 143 | 5.2e−10 |

Description
pir:[LN:H69891] [AC:H69891] [PN:hypothetical protein yneR] [GN:yneR]
[OR:*Bacillus subtilis*] [DB:pir2] >gp:[GI:e249654:g1405458] [LN:BC170DEGR]
[AC:Z73234] [PN:YneR] [GN:yneR] [OR:*Bacillus subtilis*] [DB:genpept-bct1]
[DE:*B. subtilis* DNA (26.2 kb fragment; 170 degree region).] [LE:13221]
[RE:13508] [DI:complement] >gp:[GI:e1183464:g2634189] [LN:BSUB0010]
[AC:Z99113:AL009126] [GN:yneR] [FN:unknown] [OR:*Bacillus subtilis*]
[DB:genpept-bct1] [DE:*Bacillus subtilis* complete genome (section 10 of 21):
from 1781201 to 2014980.] [LE:149600] [RE:149887] [DI:complement]

| ORF Name | NT ID | AA ID | NT LN | AA LN | Score | P-Value |
|---|---|---|---|---|---|---|
| AI7503000983_14457876_f3_521 | 414 | 4186 | 135 | 44 | 194 | 2.1e−15 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000983_14471938_c3_1027 | 415 | 4187 | 183 | 60 | 231 | 2.5e−19 |

Description
sp:[LN:RL33_BACST] [AC:P23375] [GN:RPMG] [OR:*BACILLUS STEAROTHERMOPHILUS*]
[DE:50S RIBOSOMAL PROTEIN L33] [SP:P23375] [DB:swissprot] >pir:[LN:B48396]
[AC:B48396] [PN:ribosomal protein L33] [CL:*Escherichia coli* ribosomal
protein L33] [OR:*Bacillus stearothermophilus*] [DB:pir2]

| ORF Name | NT ID | AA ID | NT LN | AA LN | Score | P-Value |
|---|---|---|---|---|---|---|
| AI7503000983_1461588_f1_16 | 416 | 4188 | 942 | 313 | 712 | 2.6e−70 |

Description
pir:[LN:D69419] [AC:D69419] [PN:phosphate ABC transporter, permease protein
(pstC) homolog] [CL:phoW protein] [OR:*Archaeoglobus fulgidus*] [DB:pir2]
>gp:[GI:g2649218] [LN:AE001010] [AC:AE001010:AE000782] [PN:phosphate ABC
transporter, permease protein] [GN:AF1357] [OR:*Archaeoglobus fulgidus*]
[DB:genpept-bct2] [DE:*Archaeoglobus fulgidus* section 97 of 172 of the
complete genome.] [NT:similar to SP:P46339 PID:903304 PID:1303855] [LE:5294]
[RE:6187] [DI:direct]

| ORF Name | NT ID | AA ID | NT LN | AA LN | Score | P-Value |
|---|---|---|---|---|---|---|
| AI7503000983_14634450_f1_1 | 417 | 4189 | 204 | 67 | | |

Description
NO-HIT

| ORF Name | NT ID | AA ID | NT LN | AA LN | Score | P-Value |
|---|---|---|---|---|---|---|
| AI7503000983_14723387_c2_904 | 418 | 4190 | 282 | 93 | 250 | 2.4e−21 |

Description
sp:[LN:YNEF_BACSU] [AC:P45708] [GN:YNEF] [OR:*BACILLUS SUBTILIS*]
[DE:HYPOTHETICAL 8.3 KD PROTEIN IN TTK-CCDA INTERGENIC REGION] [SP:P45708]
[DB:swissprot] >pir:[LN:S57403] [AC:S57403:A69891] [PN:hypothetical protein
yneF] [GN:yneF] [CL:conserved hypothetical protein yneF] [OR:*Bacillus
subtilis*] [DB:pir2] >gp:[GI:e249644:g1405448] [LN:BC170DEGR] [AC:Z73234]
[PN:YneF] [GN:yneF] [OR:*Bacillus subtilis*] [DB:genpept-bct1] [DE:*B. subtilis*
DNA (26.2 kb fragment; 170 degree region).] [NT:identical to yoxG (from acc.

-continued no. X87845)] [SP:P45708] [LE:4225] [RE:4443] [DI:direct] >gp:[GI:g870924]
[LN:BSTKTCCDA] [AC:X87845] [GN:orf] [OR:*Bacillus subtilis*] [DB:genpept-bct1]
[DE:*B. subtilis* ORF120, ORF160, tkt and ccdA genes.] [SP:P45708] [LE:1011]
[RE:1229] [DI:direct] >gp:[GI:e1183450:g2634175] [LN:BSUB0010]
[AC:Z99113:AL009126] [GN:yneF] [FN:unknown] [OR:*Bacillus subtilis*]
[DB:genpept-bct1] [DE:*Bacillus subtilis* complete genome (section 10 of 21):
from 1781201 to 2014980.] [NT:alternate gene name:yoxG] [SP:P45708]
[LE:140604] [RE:140822] [DI:direct]

| ORF Name | NT ID | AA ID | NT LN | AA LN | Score | P-Value |
| --- | --- | --- | --- | --- | --- | --- |
| AI7503000983__14850082__f1__18 | 419 | 4191 | 933 | 310 | 880 | 4.2e−88 |

Description
sp:[LN:YQGK_BACSU] [AC:P46342] [GN:YQGK] [OR:*BACILLUS SUBTILIS*]
[DE:INTERGENIC REGION (ORF75)] [SP:P46342] [DB:swissprot] >pir:[LN:E69956]
[AC:E69956] [PN:phosphate ABC transporter (ATP-binding pro) homolog yqgK]
[GN:yqgK] [CL:inner membrane protein malK:ATP-binding cassette homology]
[OR:*Bacillus subtilis*] [DB:pir2] >gp:[GI:d1013193:g1303858] [LN:BACJH642]
[AC:D84432:D82370] [PN:YqgK] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:141613] [RE:142395]
[DI:direct] >gp:[GI:d1010228:g903307] [LN:BACPST] [AC:D58414] [PN:ORF75]
[OR:*Bacillus subtilis*] [SR:*Bacillus subtilis* (strain:JH642 (trpC2 pheA1))
DNA] [DB:genpept-bct1] [DE:*Bacillus subtilis* DNA for homologues of the *E.
coli* pst gene products.] [NT:Similarity to phosphate transport protein (PstB)
of] [LE:3782] [RE:4564] [DI:direct] >gp:[GI:e1185762:g2634928] [LN:BSUB0013]
[AC:Z99116:AL009126] [GN:yqgK] [FN:unknown] [OR:*Bacillus subtilis*]
[DB:genpept-bct1] [DE:*Bacillus subtilis* complete genome (section 13 of 21):
from 2395261 to 2613730.] [NT:alternate gene name:yzmF; similar to phosphate
ABC] [SP:P46342] [LE:181226] [RE:182008] [DI:complement]

| ORF Name | NT ID | AA ID | NT LN | AA LN | Score | P-Value |
| --- | --- | --- | --- | --- | --- | --- |
| AI7503000983__14876553__c2__919 | 420 | 4192 | 996 | 331 | 570 | 2.9e−55 |

Description
gp:[GI:g1147744] [LN:EHU42211] [AC:U42211] [PN:PBP 5 synthesis repressor]
[GN:psr] [FN:involved in the regulation of penicillin] [OR:*Enterococcus
hirae*] [DB:genpept-bct2] [DE:*Enterococcus hirae* PBP 5 synthesis repressor
(psr) gene, complete cds.] [LE:746] [RE:1627] [DI:direct]

| ORF Name | NT ID | AA ID | NT LN | AA LN | Score | P-Value |
| --- | --- | --- | --- | --- | --- | --- |
| AI7503000983__14901512__c3__1012 | 421 | 4193 | 552 | 183 | 500 | 7.7e−48 |

Description
sp:[LN:NUC_STAIN] [AC:P43269] [GN:NUCI:NUC] [OR:*STAPHYLOCOCCUS INTERMEDIUS*]
[EC:3.1.31.1] [DE:(*STAPHYLOCOCCAL NUCLEASE*)] [SP:P43269] [DB:swissprot]
>pir:[LN:S26079] [AC:S26079] [PN:thermonuclease] [CL:micrococcal nuclease]
[OR:*Staphylococcus intermedius*] [DB:pir2] >gp:[GI:g47146] [LN:SINUC8]
[AC:X67678] [PN:thermonuclease] [GN:nuc] [OR:*Staphylococcus intermedius*]
[DB:genpept-bct1] [DE:*S. intermedius* nuc gene for thermonuclease.]
[SP:P43269] [LE:495] [RE:1001] [DI:direct]

| ORF Name | NT ID | AA ID | NT LN | AA LN | Score | P-Value |
| --- | --- | --- | --- | --- | --- | --- |
| AI7503000983__15084826__c3__1034 | 422 | 4194 | 300 | 99 | 268 | 3.0e−23 |

Description
sp:[LN:CCDC_BACSU] [AC:P45710] [GN:CCDC] [OR:*BACILLUS SUBTILIS*] [DE:CCDC
PROTEIN] [SP:P45710] [DB:swissprot] >gp:[GI:g870927] [LN:BSTKTCCDA]
[AC:X87845] [GN:ORF160] [OR:*Bacillus subtilis*] [DB:genpept-bct1]
[DE:*B. subtilis* ORF120, ORF160, tkt and ccdA genes.] [SP:P45710] [LE:2942]
[RE:3424] [DI:direct]

| ORF Name | NT ID | AA ID | NT LN | AA LN | Score | P-Value |
| --- | --- | --- | --- | --- | --- | --- |
| AI7503000983__15757712__f1__23 | 423 | 4195 | 732 | 243 | 686 | 1.5e−67 |

Description
gp:[GI:g3800828] [LN:AF076684] [AC:AF076684] [PN:oligopeptide transporter
putative ATPase domain] [GN:opp-2F] [OR:*Staphylococcus aureus*]
[DB:genpept-bct2] [DE:*Staphylococcus aureus* oligopeptide transporter
putative membrane permease domain (opp-2B), oligopeptide transporter
putative membrane permease domain (opp-2C), oligopeptide transporter putative
ATPase domain (opp-2D), and oligopeptide transporter putative ATPase domain
(opp-2F) genes, complete cds.] [LE:2735] [RE:3436] [DI:direct]

| ORF Name | NT ID | AA ID | NT LN | AA LN | Score | P-Value |
|---|---|---|---|---|---|---|
| AI7503000983_15803510_c2_854 | 424 | 4196 | 132 | 43 | | |

Description
NO-HIT

| ORF Name | NT ID | AA ID | NT LN | AA LN | Score | P-Value |
|---|---|---|---|---|---|---|
| AI7503000983_16205378_c1_815 | 425 | 4197 | 243 | 80 | | |

Description
NO-HIT

| ORF Name | NT ID | AA ID | NT LN | AA LN | Score | P-Value |
|---|---|---|---|---|---|---|
| AI7503000983_162843_f2_330 | 426 | 4198 | 468 | 155 | 395 | 1.0e−36 |

Description
Sp:[LN:LYSP_ECOLI] [AC:P25737] [GN:LYSP:CADR] [OR:ESCHERICHIA COLI]
[DE:LYSINE-SPECIFIC PERMEASE] [SP:P25737] [DB:swissprot]

| ORF Name | NT ID | AA ID | NT LN | AA LN | Score | P-Value |
|---|---|---|---|---|---|---|
| AI7503000983_16835388_f1_19 | 427 | 4199 | 654 | 217 | 265 | 6.2e−23 |

Description
gp:[GI:d1023735:g2547082] [LN:D89963] [AC:D89963] [PN:negative regulatory
protein of pho regulon] [GN:phoU] [OR:Enterobacter cloacae] [SR:Enterobacter
cloacae (strain:IFO3320) DNA] [DB:genpept-bct1] [DE:Enterobacter cloacae
pstS, pstC, pstA, pstB and phoU genes, complete cds.] [NT:The phoU gene is
required for chemotaxis to ward] [LE:4554] [RE:5279] [DI:direct]

| ORF Name | NT ID | AA ID | NT LN | AA LN | Score | P-Value |
|---|---|---|---|---|---|---|
| AI7503000983_17040911_c1_771 | 428 | 4200 | 123 | 40 | | |

Description
NO-HIT

| ORF Name | NT ID | AA ID | NT LN | AA LN | Score | P-Value |
|---|---|---|---|---|---|---|
| AI7503000983_190707_f1_81 | 429 | 4201 | 129 | 42 | | |

Description
NO-HIT

| ORF Name | NT ID | AA ID | NT LN | AA LN | Score | P-Value |
|---|---|---|---|---|---|---|
| AI7503000983_194431_c3_1033 | 430 | 4202 | 132 | 43 | | |

Description
NO-HIT

| ORF Name | NT ID | AA ID | NT LN | AA LN | Score | P-Value |
|---|---|---|---|---|---|---|
| AI7503000983_19540678_c1_797 | 431 | 4203 | 438 | 145 | 270 | 7.7e−23 |

Description
gp:[GI:g4835822] [LN:AF102174] [AC:AF102174] [PN:glycine betaine transporter
BetL] [GN:betL] [OR:Listeria monocytogenes] [DB:genpept-bct2] [DE:Listeria
monocytogenes glycine betaine transporter BetL (betL)gene, complete cds.]
[LE:209] [RE:1732] [DI:direct]

| ORF Name | NT ID | AA ID | NT LN | AA LN | Score | P-Value |
|---|---|---|---|---|---|---|
| AI7503000983_19730438_c2_926 | 432 | 4204 | 1272 | 423 | 2221 | 3.3e−230 |

Description
pir:[LN:JC5326] [AC:JC5326] [PN:methicillin resistance factor FEMB]
[GN:femB] [CL:methicillin resistance factor femA] [OR:Staphylococcus
epidermidis] [DB:pir2] >gp:[GI:g1815620] [LN:SEU23714] [AC:U23714] [PN:FEMB]
[GN:femB] [OR:Staphylococcus epidermidis] [DB:genpept-bct1]
[DE:Staphylococcus epidermidis factor essential for methicillin resistance
FEMB (femB) gene, complete cds.] [NT:Factor essential for methicillin
resistance] [LE:33] [RE:1286] [DI:direct]

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000983__19735887__c1__754 | 433 | 4205 | 1581 | 526 | 1924 | 9.7e−199 |

Description
pir:[LN:D69884] [AC:D69884] [PN:conserved hypothetical protein ymcB]
[GN:ymcB] [CL:conserved hypothetical protein b0835] [OR:*Bacillus subtilis*]
[DB:pir2] >gp:[GI:e1185292:g2634073] [LN:BSUB0009] [AC:Z99112:AL009126]
[GN:ymcB] [FN:unknown] [OR:*Bacillus subtilis*] [DB:genpept-bct1] [DE:*Bacillus subtilis* complete genome (section 9 of 21):from 1598421 to 1807200.]
[NT:similar to hypothetical proteins] [LE:173791] [RE:175320] [DI:direct]

| ORF Name | NT ID | AA ID | NT LN | AA LN | Score | P-Value |
|---|---|---|---|---|---|---|
| AI7503000983__19953281__c3__1016 | 434 | 4206 | 1347 | 448 | 822 | 5.8e−82 |

Description
sp:[LN:DHOM_BACSU] [AC:P19582] [GN:HOM:TDM] [OR:*BACILLUS SUBTILIS*]
[EC:1.1.1.3] [DE:HOMOSERINE DEHYDROGENASE, (HDH)] [SP:P19582] [DB:swissprot]
>gp:[GI:g558494] [LN:BACHOM] [AC:M23217:J04034] [PN:homoserine
dehydrogenase] [GN:hom] [OR:*Bacillus subtilis*] [SR:*Bacillus subtilis* DNA]
[DB:genpept-bct1] [EC:1.1.1.3] [DE:*Bacillus subtilis* homoserine
dehydrogenase (hom) gene, complete cds, threonine synthase (thrC) gene, 5'
end of cds.] [LE:276] [RE:1577] [DI:direct]

| ORF Name | NT ID | AA ID | NT LN | AA LN | Score | P-Value |
|---|---|---|---|---|---|---|
| AI7503000983__20086512__c2__899 | 435 | 4207 | 654 | 217 | 780 | 1.6e−77 |

Description
gp:[GI:g3064126] [LN:AF011784] [AC:AF011784] [PN:catalase] [GN:katA]
[OR:*Vibrio fischeri*] [DB:genpept-bct2] [DE:*Vibrio fischeri* catalase (katA)
gene, complete cds.] [LE:256] [RE:1704] [DI:direct]

| ORF Name | NT ID | AA ID | NT LN | AA LN | Score | P-Value |
|---|---|---|---|---|---|---|
| AI7503000983__20095803__c3__994 | 436 | 4208 | 207 | 68 | | |

Description
NO-HIT

| ORF Name | NT ID | AA ID | NT LN | AA LN | Score | P-Value |
|---|---|---|---|---|---|---|
| AI7503000983__20312510__f3__506 | 437 | 4209 | 1041 | 346 | 1070 | 3.1e−108 |

Description
gp:[GI:g3800825] [LN:AF076684] [AC:AF076684] [PN:oligopeptide transporter
putative membrane] [GN:opp-2B] [OR:*Staphylococcus aureus*] [DB:genpept-bct2]
[DE:*Staphylococcus aureus* oligopeptide transporter putative membrane permease
domain (opp-2B), oligopeptide transporter putative membrane permease domain
(opp-2C), oligopeptide transporter putative ATPase domain (opp-2D), and
oligopeptide transporter putative ATPase domain (opp-2F) genes, complete
cds.] [LE:173] [RE:1159] [DI:direct]

| ORF Name | NT ID | AA ID | NT LN | AA LN | Score | P-Value |
|---|---|---|---|---|---|---|
| AI7503000983__20347165__f3__485 | 438 | 4210 | 147 | 48 | | |

Description
NO-HIT

| ORF Name | NT ID | AA ID | NT LN | AA LN | Score | P-Value |
|---|---|---|---|---|---|---|
| AI7503000983__20370457__c2__884 | 439 | 4211 | 183 | 60 | | |

Description
NO-HIT

| ORF Name | NT ID | AA ID | NT LN | AA LN | Score | P-Value |
|---|---|---|---|---|---|---|
| AI7503000983__20400051__f2__319 | 440 | 4212 | 810 | 269 | 691 | 4.4e−68 |

Description
sp:[LN:LEXA_BACSU] [AC:P31080] [GN:LEXA:DINR] [OR:*BACILLUS SUBTILIS*] [DE:SOS
REGULATORY PROTEIN LEXA/DINR] [SP:P31080] [DB:swissprot] >pir:[LN:A41315]
[AC:A41315:B69651] [PN:transcription repressor of SOS regulon lexA/dinR]
[GN:lexA:dinR] [CL:lexA protein] [OR:*Bacillus subtilis*] [DB:pir2]
>gp:[GI:g289288] [LN:BACLEXA] [AC:M64684] [GN:lexA] [OR:*Bacillus subtilis*]
[SR:*Bacillus subtilis* DNA] [DB:genpept-bct1] [DE:*Bacillus subtilis* lexA
gene, 3' end.] [LE:390] [RE:1007] [DI:direct] >gp:[GI:e1183444:g2634169]
[LN:BSUB0010] [AC:Z99113:AL009126] [PN:transcriptional regulator] [GN:lexA]

-continued

[FN:negative regulation of the SOS regulon] [OR:*Bacillus subtilis*]
[DB:genpept-bct1] [DE:*Bacillus subtilis* complete genome (section 10 of 21):
from 1781201 to 2014980.] [NT:alternate gene name:dinR] [SP:P31080]
[LE:135694] [RE:136311] [DI:complement]

| ORF Name | NT ID | AA ID | NT LN | AA LN | Score | P-Value |
|---|---|---|---|---|---|---|
| AI7503000983_20423127_c3_991 | 441 | 4213 | 2676 | 891 | 2302 | 8.6e−239 |

Description
pir:[LN:C69663] [AC:C69663] [PN:DNA mismatch repair (recognition) mutS]
[GN:mutS] [CL:DNA mismatch repair protein mutS] [OR:*Bacillus subtilis*]
[DB:pir2] >gp:[GI:e1185295:g2634076] [LN:BSUB0009] [AC:Z99112:AL009126]
[GN:mutS] [FN:DNA mismatch repair recognition] [OR:*Bacillus subtilis*]
[DB:genpept-bct1] [DE:*Bacillus subtilis* complete genome (section 9 of 21):
from 1598421 to 1807200.] [SP:P49849] [LE:176693] [RE:179269] [DI:direct]

| ORF Name | NT ID | AA ID | NT LN | AA LN | Score | P-Value |
|---|---|---|---|---|---|---|
| AI7503000983_20485875_c3_1008 | 442 | 4214 | 231 | 76 | | |

Description
NO-HIT

| ORF Name | NT ID | AA ID | NT LN | AA LN | Score | P-Value |
|---|---|---|---|---|---|---|
| AI7503000983_20501250_c2_922 | 443 | 4215 | 1029 | 342 | 551 | 3.0e−53 |

Description
sp:[LN:TRPD_METJA] [AC:Q57686] [GN:TRPD:MJ0234] [OR:*METHANOCOCCUS
JANNASCHII*] [EC:2.4.2.18] [DE:ANTHRANILATE PHOSPHORIBOSYLTRANSFERASE,]
[SP:Q57686] [DB:swissprot] >pir:[LN:C64329] [AC:C64329] [PN:anthranilate
synthase, subunit II'] [CL:anthranilate phosphoribosyltransferase:trpD
homology] [OR:*Methanococcus jannaschii*] [EC:4.1.3.27] [DB:pir2]
[MP:FOR225111−2261212] >gp:[GI:g1590969] [LN:U67479] [AC:U67479:L77117]
[PN:anthranilate synthase component II (trpD)] [GN:MJ0234] [OR:*Methanococcus
jannaschii*] [DB:genpept-bct2] [DE:*Methanococcus jannaschii*] section 21 of 150
of the complete genome.] [NT:similar to GB:M33814 SP:P20574 PID:151234
percent] [LE:3662] [RE:4672] [DI:direct]

| ORF Name | NT ID | AA ID | NT LN | AA LN | Score | P-Value |
|---|---|---|---|---|---|---|
| AI7503000983_20504512_c2_864 | 444 | 4216 | 1758 | 585 | 808 | 1.8e−80 |

Description
gp:[GI:g4981713] [LN:AE001773] [AC:AE001773:AE000512] [PN:2-oxoacid
ferredoxin oxidoreductase, alpha] [GN:TM1164] [OR:*Thermotoga maritima*]
[DB:genpept-bct2] [DE:*Thermotoga maritima* section 85 of 136 of the complete
genome.] [NT:similar to GB:AE000666 percent identity:68.99;] [LE:8189]
[RE:9865] [DI:direct]

| ORF Name | NT ID | AA ID | NT LN | AA LN | Score | P-Value |
|---|---|---|---|---|---|---|
| AI7503000983_205327_c2_836 | 445 | 4217 | 1332 | 443 | 1679 | 8.9e−173 |

Description
sp:[LN:GID_BACSU] [AC:P39815] [GN:GID] [OR:*BACILLUS SUBTILIS*] [DE:GID
PROTEIN] [SP:P39815] [DB:swissprot] >pir:[LN:A69632] [AC:A69632:S61497]
[PN:glucose-inhibited division protein gid] [GN:gid] [OR:*Bacillus subtilis*]
[DB:pir2] >gp:[GI:e1185204:g2633985] [LN:BSUB0009] [AC:Z99112:AL009126]
[PN:glucose-inhibited division protein] [GN:gid] [OR:*Bacillus subtilis*]
[DB:genpept-bct1] [DE:*Bacillus subtilis* complete genome (section 9 of 21):
from 1598421 to 1807200.] [NT:alternate gene name:ylyC] [LE:86791]
[RE:88098] [DI:direct] >gp:[GI:e332181:g24629971] [LN:BSYLQGCOD]
[AC:AJ000975] [PN:Gid protein] [GN:gid] [OR:*Bacillus subtilis*]
[DB:genpept-bct1] [DE:*Bacillus subtilis* ylqg to cody gene region.]
[SP:P39815] [LE:5959] [RE:7266] [DI:direct]

| ORF Name | NT ID | AA ID | NT LN | AA LN | Score | P-Value |
|---|---|---|---|---|---|---|
| AI7503000983_20745462_c1_767 | 446 | 4218 | 1257 | 418 | 862 | 3.4e−86 |

Description
pir:[LN:B69888] [AC:B69888] [PN:GTP-binding protein proteinase modulator
homolog ynbA] [GN:ynbA] [CL:GTP-binding protein hflX] [OR:*Bacillus
subtilis*] [DB:pir2] >gp:[GI:g1750108] [LN:BSU66480] [AC:U66480] [PN:YnbA]
[GN:ynbA] [OR:*Bacillus subtilis*] [DB:genpept-bct1] [DE:*Bacillus subtilis*
SpoVK (spoVK), YnbA (ynbA), YnbB (ynbB), GlnR (glnR), glutamine synthetase
(glnA), YnaA (ynaA), YnaB (ynaB), YnaC (ynaC), YnaD (ynaD), YnaE (ynaE), YnaF -continued (ynaF), YnaG (ynaG), YnaH (ynaH), YnaI (ynaI), YnaJ (ynaJ), xylan
beta-1,4-xylosidase (xynB), xylose repressor (xylR), xylose isomerase (xylA),
xylulose kinase(xylB), YncB (yncB), YncC (yncC), YncD (yncD) and YncE
(yncE) genes, complete cds.] [LE:1382] [RE:2386] [DI:direct]
>gp:[GI:e1183402:g2634127] [LN:BSUB0010] [AC:Z99113:AL009126] [GN:ynbA]
[FN:unknown] [OR:*Bacillus subtilis*] [DB:genpept-bct1] [DE:*Bacillus subtilis*
complete genome (section 10 of 21):from 1781201 to 2014980.] [NT:similar to
GTP-binding protein protease modulator] [LE:93433] [RE:94437] [DI:direct]

| ORF Name | NT ID | AA ID | NT LN | AA LN | Score | P-Value |
|---|---|---|---|---|---|---|
| AI7503000983__20819512__f1__50 | 447 | 4219 | 153 | 50 | | |

Description
NO-HIT

| ORF Name | NT ID | AA ID | NT LN | AA LN | Score | P-Value |
|---|---|---|---|---|---|---|
| AI7503000983__20968788__f3__579 | 448 | 4220 | 180 | 59 | | |

Description
NO-HIT

| ORF Name | NT ID | AA ID | NT LN | AA LN | Score | P-Value |
|---|---|---|---|---|---|---|
| AI7503000983__21641877__f2__250 | 449 | 4221 | 954 | 317 | 687 | 1.2e−67 |

Description
pir:[LN:E69419] [AC:E69419] [PN:phosphate ABC transporter, permease protein
(pstA) homolog] [CL:phoW protein] [OR:*Archaeoglobus fulgidus*] [DB:pir2]
>gp:[GI:g2649217] [LN:AE001010] [AC:AE001010:AE000782] [PN:phosphate ABC
transporter, permease protein] [GN:AF1358] [OR:*Archaeoglobus fulgidus*]
[DB:genpept-bct2] [DE:*Archaeoglobus fulgidus* section 97 of 172 of the
complete genome.] [NT:similar to GB:L10328 SP:P07654 GB:K01992 GB:X02723]
[LE:6184] [RE:7035] [DI:direct]

| ORF Name | NT ID | AA ID | NT LN | AA LN | Score | P-Value |
|---|---|---|---|---|---|---|
| AI7503000983__21751938__f3__601 | 450 | 4222 | 708 | 235 | 183 | 3.0e−14 |

Description
gp:[GI:g2897104] [LN:AF020798] [AC:AF020798] [PN:putative host cell
surface-exposed lipoprotein] [OR:*Streptococcus thermophilus* bacteriophage
TP-J34] [DB:genpept-phg] [DE:*Streptococcus thermophilus* bacteriophage
lysogeny module, integrasehomolog (int), putative host cell surface-exposed
lipoprotein, putative metallo-proteinase, repressor, Cro-like
regulatory protein, and P1-antirepressor homolog genes, complete cds.]
[NT:orf142] [LE:3941] [RE:4369] [DI:complement]

| ORF Name | NT ID | AA ID | NT LN | AA LN | Score | P-Value |
|---|---|---|---|---|---|---|
| AI7503000983__21912535__f1__212 | 451 | 4223 | 420 | 139 | 75 | 0.018 |

Description
pir:[LN:B21124] [AC:B21124] [PN:Bkm-like sex-determining region
hypothetical protein CS314] [GN:Bkm] [OR:*Drosophila melanogaster*] [DB:pir2]

| ORF Name | NT ID | AA ID | NT LN | AA LN | Score | P-Value |
|---|---|---|---|---|---|---|
| AI7503000983__2195265__f1__6 | 452 | 4224 | 147 | 48 | | |

Description
NO-HIT

| ORF Name | NT ID | AA ID | NT LN | AA LN | Score | P-Value |
|---|---|---|---|---|---|---|
| AI7503000983__22304635__f1__113 | 453 | 4225 | 150 | 49 | | |

Description
NO-HIT

| ORF Name | NT ID | AA ID | NT LN | AA LN | Score | P-Value |
|---|---|---|---|---|---|---|
| AI7503000983__22368803__c2__857 | 454 | 4226 | 2397 | 798 | 1659 | 1.2e−170 |

Description
sp:[LN:SP3E_BACSU] [AC:P21458:P21459] [GN:SPOIIIE] [OR:*BACILLUS SUBTILIS*]
[DE:STAGE III SPORULATION PROTEIN E] [SP:P21458:P21459] [DB:swissprot]
>pir:[LN:S09411] [AC:S09411:A32269:B32269:F69712] [PN:DNA translocase spoIIIE] [GN:spoIIIE] [OR:*Bacillus subtilis*] [DB:pir2]
>gp:[GI:e1185271:g2634052] [LN:BSUB0009] [AC:Z99112:AL009126] [PN:DNA translocase] [GN:spoIIIE] [FN:required for chromosome partitioning through] [OR:*Bacillus subtilis*] [DB:genpept-bct1] [DE:*Bacillus subtilis* complete genome (section 9 of 21):from 1598421 to 1807200.] [SP:P21458] [LE:153248] [RE:155611] [DI:direct]

| ORF Name | NT ID | AA ID | NT LN | AA LN | Score | P-Value |
|---|---|---|---|---|---|---|
| AI7503000983_22390917_f3_560 | 455 | 4227 | 165 | 54 | | |

Description
NO-HIT

| ORF Name | NT ID | AA ID | NT LN | AA LN | Score | P-Value |
|---|---|---|---|---|---|---|
| AI7503000983_22444075_c3_959 | 456 | 4228 | 873 | 290 | 788 | 2.3e−78 |

Description
gp:[GI:d1034831:g3767595] [LN:AB015195] [AC:AB015195] [OR:*Staphylococcus aureus*] [SR:*Staphylococcus aureus* (strain:RN450) DNA] [DB:genpept-bct1] [DE:*Staphylococcus aureus* gene for LytN and Eprh, complete cds.] [NT:ORF4] [LE:3221] [RE:4024] [DI:direct] >gp:[GI:d1034831:g3767595] [LN:AB015195] [AC:AB015195] [OR:*Staphylococcus aureus*] [SR:*Staphylococcus aureus* (strain:RN450) DNA] [DB:genpept] [DE:*Staphylococcus aureus* gene for LytN and Eprh, complete cds.] [NT:ORF4] [LE:3221] [RE:4024] [DI:direct]

| ORF Name | NT ID | AA ID | NT LN | AA LN | Score | P-Value |
|---|---|---|---|---|---|---|
| AI7503000983_22453425_f1_196 | 457 | 4229 | 138 | 45 | | |

Description
NO-HIT

| ORF Name | NT ID | AA ID | NT LN | AA LN | Score | P-Value |
|---|---|---|---|---|---|---|
| AI7503000983_22470463_c3_989 | 458 | 4230 | 810 | 269 | 881 | 3.3e−88 |

Description
pir:[LN:G69884] [AC:G69884] [PN:conserved hypothetical protein ymdB] [GN:ymdB] [CL:hypothetical protein ymdB] [OR:*Bacillus subtilis*] [DB:pir2]
>gp:[GI:e1185288:g2634069] [LN:BSUB0009] [AC:Z99112:AL009126] [GN:ymdB] [FN:unknown] [OR:*Bacillus subtilis*] [DB:genpept-bct1] [DE:*Bacillus subtilis* complete genome (section 9 of 21):from 1598421 to 1807200.] [NT:similar to hypothetical proteins] [LE:169889] [RE:170683] [DI:direct]

| ORF Name | NT ID | AA ID | NT LN | AA LN | Score | P-Value |
|---|---|---|---|---|---|---|
| AI7503000983_22539812_c1_768 | 459 | 4231 | 1254 | 417 | 1290 | 1.5e−131 |

Description
pir:[LN:C69888] [AC:C69888] [PN:conserved hypothetical protein ynbB] [GN:ynbB] [CL:hypothetical protein ynbB] [OR:*Bacillus subtilis*] [DB:pir2]
>gp:[GI:g1750109] [LN:BSU66480] [AC:U66480] [PN:YnbB] [GN:ynbB] [OR:*Bacillus subtilis*] [DB:genpept-bct1] [DE:*Bacillus subtilis* SpoVK (spoVK), YnbA (ynbA), YnbB (ynbB), GlnR (glnR), glutamine synthetase (glnA), YnaA (ynaA), YnaB (ynaB), YnaC (ynaC), YnaD (ynaD), YnaE (ynaE), YnaF (ynaF), YnaG (ynaG), YnaH (ynaH), YnaI (ynaI), YnaJ (ynaJ), xylan beta-1,4-xylosidase (xynB), xylose repressor (xylR), xylose isomerase (xylA), xylulose kinase(xylB), YncB (yncB), YncC (yncC), YncD (yncD) and YncE (yncE)genes, complete cds.] [LE:2574] [RE:3839] [DI:direct] >gp:[GI:e1183403:g2634128] [LN:BSUB0010] [AC:Z99113:AL009126] [GN:ynbB] [FN:unknown] [OR:*Bacillus subtilis*] [DB:genpept-bct1] [DE:*Bacillus subtilis* complete genome (section 10 of 21):from 1781201 to 2014980.] [NT:similar to hypothetical proteins] [LE:94625] [RE:95890] [DI:direct]

| ORF Name | NT ID | AA ID | NT LN | AA LN | Score | P-Value |
|---|---|---|---|---|---|---|
| AI7503000983_22663932_f1_22 | 460 | 4232 | 972 | 323 | 1021 | 4.8e−103 |

Description
gp:[GI:g3800826] [LN:AF076684] [AC:AF0766841 [PN:oligopeptide transporter putative membrane] [GN:opp-2C] [OR:*Staphylococcus aureus*] [DB:genpept-bct2] [DE:*Staphylococcus aureus* oligopeptide transporter putative membrane permease domain (opp-2B), oligopeptide transporter putative membrane permease domain (opp-2C), oligopeptide transporter putative ATPase domain (opp-2D), and oligopeptide transporter putative ATPase domain (opp-2F) genes, complete cds.] [LE:1152] [RE:1982] [DI:direct]

-continued

| ORF Name | NT ID | AA ID | NT LN | AA LN | Score | P-Value |
|---|---|---|---|---|---|---|
| AI7503000983__22850885__c1__752 | 461 | 4233 | 1596 | 531 | 1799 | 1.7e−185 |

Description
pir:[LN:F69884] [AC:F69884] [PN:conserved hypothetical protein ymdA]
[GN:ymdA] [CL:hypothetical protein ymdA] [OR:*Bacillus subtilis*] [DB:pir2]
>gp:[GI:e1185287:g2634068] [LN:BSUB0009] [AC:Z99112:AL009126] [GN:ymdA]
[FN:unknown] [OR:*Bacillus subtilis*] [DB:genpept-bct1] [DE:*Bacillus subtilis*
complete genome (section 9 of 21):from 1598421 to 1807200.] [NT:similar to
hypothetical proteins] [LE:168258] [RE:169820] [DI:direct]

| ORF Name | NT ID | AA ID | NT LN | AA LN | Score | P-Value |
|---|---|---|---|---|---|---|
| AI7503000983__23445463__c3__965 | 462 | 4234 | 801 | 266 | 1002 | 4.9e−101 |

Description
pir:[LN:A69699] [AC:A69699:S09561] [PN:ribosomal protein S2
(rpsB):ribosomal protein BS1] [GN:rpsB] [CL:*Escherichia coli* ribosomal
protein S2] [OR:*Bacillus subtilis*] [DB:pir2] >gp:[GI:e1185240:g2634021]
[LN:BSUB0009] [AC:Z99112:AL009126] [PN:ribosomal protein S2] [GN:rpsB]
[OR:*Bacillus subtilis*] [DB:genpept-bct1] [DE:*Bacillus subtilis* complete
genome (section 9 of 21):from 1598421 to 1807200.] [SP:P21464] [LE:118905]
[RE:119645] [DI:direct]

| ORF Name | NT ID | AA ID | NT LN | AA LN | Score | P-Value |
|---|---|---|---|---|---|---|
| AI7503000983__23472175__c3__975 | 463 | 4235 | 417 | 138 | 360 | 5.3e−33 |

Description
sp:[LN:RBFA__BACSU] [AC:P32731] [GN:RBFA] [OR:*BACILLUS SUBTILIS*]
[DE:RIBOSOME-BINDING FACTOR A (P15B PROTEIN)] [SP:P32731] [DB:swissprot]
>pir:[LN:G36905] [AC:G36905:G69689:S31996] [PN:ribosome-binding factor A
rbfA] [GN:rbfA] [CL:*Escherichia coli* protein P15B] [OR:*Bacillus subtilis*]
[DB:pir2] >gp:[GI:g580902] [LN:BSORF1T7A] [AC:Z18631] [GN:ORF6] [OR:*Bacillus
subtilis*] [DB:genpept-bct1] [DE:*B. subtilis* infB-nusA operon.] [SP:P32731]
[LE:5131] [RE:5484] [DI:direct] >gp:[GI:e1185256:g2634037] [LN:BSUB0009]
[AC:Z99112:AL009126] [PN:ribosome-binding factor A] [GN:rbfA] [OR:*Bacillus
subtilis*] [DB:genpept-bct1] [DE:*Bacillus subtilis* complete genome (section 9
of 21):from 1598421 to 1807200.] [NT:alternate gene name:ymxE, ylxO]
[SP:P32731] [LE:137422] [RE:137775] [DI:direct]

| ORF Name | NT ID | AA ID | NT LN | AA LN | Score | P-Value |
|---|---|---|---|---|---|---|
| AI7503000983__23491077__c1__824 | 464 | 4236 | 1266 | 421 | 1037 | 9.6e−105 |

Description
sp:[LN:DCDA__BACSU] [AC:P23630] [GN:LYSA:LYS] [OR:*BACILLUS SUBTILIS*]
[EC:4.1.1.20] [DE:DIAMINOPIMELATE DECARBOXYLASE, (DAP DECARBOXYLASE)]
[SP:P23630] [DB:swissprot] >gp:[GI:d1013342:g1304007] [LN:BACJH642]
[AC:D84432:D82370] [PN:LysA] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:281375] [RE:282700]
[DI:direct]

| ORF Name | NT ID | AA ID | NT LN | AA LN | Score | P-Value |
|---|---|---|---|---|---|---|
| AI7503000983__23554760__f3__646 | 465 | 4237 | 255 | 84 | 64 | 0.0077 |

Description
gp:[GI:g1123040] [LN:CELF44A2] [AC:U41993] [GN:F44A2.4] [OR:*Caenorhabditis
elegans*] [SR:*Caenorhabditis elegans* strain=Bristol N2] [DB:genpept-inv1]
[DE:*Caenorhabditis elegans* cosmid F44A2.] [NT:similar to C4-type zinc finger
and to *C. elegans*] [LE:11552:11678:12072:12484] [RE:11632:12022:12435:12848]
[DI:direct Join]

| ORF Name | NT ID | AA ID | NT LN | AA LN | Score | P-Value |
|---|---|---|---|---|---|---|
| AI7503000983__23557807__f2__357 | 466 | 4238 | 534 | 177 | 506 | 1.8e−48 |

Description
gp:[GI:e1172770:g2598550] [LN:LLAJ109] [AC:AJ000109] [PN:gluthatione
peroxidase] [GN:gpo] [OR:*Lactococcus lactis*] [DB:genpept-bct1]
[DE:*Lactococcus lactis* carB and gpo genes.] [LE:163] [RE:636] [DI:direct]

| ORF Name | NT ID | AA ID | NT LN | AA LN | Score | P-Value |
|---|---|---|---|---|---|---|

-continued

| ORF Name | | | | | | |
|---|---|---|---|---|---|---|
| AI7503000983_23597802_c2_942 | 467 | 4239 | 144 | 47 | | |

Description
NO-HIT

| ORF Name | NT ID | AA ID | NT LN | AA LN | Score | P-Value |
|---|---|---|---|---|---|---|
| AI7503000983_23632758_c1_723 | 468 | 4240 | 258 | 85 | 79 | 0.037 |

Description
gp:[GI:g882139] [LN:SCU17174] [AC:U17174] [PN:phase-2 flagellin structural protein] [GN:fljB] [OR:*Salmonella choleraesuis*] [DB:genpept-bct2]
[DE:*Salmonella choleraesuis* ATCC 6967 phase-2 flagellin structural protein (fljB) gene, complete cds.] [LE:1] [RE:1521] [DI:direct]

| ORF Name | NT ID | AA ID | NT LN | AA LN | Score | P-Value |
|---|---|---|---|---|---|---|
| AI7503000983_23633467_c2_851 | 469 | 4241 | 987 | 328 | 659 | 1.1e−64 |

Description
pir:[LN:D69692] [AC:D69692] [PN:riboflavin kinase/FAD synthase ribC]
[GN:ribC] [CL:conserved hypothetical protein HI0963] [OR:*Bacillus subtilis*]
[DB:pir2] >gp:[GI:e269877:g1592690] [LN:BSRIBRPS] [AC:Z80835] [PN:FMN
adenylyltransferase] [GN:ribC] [OR:*Bacillus subtilis*] [DB:genpept-bct1]
[DE:*B. subtilis* ribC, rpsO and pnpA genes.] [NT:riboflavin kinase]
[SP:P54575] [LE:88] [RE:1038] [DI:direct] >gp:[GI:e1185258:g2634039]
[LN:BSUB0009] [AC:Z99112:AL009126] [PN:FAD synthase] [GN:ribC]
[FN:riboflavin biosynthesis] [OR:*Bacillus subtilis*] [DB:genpept-bct1]
[EC:2.7.1.26:2.7.7.2] [DE:*Bacillus subtilis* complete genome (section 9 of
21):from 1598421 to 1807200.] [NT:riboflavin kinase] [SP:P54575] [LE:138805]
[RE:139755] [DI:direct]

| ORF Name | NT ID | AA ID | NT LN | AA LN | Score | P-Value |
|---|---|---|---|---|---|---|
| AI7503000983_23650250_c1_729 | 470 | 4242 | 546 | 181 | 667 | 1.6e−65 |

Description
sp:[LN:HSLV_BACSU] [AC:P39070] [GN:HSLV:CLPQ:CODW] [OR:*BACILLUS SUBTILIS*]
[EC:3.4.99.-] [DE:HEAT SHOCK PROTEIN HSLV PRECURSOR,] [SP:P39070]
[DB:swissprot] >pir:[LN:S61494] [AC:S61494:S45024:C69601] [PN:20S
proteasome beta-type chain clpQ:heat shock protein codW] [GN:clpQ:codW]
[OR:*Bacillus subtilis*] [DB:pir2] >gp:[GI:g535349] [LN:BSU13634] [AC:U13634]
[PN:CodW] [GN:codW] [OR:*Bacillus subtilis*] [DB:genpept-bct1] [DE:*Bacillus subtilis* JH642 dipeptide permease operon regulators, codV, codW, codX, and codY genes, complete cds.] [LE:1220] [RE:1765] [DI:direct]
>gp:[GI:e1185206:g2633987] [LN:BSUB0009] [AC:Z99112:AL009126] [PN:beta-type subunit of the 20S proteasome] [GN:clpQ] [OR:*Bacillus subtilis*]
[DB:genpept-bct1] [DE:*Bacillus subtilis* complete genome (section 9 of 21):
from 1598421 to 1807200.] [NT:alternate gene name:hslV, codW] [SP:P39070]
[LE:89093] [RE:89638] [DI:direct]

| ORF Name | NT ID | AA ID | NT LN | AA LN | Score | P-Value |
|---|---|---|---|---|---|---|
| AI7503000983_23650343_c2_949 | 471 | 4243 | 1167 | 388 | 527 | 1.1e−50 |

Description
pir:[LN:G71097] [AC:G71097] [PN:probable amidohydrolase] [GN:PH1043]
[OR:*Pyrococcus horikoshii*] [DB:pir2] >gp:[GI:d1031084:g3257458]
[LN:AP000004]
[AC:AP000004:AB009494:AB009495:AB009496:AB009497:AB009498:AB009499]
[PN:387aa long hypothetical amidohydrolase] [GN:PH1043] [OR:*Pyrococcus horikoshii*] [SR:*Pyrococcus horikoshii* (strain:OT3) DNA] [DB:genpept-bct1]
[DE:*Pyrococcus horikoshii* OT3 genomic DNA, 777001−994000 nt. position(4/7).]
[NT:similar to Swiss_Prot:P80092 percent identity:] [LE:172136] [RE:173299]
[DI:complement]

| ORF Name | NT ID | AA ID | NT LN | AA LN | Score | P-Value |
|---|---|---|---|---|---|---|
| AI7503000983_23671890_c1_807 | 472 | 4244 | 1287 | 428 | 918 | 3.9e−92 |

Description
pir:[LN:A69730] [AC:A69730] [PN:UV-damage repair protein uvrX] [GN:uvrX]
[CL:umuC protein] [OR:*Bacillus subtilis*] [DB:pir2]
>gp:[GI:e1183597:g2634570] [LN:BSUB0012] [AC:Z99115:AL009126] [PN:UV-damage
repair protein] [GN:uvrX] [OR:*Bacillus subtilis*] [DB:genpept-bct1]
[DE:*Bacillus subtilis* complete genome (section 12 of 21):from 2195541 to
2409220.] [NT:alternate gene name:yolE] [LE:74108] [RE:75358]
[DI:complement] >gp:[GI:g3025495] [LN:AF020713] [AC:AF020713]
[PN:IMPB/MUCB/SAMB family protein] [GN:yolE] [OR:Bacteriophage SPBc2]

-continued

[DB:genpept-phg] [DE:Bacteriophage SPBc2 complete genome.] [LE:14792]
[RE:16042] [DI:direct]

| ORF Name | NT ID | AA ID | NT LN | AA LN | Score | P-Value |
|---|---|---|---|---|---|---|
| AI7503000983__23673150__c3__1029 | 473 | 4245 | 1002 | 333 | 1329 | 1.1e−135 |

Description
pir:[LN:C70015] [AC:C70015] [PN:GMP reductase, homolog yumD] [GN:yumD]
[OR:*Bacillus subtilis*] [EC:1.6.6.8] [DB:pir2] >gp:[GI:e1184292:g2635710]
[LN:BSUB0017] [AC:Z99120:AL009126] [GN:yumD] [FN:unknown] [OR:*Bacillus
subtilis*] [DB:genpept-bct1] [DE:*Bacillus subtilis* complete genome (section
17 of 21):from 3197001 to 3414420.] [NT:similar to GMP reductase]
[LE:105099] [RE:106079] [DI:direct] >gp:[GI:e311468:g1934831] [LN:BSZ93939]
[AC:Z93939] [PN:unknown] [GN:yumD] [OR:*Bacillus subtilis*] [DB:genpept-bct1]
[DE:*B. subtilis* genomic DNA fragment from yumA to yulF.] [NT:potential
inosine or guanosine 5' monophosphate] [LE:3536] [RE:4516] [DI:direct]

| ORF Name | NT ID | AA ID | NT LN | AA LN | Score | P-Value |
|---|---|---|---|---|---|---|
| AI7503000983__23725442__f2__230 | 474 | 4246 | 456 | 151 | 97 | 0.0028 |

Description
gp:[GI:g3582212] [LN:AE001272] [AC:AE001272] [PN:Potential membrane spanning
protein] [GN:ORF00031] [OR:*Lactococcus lactis*] [DB:genpept-bct2]
[DE:*Lactococcus lactis* DPC3147 plasmid pMRC01, complete plasmid sequence.]
[NT:similar to GB:Z30588 PID:459257 percent identity:] [LE:25025] [RE:25804]
[DI:complement]

| ORF Name | NT ID | AA ID | NT LN | AA LN | Score | P-Value |
|---|---|---|---|---|---|---|
| AI7503000983__23860952__f3__526 | 475 | 4247 | 516 | 171 | 453 | 7.4e−43 |

Description
sp:[LN:PMSR_BACSU] [AC:P54154] [GN:YPPP] [OR:*BACILLUS SUBTILIS*]
[DE:REDUCTASE)] [SP:P54154] [DB:swissprot] >pir:[LN:E69940] [AC:E69940]
[PN:peptide methionine sulfoxide reductase homolog yppP] [GN:yppP]
[CL:peptide methionine sulfoxide reductase] [OR:*Bacillus subtilis*] [DB:pir2]
>gp:[GI:g1256653] [LN:BACYACA] [AC:L77246] [PN:DNA-binding protein]
[GN:yppP] [OR:*Bacillus subtilis*] [DB:genpept-bct1] [DE:*Bacillus subtilis*
(YAC10-9 clone) DNA region between the serA and kdg loci.] [NT:42.4% identity
with the *Lycopersicon esculentum*] [LE:33389] [RE:33922] [DI:direct]
>gp:[GI:e1183616:g2634589] [LN:BSUB0012] [AC:Z99115:AL009126] [GN:yppP]
[FN:unknown] [OR:*Bacillus subtilis*] [DB:genpept-bct1] [DE:*Bacillus subtilis*
complete genome (section 12 of 21):from 2195541 to 2409220.] [NT:similar to
peptide methionine sulfoxide reductase] [SP:P54154] [LE:91230] [RE:91763]
[DI:complement]

| ORF Name | NT ID | AA ID | NT LN | AA LN | Score | P-Value |
|---|---|---|---|---|---|---|
| AI7503000983__23944052__c1__789 | 476 | 4248 | 378 | 125 | 248 | 1.7e−20 |

Description
sp:[LN:CATB_BACFR] [AC:P45737] [GN:KATB] [OR:*BACTEROIDES FRAGILIS*]
[EC:1.11.1.6] [DE:CATALASE,] [SP:P45737] [DB:swissprot] >pir:[LN:A57262]
[AC:A57262] [PN:catalase,] [GN:katB] [CL:catalase] [OR:*Bacteroides
fragilis*] [EC:1.11.1.6] [DB:pir2] >gp:[GI:g841192] [LN:BFU18676] [AC:U18676]
[PN:catalase] [GN:katB] [FN:decomposes hydrogen peroxide in water and]
[OR:*Bacteroides fragilis*] [DB:genpept-bct2] [EC:1.11.1.6] [DE:*Bacteroides
fragilis* catalase (katB) gene, complete cds.] [LE:348] [RE:1808] [DI:direct]

| ORF Name | NT ID | AA ID | NT LN | AA LN | Score | P-Value |
|---|---|---|---|---|---|---|
| AI7503000983__23992812__c1__793 | 477 | 4249 | 129 | 42 | | |

Description
NO-HIT

| ORF Name | NT ID | AA ID | NT LN | AA LN | Score | P-Value |
|---|---|---|---|---|---|---|
| AI7503000983__24017127__c1__769 | 478 | 4250 | 405 | 134 | 537 | 9.3e−52 |

Description
gp:[GI:g468509] [LN:SAGLNAR] [AC:X76490] [PN:glutamine synthetase repressor]
[GN:glnR] [OR:*Staphylococcus aureus*] [DB:genpept-bct1] [DE:*S. aureus* (bb270)
glnA and glnR genes.] [LE:975] [RE:1343] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000983__24033217__c2__850 | 479 | 4251 | 930 | 309 | 720 | 3.8e−71 |

Description
sp:[LN:TRUB_BACSU] [AC:P32732] [GN:TRUB] [OR:*BACILLUS SUBTILIS*]
[EC:4.2.1.70] [DE:HYDROLYASE)] [SP:P32732] [DB:swissprot] >pir:[LN:G69726]
[AC:G69726:H36905:S31997] [PN:tRNA pseudouridine 5S synthase truB:P35
homolog] [GN:truB] [CL:*Escherichia coli* protein P35] [OR:*Bacillus subtilis*]
[DB:pir2] >gp:[GI:e1185257:g2634038] [LN:BSUB0009] [AC:Z99112:AL009126]
[PN:tRNA pseudouridine 5S synthase] [GN:truB] [OR:*Bacillus subtilis*]
[DB:genpept-bct1] [DE:*Bacillus subtilis* complete genome (section 9 of 21):
from 1598421 to 1807200.] [NT:alternate gene name:ylxN, ymxF] [SP:P32732]
[LE:137857] [RE:138786] [DI:direct]

| ORF Name | NT ID | AA ID | NT LN | AA LN | Score | P-Value |
|---|---|---|---|---|---|---|
| AI7503000983__24078753__c3__999 | 480 | 4252 | 450 | 149 | 295 | 4.1e−26 |

Description
pir:[LN:G69657] [AC:G69657] [PN:tRNA isopentenylpyrophosphate transferase
miaA] [GN:miaA] [CL:delta(2)-isopentenylpyrophosphate transferase]
[OR:*Bacillus subtilis*] [DB:pir2] >gp:[GI:e1183392:g2634117] [LN:BSUB0010]
[AC:Z99113:AL009126] [PN:tRNA isopentenylpyrophosphate transferase]
[GN:miaA] [OR:*Bacillus subtilis*] [DB:genpept-bct1] [DE:*Bacillus subtilis*
complete genome (section 10 of 21):from 1781201 to 2014980.] [LE:84430]
[RE:85374] [DI:direct]

| ORF Name | NT ID | AA ID | NT LN | AA LN | Score | P-Value |
|---|---|---|---|---|---|---|
| AI7503000983__24222137__f2__341 | 481 | 4253 | 159 | 52 | | |

Description
NO-HIT

| ORF Name | NT ID | AA ID | NT LN | AA LN | Score | P-Value |
|---|---|---|---|---|---|---|
| AI7503000983__24225000__f3__475 | 482 | 4254 | 894 | 297 | 360 | 5.3e−33 |

Description
gp:[GI:g2194195] [LN:SGU61158] [AC:U61158] [PN:GdmF] [GN:gdmF]
[OR:*Staphylococcus gallinarum*] [DB:genpept-bct1] [DE:*Staphylococcus
gallinarum* Tue3928 GdmF (gdmF), putative membrane protein (gdmH), ABC
transporter (gdmT), and antibiotic gallidermin precursor (gdmA) genes,
complete cds, putative membrane protein(gdmE) and modifying enzyme (gdmB)
genes, partial cds.] [NT:proposed ABC transporter subunit (ATP-binding]
[LE:179] [RE:874] [DI:complement]

| ORF Name | NT ID | AA ID | NT LN | AA LN | Score | P-Value |
|---|---|---|---|---|---|---|
| AI7503000983__24225053__c3__1031 | 483 | 4255 | 318 | 105 | 202 | 2.9e−16 |

Description
pir:[LN:E69894] [AC:E69894] [PN:hypothetical protein ynzC] [GN:ynzC]
[OR:*Bacillus subtilis*] [DB:pir2] >gp:[GI:e1183447:g2634172] [LN:BSUB0010]
[AC:Z99113:AL009126] [GN:ynzC] [FN:unknown] [OR:*Bacillus subtilis*]
[DB:genpept-bct1] [DE:*Bacillus subtilis* complete genome (section 10 of 21):
from 1781201 to 2014980.] [LE:137514] [RE:137747] [DI:direct]

| ORF Name | NT ID | AA ID | NT LN | AA LN | Score | P-Value |
|---|---|---|---|---|---|---|
| AI7503000983__24251466__c1__799 | 484 | 4256 | 2745 | 914 | 3437 | 0.0 |

Description
sp:[LN:ACON_BACSU] [AC:P09339:Q45059] [GN:CITB] [OR:*BACILLUS SUBTILIS*]
[EC:4.2.1.3] [DE:ACONITATE HYDRATASE, (CITRATE HYDRO-LYASE) (ACONITASE)]
[SP:P09339:Q45059] [DB:swissprot]

| ORF Name | NT ID | AA ID | NT LN | AA LN | Score | P-Value |
|---|---|---|---|---|---|---|
| AI7503000983__24257252__c1__727 | 485 | 4257 | 177 | 58 | | |

Description
NO-HIT

| ORF Name | NT ID | AA ID | NT LN | AA LN | Score | P-Value |
|---|---|---|---|---|---|---|
| AI7503000983__24267941__c1__745 | 486 | 4258 | 726 | 241 | 304 | 4.5e−27 |

Description
sp:[LN:YMFC_BACSU] [AC:O31761] [GN:YMFC] [OR:*BACILLUS SUBTILIS*] [DE:REGION]

-continued

[SP:O31761] [DB:swissprot] >pir:[LN:B69885] [AC:B69885] [PN:transcription regulator GntR family homolog ymfC] [GN:ymfC] [OR:*Bacillus subtilis*] [DB:pir2] >gp:[GI:e1185272:g2634053] [LN:BSUB0009] [AC:Z99112:AL009126] [GN:ymfC] [FN:unknown] [OR:*Bacillus subtilis*] [DB:genpept-bct1] [DE:*Bacillus subtilis* complete genome (section 9 of 21):from 1598421 to 1807200.] [NT:similar to transcriptional regulator (GntR family)] [SP:O31761] [LE:155754] [RE:156479] [DI:direct]

| ORF Name | NT ID | AA ID | NT LN | AA LN | Score | P-Value |
|---|---|---|---|---|---|---|
| AI7503000983_24267942_c1_823 | 487 | 4259 | 1089 | 362 | 300 | 1.2e−26 |

Description
sp:[LN:ALR_BACSU] [AC:P10725:P96620] [GN:ALR:DAL] [OR:*BACILLUS SUBTILIS*] [EC:5.1.1.1] [DE:ALANINE RACEMASE,] [SP:P10725:P96620] [DB:swissprot] >gp:[GI:d1020054:g1881274] [LN:AB001488] [AC:AB001488] [PN:ALANINE RACEMASE] [GN:alr] [OR:*Bacillus subtilis*] [SR:*Bacillus subtilis* (strain:168) DNA] [DB:genpept-bct1] [EC:5.1.1.1] [DE:*Bacillus subtilis* genome sequence, 148 kb sequence of the region between 35 and 47 degree.] [LE:50435] [RE:51604] [DI:direct] >gp:[GI:e1182430:g2632764] [LN:BSUB0003] [AC:Z99106:AL009126] [PN:D-alanine racemase] [GN:dal] [OR:*Bacillus subtilis*] [DB:genpept-bct1] [EC:5.1.1.1] [DE:*Bacillus subtilis* complete genome (section 3 of 21):from 402751 to 611850.] [NT:alternate gene name:alr] [SP:P10725] [LE:114179] [RE:115348] [DI:direct]

| ORF Name | NT ID | AA ID | NT LN | AA LN | Score | P-Value |
|---|---|---|---|---|---|---|
| AI7503000983_24275017_c2_856 | 488 | 4260 | 144 | 47 | | |

Description
NO-HIT

| ORF Name | NT ID | AA ID | NT LN | AA LN | Score | P-Value |
|---|---|---|---|---|---|---|
| AI7503000983_24352200_f3_600 | 489 | 4261 | 1095 | 364 | 674 | 2.8e−66 |

Description
pir:[LN:T02833] [AC:T02833] [PN:hypothetical protein L4171.5] [OR:*Leishmania major*] [DB:pir2] [MP:1] >gp:[GI:g2266911] [LN:AE001274] [AC:AE001274:AC003011:AC002552:U60409:AF008205:AC002134:AF008206:U7 0253] [PN:L4171.5] [GN:L4171.5] [OR:*Leishmania major*] [DB:genpept-inv2] [DE:*Leishmania major* chromosome 1, complete sequence.] [NT:similar to threonine aldolase; leucine zipper] [LE:124709] [RE:125788] [DI:direct]

| ORF Name | NT ID | AA ID | NT LN | AA LN | Score | P-Value |
|---|---|---|---|---|---|---|
| AI7503000983_24407758_f3_696 | 490 | 4262 | 129 | 42 | | |

Description
NO-HIT

| ORF Name | NT ID | AA ID | NT LN | AA LN | Score | P-Value |
|---|---|---|---|---|---|---|
| AI7503000983_24412811_c3_997 | 491 | 4263 | 957 | 318 | 147 | 4.4e−11 |

Description
pir:[LN:T02661] [AC:T02661] [PN:lysophospholipase homolog] [GN:LPL1] [OR:*Oryza sativa*] [SR:, rice] [DB:pir2] >gp:[GI:g2801536] [LN:AF039531] [AC:AF039531] [PN:lysophospholipase homolog] [GN:LPL1] [OR:*Oryza sativa*] [DB:genpept-pln2] [DE:*Oryza sativa* lysophospholipase homolog (LPL1) mRNA, complete cds.] [LE:46] [RE:960] [DI:direct]

| ORF Name | NT ID | AA ID | NT LN | AA LN | Score | P-Value |
|---|---|---|---|---|---|---|
| AI7503000983_24414187_c3_1003 | 492 | 4264 | 396 | 131 | 74 | 0.011 |

Description
gp:[GI:g42727] [LN:ECRHAT] [AC:X60699] [GN:sodA] [OR:*Escherichia coli*] [DB:genpept-bct1] [DE:*E. coli* rhaT gene for L-rhamnose permease, rhaC (3' end) and sodA(5' end) genes.] [SP:P00448] [LE:<1] [RE:288] [DI:complement]

| ORF Name | NT ID | AA ID | NT LN | AA LN | Score | P-Value |
|---|---|---|---|---|---|---|
| AI7503000983_24414818_c1_738 | 493 | 4265 | 870 | 289 | 952 | 9.8e−96 |

Description
gp:[GI:e1185251:g2634032] [LN:BSUB0009] [AC:Z99112:AL009126] [GN:nusA] [FN:transcription termination] [OR:*Bacillus subtilis*] [DB:genpept-bct1] [DE:*Bacillus subtilis* complete genome (section 9 of 21):from 1598421 to -continued 1807200.] [LE:133252] [RE:134367] [DI:direct]

| ORF Name | NT ID | AA ID | NT LN | AA LN | Score | P-Value |
|---|---|---|---|---|---|---|
| AI7503000983__24415933__c3__1078 | 494 | 4266 | 153 | 51 | | |

Description
NO-HIT

| ORF Name | NT ID | AA ID | NT LN | AA LN | Score | P-Value |
|---|---|---|---|---|---|---|
| AI7503000983__24417512__f3__505 | 495 | 4267 | 135 | 44 | | |

Description
NO-HIT

| ORF Name | NT ID | AA ID | NT LN | AA LN | Score | P-Value |
|---|---|---|---|---|---|---|
| AI7503000983__24470927__f2__358 | 496 | 4268 | 138 | 45 | | |

Description
NO-HIT

| ORF Name | NT ID | AA ID | NT LN | AA LN | Score | P-Value |
|---|---|---|---|---|---|---|
| AI7503000983__24475252__c3__1052 | 497 | 4269 | 126 | 41 | | |

Description
NO-HIT

| ORF Name | NT ID | AA ID | NT LN | AA LN | Score | P-Value |
|---|---|---|---|---|---|---|
| AI7503000983__24484683__c3__1041 | 498 | 4270 | 129 | 42 | | |

Description
NO-HIT

| ORF Name | NT ID | AA ID | NT LN | AA LN | Score | P-Value |
|---|---|---|---|---|---|---|
| AI7503000983__24492827__f1__223 | 499 | 4271 | 2601 | 866 | 1069 | 3.9e−108 |

Description
pir:[LN:G69801] [AC:G69801] [PN:hypothetical protein yfhO] [GN:yfhO]
[OR:*Bacillus subtilis*] [DB:pir2] >gp:[GI:e1182850:g2633184] [LN:BSUB0005]
[AC:Z99108:AL009126] [GN:yfhO] [FN:unknown] [OR:*Bacillus subtilis*]
[DB:genpept-bct1] [DE:*Bacillus subtilis* complete genome (section 5 of 21):
from 802821 to 1011250.] [LE:128691] [RE:131150] [DI:direct]
>gp:[GI:d1025397:g2804545] [LN:D85082] [AC:D85082] [PN:YfhO] [OR:*Bacillus
subtilis*] [SR:*Bacillus subtilis* DNA] [DB:genpept-bct1] [DE:*Bacillus subtilis*
DNA, genome sequence, 79 to 81 degree region.] [LE:21582] [RE:24041]
[DI:direct]

| ORF Name | NT ID | AA ID | NT LN | AA LN | Score | P-Value |
|---|---|---|---|---|---|---|
| AI7503000983__24495928__c1__772 | 500 | 4272 | 210 | 69 | 70 | 0.028 |

Description
pir:[LN:G69058] [AC:G69058] [PN:hypothetical protein MTH1440] [GN:MTH1440]
[OR:*Methanobacterium thermoautotrophicum*] [DB:pir2] >gp:[GI:g2622552]
[LN:AE000905] [AC:AE000905:AE000666] [PN:unknown] [GN:MTH1440]
[OR:*Methanobacterium thermoautotrophicum*] [DB:genpept-bct2]
[DE:*Methanobacterium thermoautotrophicum* from bases 1293944 to
1305586(section 111 of 148) of the complete genome.] [NT:Function Code:14.00-
Unknown,; similar to,] [LE:7011] [RE:7214] [DI:direct]

| ORF Name | NT ID | AA ID | NT LN | AA LN | Score | P-Value |
|---|---|---|---|---|---|---|
| AI7503000983__2459667__c1__796 | 501 | 4273 | 174 | 57 | | |

Description
NO-HIT

| ORF Name | NT ID | AA ID | NT LN | AA LN | Score | P-Value |
|---|---|---|---|---|---|---|
| AI7503000983__24631637__c3__1002 | 502 | 4274 | 708 | 235 | 236 | 7.3e−20 |

Description
gp:[GI:g2444107] [LN:U88974] [AC:U88974] [PN:ORF28] [OR:*Streptococcus
thermophilus* temperate bacteriophage O1205] [DB:genpept-phg]

-continued

[DE:*Streptococcus thermophilus* temperate bacteriophage O1205,
complete genome.] [LE:17062] [RE:17955] [DI:direct]

| ORF Name | NT ID | AA ID | NT LN | AA LN | Score | P-Value |
|---|---|---|---|---|---|---|
| AI7503000983__24640925__c3__1037 | 503 | 4275 | 1272 | 423 | 1288 | 2.4e−131 |

Description
sp:[LN:OPUD_BACSU] [AC:P54417] [GN:OPUD] [OR:*BACILLUS SUBTILIS*] [DE:GLYCINE
BETAINE TRANSPORTER OPUD] [SP:P54417] [DB:swissprot] >pir:[LN:G69670]
[AC:G69670] [PN:glycine betaine transporter opuD] [GN:opuD] [OR:*Bacillus
subtilis*] [DB:pir2] >gp:[GI:e1185880:g2635491] [LN:BSUB0016]
[AC:Z99119:AL009126] [PN:glycine betaine transporter] [GN:opuD]
[FN:osmoprotection] [OR:*Bacillus subtilis*] [DB:genpept-bct1] [DE:*Bacillus
subtilis* complete genome (section 16 of 21):from 2997771 to 3213410.]
[NT:alternate gene name:ytfQ] [SP:P54417] [LE:78128] [RE:79666] [DI:direct]
>gp:[GI:g2293330] [LN:AF008220] [AC:AF008220] [PN:putative transporter]
[GN:opuD] [OR:*Bacillus subtilis*] [DB:genpept-bct2] [DE:*Bacillus subtilis*
rrnB-dnaB genomic region.] [LE:100760] [RE:102298] [DI:complement]
>gp:[GI:g1524397] [LN:BSU50082] [AC:U50082] [PN:glycine betaine transporter
OpuD] [GN:opuD] [OR:*Bacillus subtilis*] [DB:genpept-bct2] [DE:*Bacillus
subtilis* glycine betaine transporter OpuD (opuD) gene, complete cds.]
[LE:460] [RE:1998] [DI:direct]

| ORF Name | NT ID | AA ID | NT LN | AA LN | Score | P-Value |
|---|---|---|---|---|---|---|
| AI7503000983__24647176__c2__928 | 504 | 4276 | 771 | 256 | 128 | 4.7e−06 |

Description
gp:[GI:g4981173] [LN:AE001738] [AC:AE001738:AE000512] [PN:conserved
hypothetical protein] [GN:TM0651] [OR:*Thermotoga maritima*] [DB:genpept-bct2]
[DE:*Thermotoga maritima* section 50 of 136 of the complete genome.]
[NT:similar to PID:1653547 percent identity:52.43;] [LE:13445] [RE:14251]
[DI:complement]

| ORF Name | NT ID | AA ID | NT LN | AA LN | Score | P-Value |
|---|---|---|---|---|---|---|
| AI7503000983__24647182__c1__821 | 505 | 4277 | 729 | 242 | 232 | 3.9e−33 |

Description
gp:[GI:g4982086] [LN:AE001799] [AC:AE001799:AE000512]
[PN:dihydrodipicolinate reductase] [GN:TM1520] [OR:*Thermotoga maritima*]
[DB:genpept-bct2] [DE:*Thermotoga maritima* section 111 of 136 of the complete
genome.] [NT:similar to PID:1185002 percent identity:62.67;] [LE:16971]
[RE:17621] [DI:complement]

| ORF Name | NT ID | AA ID | NT LN | AA LN | Score | P-Value |
|---|---|---|---|---|---|---|
| AI7503000983__24659382__c2__890 | 506 | 4278 | 126 | 41 | | |

Description
NO-HIT

| ORF Name | NT ID | AA ID | NT LN | AA LN | Score | P-Value |
|---|---|---|---|---|---|---|
| AI7503000983__24666043__c1__803 | 507 | 4279 | 1233 | 410 | 866 | 1.3e−86 |

Description
pir:[LN:D70006] [AC:D70006] [PN:conserved hypothetical protein yubA]
[GN:yubA] [CL:*Bacillus subtilis* conserved hypothetical protein yueF]
[OR:*Bacillus subtilis*] [DB:pir2] >gp:[GI:e1185989:g2635600] [LN:BSUB0016]
[AC:Z99119:AL009126] [GN:yubA] [FN:unknown] [OR:*Bacillus subtilis*]
[DB:genpept-bct1] [DE:*Bacillus subtilis* complete genome (section 16 of 21):
from 2997771 to 3213410.] [NT:similar to hypothetical proteins] [LE:196858]
[RE:198024] [DI:complement]

| ORF Name | NT ID | AA ID | NT LN | AA LN | Score | P-Value |
|---|---|---|---|---|---|---|
| AI7503000983__24744010__c3__1028 | 508 | 4280 | 273 | 90 | 347 | 1.3e−31 |

Description
pir:[LN:F69835] [AC:F69835] [PN:ribosomal protein S14 homolog yhzA]
[GN:yhzA] [CL:*Escherichia coli* ribosomal protein S14] [OR:*Bacillus
subtilis*] [DB:pir2] >gp:[GI:e1182877:g2633211] [LN:BSUB0005]
[AC:Z99108:AL009126] [GN:yhzA] [FN:unknown] [OR:*Bacillus subtilis*]
[DB:genpept-bct1] [DE:*Bacillus subtilis* complete genome (section 5 of 21):
from 802821 to 1011250.] [NT:similar to ribosomal protein S14] [LE:162598]
[RE:162867] [DI:direct]

-continued

| ORF Name | NT ID | AA ID | NT LN | AA LN | Score | P-Value |
|---|---|---|---|---|---|---|
| AI7503000983_24792776_c2_846 | 509 | 4281 | 528 | 175 | 371 | 3.6e−34 |

Description
sp:[LN:YLXS_BACSU] [AC:P32726] [GN:YLXS] [OR:*BACILLUS SUBTILIS*]
[DE:HYPOTHETICAL 17.6 KD PROTEIN IN NUSA 5' REGION (P15A) (ORF1)] [SP:P32726]
[DB:swissprot] >pir:[LN:B36905] [AC:B36905:E69882:S31990] [PN:conserved
hypothetical protein ylxS] [GN:ylxS] [CL:nus operon 15K protein]
[OR:*Bacillus subtilis*] [DB:pir2] >gp:[GI:g49315] [LN:BSORF1T7A] [AC:Z18631]
[GN:ORF1] [OR:*Bacillus subtilis*] [DB:genpept-bct1] [DE:*B. subtilis* infB-nusA
operon.] [SP:P32726] [LE:456] [RE:926] [DI:direct]
>gp:[GI:e1185250:g2634031] [LN:BSUB0009] [AC:Z99112:AL009126] [GN:ylxS]
[FN:unknown] [OR:*Bacillus subtilis*] [DB:genpept-bct1] [DE:*Bacillus subtilis*
complete genome (section 9 of 21):from 1598421 to 1807200.] [NT:alternate
gene name:ymxA; similar to hypothetical] [SP:P32726] [LE:132747]
[RE:133217] [DI:direct]

| ORF Name | NT ID | AA ID | NT LN | AA LN | Score | P-Value |
|---|---|---|---|---|---|---|
| AI7503000983_24823377_f3_498 | 510 | 4282 | 912 | 303 | 462 | 8.2e−44 |

Description
pir:[LN:E69840] [AC:E69840] [PN:hypothetical protein yitL] [GN:yitL]
[OR:*Bacillus subtilis*] [DB:pir2] >gp:[GI:e1183105:g2633439] [LN:BSUB0006]
[AC:Z99109:AL009126] [GN:yitL] [FN:unknown] [OR:*Bacillus subtilis*]
[DB:genpept-bct1] [DE:*Bacillus subtilis* complete genome (section 6 of 21):
from 999501 to 1209940.] [LE:181473] [RE:182369] [DI:direct]

| ORF Name | NT ID | AA ID | NT LN | AA LN | Score | P-Value |
|---|---|---|---|---|---|---|
| AI7503000983_24877312_f1_105 | 511 | 4283 | 1392 | 463 | 1093 | 1.1e−110 |

Description
pir:[LN:A69763] [AC:A69763] [PN:homoserine dehydrogenase homolog yclM]
[GN:yclM] [CL:aspartate kinase homology] [OR:*Bacillus subtilis*] [DB:pir2]
>gp:[GI:e1182346:g2632680] [LN:BSUB0003] [AC:Z99106:AL009126] [GN:yclM]
[FN:unknown] [OR:*Bacillus subtilis*] [DB:genpept-bct1] [DE:*Bacillus subtilis*
complete genome (section 3 of 21):from 402751 to 611850.] [NT:similar to
homoserine dehydrogenase] [LE:27453] [RE:28817] [DI:complement]
>gp:[GI:d1009646:g1805449] [LN:D50453] [AC:D50453] [PN:homologue of
aspartokinase 2 alpha and beta] [GN:yclM] [OR:*Bacillus subtilis*]
[SR:*Bacillus subtilis* (strain:168 trpC2) DNA] [DB:genpept-bct1] [DE:*Bacillus
subtilis* DNA for 25–36 degree region containing theamyE-srfA region,
complete cds.] [LE:109856] [RE:111220] [DI:complement]

| ORF Name | NT ID | AA ID | NT LN | AA LN | Score | P-Value |
|---|---|---|---|---|---|---|
| AI7503000983_24886550_c1_741 | 512 | 4284 | 288 | 95 | 350 | 6.1e−32 |

Description
pir:[LN:F69700] [AC:F69700:S11365:S70690] [PN:ribosomal protein S15
(rpsO):ribosomal protein BS18] [GN:rpsO] [CL:*Escherichia coli* ribosomal
protein S15:eubacterial ribosomal protein S15 homology] [OR:*Bacillus
subtilis*] [DB:pir2] >gp:[GI:e269878:g1592691] [LN:BSRIBRPS] [AC:Z80835]
[PN:ribosomal protein S15] [GN:rpsO] [OR:*Bacillus subtilis*]
[DB:genpept-bct1] [DE:*B. subtilis* ribC, rpsO and pnpA genes.] [SP:P21473]
[LE:1195] [RE:1464] [DI:direct] >gp:[GI:e1185259:g2634040] [LN:BSUB0009]
[AC:Z99112:AL009126] [PN:ribosomal protein S15 (BS18)] [GN:rpsO]
[OR:*Bacillus subtilis*] [DB:genpept-bct1] [DE:*Bacillus subtilis* complete
genome (section 9 of 21):from 1598421 to 1807200.] [SP:P21473] [LE:139912]
[RE:140181] [DI:direct]

| ORF Name | NT ID | AA ID | NT LN | AA LN | Score | P-Value |
|---|---|---|---|---|---|---|
| AI7503000983_24886677_c3_971 | 513 | 4285 | 1722 | 573 | 1885 | 1.3e−194 |

Description
pir:[LN:G69682] [AC:G69682] [PN:proline--tRNA ligase, proS:prolyl-tRNA
synthetase] [GN:proS] [CL:proline--tRNA ligase] [OR:*Bacillus subtilis*]
[EC:6.1.1.15] [DB:pir2] >gp:[GI:e1185248:g2634029] [LN:BSUB0009]
[AC:Z99112:AL009126] [PN:prolyl-tRNA synthetase] [GN:proS] [OR:*Bacillus
subtilis*] [DB:genpept-bct1] [DE:*Bacillus subtilis* complete genome (section 9
of 21):from 1598421 to 1807200.] [LE:126301] [RE:127995] [DI:direct]

| ORF Name | NT ID | AA ID | NT LN | AA LN | Score | P-Value |
|---|---|---|---|---|---|---|
| AI7503000983_24900332_c2_870 | 514 | 4286 | 981 | 326 | 935 | 6.2e−94 |

-continued

Description
sp:[LN:MUTL_BACSU] [AC:P49850] [GN:MUTL] [OR:*BACILLUS SUBTILIS*] [DE:DNA
MISMATCH REPAIR PROTEIN MUTL] [SP:P49850] [DB:swissprot] >pir:[LN:A69663]
[AC:A69663] [PN:DNA mismatch repair mutL] [GN:mutL] [CL:mismatch repair
protein hexB] [OR:*Bacillus subtilis*] [DB:pir2] >gp:[GI:g1002521]
[LN:BSU27343] [AC:U27343] [PN:MutL] [GN:mutL] [FN:mismatch-repair
recognition] [OR:*Bacillus subtilis*] [DB:genpept-bct1] [DE:*Bacillus subtilis*
spore coat protein (cotE) gene, partial cds, and mismatch repair recognition
proteins (mutS) and (mutL) genes, complete cds.] [LE:2782] [RE:4665]
[DI:direct] >gp:[GI:e1185296:g2634077] [LN:BSUB0009] [AC:Z99112:AL009126]
[GN:mutL] [FN:DNA mismatch repair] [OR:*Bacillus subtilis*] [DB:genpept-bct1]
[DE:*Bacillus subtilis* complete genome (section 9 of 21):from 1598421 to
1807200.] [SP:P49850] [LE:179285] [RE:181168] [DI:direct]

| ORF Name | NT ID | AA ID | NT LN | AA LN | Score | P-Value |
| --- | --- | --- | --- | --- | --- | --- |
| AI7503000983_25445253_c3_1039 | 515 | 4287 | 495 | 164 | 336 | 1.8e−30 |

Description
pir:[LN:F69891] [AC:F69891] [PN:conserved hypothetical protein yneP]
[GN:yneP] [OR:*Bacillus subtilis*] [DB:pir2] >gp:[GI:e249652:g1405456]
[LN:BC170DEGR] [AC:Z73234] [PN:YneP] [GN:yneP] [OR:*Bacillus subtilis*]
[DB:genpept-bct1] [DE:*B. subtilis* DNA (26.2 kb fragment; 170 degree region).]
[LE:12510] [RE:12875] [DI:direct] >gp:[GI:e1183462:g2634187] [LN:BSUB0010]
[AC:Z99113:AL009126] [GN:yneP] [FN:unknown] [OR:*Bacillus subtilis*]
[DB:genpept-bct1] [DE:*Bacillus subtilis* complete genome (section 10 of 21):
from 1781201 to 2014980.] [NT:similar to hypothetical proteins] [LE:148889]
[RE:149254] [DI:direct]

| ORF Name | NT ID | AA ID | NT LN | AA LN | Score | P-Value |
| --- | --- | --- | --- | --- | --- | --- |
| AI7503000983_25449061_c1_780 | 516 | 4288 | 249 | 82 | 191 | 4.3e−15 |

Description
pir:[LN:D69901] [AC:D69901] [PN:two-component response regulator [YocF]
homolog yocG] [GN:yocG] [CL:regulatory protein comA:response regulator
homology] [OR:*Bacillus subtilis*] [DB:pir2] >gp:[GI:g2619014] [LN:AF027868]
[AC:AF027868] [PN:sensor regulator] [GN:yocG] [OR:*Bacillus subtilis*]
[DB:genpept-bct1] [DE:*Bacillus subtilis* chromosome region between terC and
odhAB.] [NT:similar to *B. subtilis* Spo0A protein (267 aa)] [LE:71699]
[RE:72298] [DI:direct] >gp:[GI:e1185392:g2634313] [LN:BSUB0011]
[AC:Z99114:AL009126] [GN:yocG] [FN:unknown] [OR:*Bacillus subtilis*]
[DB:genpept-bct1] [DE:*Bacillus subtilis* complete genome (section 11 of 21):
from 2000171 to 2207900.] [NT:similar to two-component response regulator
[YocF] [LE:90790] [RE:91389] [DI:direct]

| ORF Name | NT ID | AA ID | NT LN | AA LN | Score | P-Value |
| --- | --- | --- | --- | --- | --- | --- |
| AI7503000983_25578140_f3_612 | 517 | 4289 | 132 | 43 | | |

Description
NO-HIT

| ORF Name | NT ID | AA ID | NT LN | AA LN | Score | P-Value |
| --- | --- | --- | --- | --- | --- | --- |
| AI7503000983_25587942_c3_956 | 518 | 4290 | 786 | 261 | 556 | 9.0e−54 |

Description
pir:[LN:C69693] [AC:C69693] [PN:ribonuclease H rnh] [GN:rnh]
[CL:ribonuclease HII] [OR:*Bacillus subtilis*] [DB:pir2]
>gp:[GI:e1185197:g2633978] [LN:BSUB0009] [AC:Z99112:AL009126]
[PN:ribonuclease H] [GN:rnh] [OR:*Bacillus subtilis*] [DB:genpept-bct1]
[EC:3.1.26.4] [DE:*Bacillus subtilis* complete genome (section 9 of 21):from
1598421 to 1807200.] [LE:78430] [RE:79197] [DI:direct]

| ORF Name | NT ID | AA ID | NT LN | AA LN | Score | P-Value |
| --- | --- | --- | --- | --- | --- | --- |
| AI7503000983_25593925_f1_166 | 519 | 4291 | 153 | 50 | | |

Description
NO-HIT

| ORF Name | NT ID | AA ID | NT LN | AA LN | Score | P-Value |
| --- | --- | --- | --- | --- | --- | --- |
| AI7503000983_25626625_c2_891 | 520 | 4292 | 636 | 211 | | |

Description
NO-HIT

-continued

| ORF Name | NT ID | AA ID | NT LN | AA LN | Score | P-Value |
|---|---|---|---|---|---|---|
| AI7503000983_25664512_c2_915 | 521 | 4293 | 495 | 164 | 279 | 2.0e−24 |

Description
pir:[LN:A69805] [AC:A69805] [PN:hypothetical protein yfiW] [GN:yfiW]
[OR:*Bacillus subtilis*] [DB:pir2] >gp:[GI:e1182832:g2633166] [LN:BSUB0005]
[AC:Z99108:AL009126] [GN:yfiW] [FN:unknown] [OR:*Bacillus subtilis*]
[DB:genpept-bct1] [DE:*Bacillus subtilis* complete genome (section 5 of 21):
from 802821 to 1011250.] [LE:113464] [RE:114240] [DI:direct]
>gp:[GI:d1025379:g2804527] [LN:D85082] [AC:D85082] [PN:YfiW] [OR:*Bacillus
subtilis*] [SR:*Bacillus subtilis* DNA] [DB:genpept-bct1] [DE:*Bacillus subtilis*
DNA, genome sequence, 79 to 81 degree region.] [LE:6355] [RE:7131]
[DI:direct]

| ORF Name | NT ID | AA ID | NT LN | AA LN | Score | P-Value |
|---|---|---|---|---|---|---|
| AI7503000983_25665937_c3_968 | 522 | 4294 | 558 | 185 | 841 | 5.7e−84 |

Description
sp:[LN:RRF_STAAU] [AC:O33276] [GN:FRR] [OR:*STAPHYLOCOCCUS AUREUS*]
[DE:PROBABLE RIBOSOME RECYCLING FACTOR (RIBOSOME RELEASING FACTOR) (RRF)]
[SP:O33276] [DB:swissprot] >gp:[GI:g2645713] [LN:AF033018] [AC:AF033018]
[PN:ribosome recycling factor] [GN:frr] [OR:*Staphylococcus aureus*]
[DB:genpept-bct2] [DE:*Staphylococcus aureus* ribosome recycling factor (frr)
gene, complete cds.] [LE:1] [RE:555] [DI:direct]

| ORF Name | NT ID | AA ID | NT LN | AA LN | Score | P-Value |
|---|---|---|---|---|---|---|
| AI7503000983_257837_c3_1013 | 523 | 4295 | 174 | 57 | 87 | 0.0045 |

Description
gp:[GI:g2668605] [LN:AF015453] [AC:AF015453] [PN:unknown] [OR:*Lactobacillus
rhamnosus*] [DB:genpept-bct2] [DE:*Lactobacillus rhamnosus*
6-phospho-beta-glucosidase homolog gene, partial cds; GNTR transcriptional
regulator homolog and surface located protein genes, complete cds.]
[NT:3.0E-ORF-1] [LE:2236] [RE:>3603] [DI:complement]

| ORF Name | NT ID | AA ID | NT LN | AA LN | Score | P-Value |
|---|---|---|---|---|---|---|
| AI7503000983_25977318_c3_1044 | 524 | 4296 | 2415 | 804 | 3470 | 0.0 |

Description
sp:[LN:PARC_STAAU] [AC:P50073:P95682:P95683] [GN:PARC:GRLA]
[OR:*STAPHYLOCOCCUS AUREUS*] [EC:5.99.1.-] [DE:TOPOISOMERASE IV SUBUNIT A,]
[SP:P50073:P95682:P95683] [DB:swissprot] >gp:[GI:d1011747:g1777321]
[LN:D67075] [AC:D67075] [PN:DNA topoisomerase IV GrlA subunit] [GN:grlA]
[OR:*Staphylococcus aureus*] [SR:*Staphylococcus aureus* (isolate:RN4220) DNA]
[DB:genpept-bct1] [DE:*Staphylococcus aureus* DNA for DNA topoisomerase IV
GrlB subunit, DNA topoisomerase IV GrlA subunit, complete cds.] [LE:2376]
[RE:4778] [DI:direct]

| ORF Name | NT ID | AA ID | NT LN | AA LN | Score | P-Value |
|---|---|---|---|---|---|---|
| AI7503000983_26205387_f2_331 | 525 | 4297 | 336 | 111 | | |

Description
NO-HIT

| ORF Name | NT ID | AA ID | NT LN | AA LN | Score | P-Value |
|---|---|---|---|---|---|---|
| AI7503000983_26210925_c3_1032 | 526 | 4298 | 2028 | 675 | 2097 | 4.5e−217 |

Description
sp:[LN:TKT_BACSU] [AC:P45694] [GN:TKT:TKTA] [OR:*BACILLUS SUBTILIS*]
[EC:2.2.1.1] [DE:TRANSKETOLASE,] [SP:P45694] [DB:swissprot] >pir:[LN:G69723]
[AC:G69723:S57401] [PN:transketolase, tkt] [GN:tkt]
[CL:transketolase:thiamine pyrophosphate-binding domain homology]
[OR:*Bacillus subtilis*] [EC:2.2.1.1] [DB:pir2] >gp:[GI:e249642:g1405446]
[LN:BC170DEGR] [AC:Z73234] [PN:transketolase] [GN:tktA] [OR:*Bacillus
subtilis*] [DB:genpept-bct1] [DE:*B. subtilis* DNA (26.2 kb fragment; 170 degree
region).] [SP:P45694] [LE:1537] [RE:3540] [DI:direct]
>gp:[GI:e1183448:g2634173] [LN:BSUB0010] [AC:Z99113:AL009126]
[PN:transketolase] [GN:tkt] [FN:pentose phosphate] [OR:*Bacillus subtilis*]
[DB:genpept-bct1] [EC:2.2.1.1] [DE:*Bacillus subtilis* complete genome
(section 10 of 21):from 1781201 to 2014980.] [NT:alternate gene name:tktA]
[SP:P45694] [LE:137916] [RE:139919] [DI:direct]

-continued

| ORF Name | NT ID | AA ID | NT LN | AA LN | Score | P-Value |
|---|---|---|---|---|---|---|
| AI7503000983__26213890_c3__1026 | 527 | 4299 | 699 | 232 | 757 | 4.5e−75 |

Description
gp:[GI:e313391:g2052219] [LN:SCDNACAT] [AC:X96981] [PN:catalase] [GN:catA]
[OR:*Streptomyces coelicolor*] [DB:genpept-bct1] [DE:*S. coelicolor* catA gene.]
[LE:392] [RE:1858] [DI:direct]

| ORF Name | NT ID | AA ID | NT LN | AA LN | Score | P-Value |
|---|---|---|---|---|---|---|
| AI7503000983__26257806_c3__993 | 528 | 4300 | 984 | 327 | 707 | 9.0e−70 |

Description
sp:[LN:MUTL_BACSU] [AC:P49850] [GN:MUTL] [OR:*BACILLUS SUBTILIS*] [DE:DNA
MISMATCH REPAIR PROTEIN MUTL] [SP:P49850] [DB:swissprot] >pir:[LN:A69663]
[AC:A69663] [PN:DNA mismatch repair mutL] [GN:mutL] [CL:mismatch repair
protein hexB] [OR:*Bacillus subtilis*] [DB:pir2] >gp:[GI:g1002521]
[LN:BSU27343] [AC:U27343] [PN:MutL] [GN:mutL] [FN:mismatch-repair
recognition] [OR:*Bacillus subtilis*] [DB:genpept-bct1] [DE:*Bacillus subtilis*
spore coat protein (cotE) gene, partial cds, and mismatch repair recognition
proteins (mutS) and (mutL) genes, complete cds.] [LE:2782] [RE:4665]
[DI:direct] >gp:[GI:e1185296:g2634077] [LN:BSUB0009] [AC:Z99112:AL009126]
[GN:mutL] [FN:DNA mismatch repair] [OR:*Bacillus subtilis*] [DB:genpept-bct1]
[DE:*Bacillus subtilis* complete genome (section 9 of 21):from 1598421 to
1807200.] [SP:P49850] [LE:179285] [RE:181168] [DI:direct]

| ORF Name | NT ID | AA ID | NT LN | AA LN | Score | P-Value |
|---|---|---|---|---|---|---|
| AI7503000983__26306257_c2__835 | 529 | 4301 | 2073 | 690 | 2490 | 1.0e−258 |

Description
sp:[LN:TOP1_BACSU] [AC:P39814] [GN:TOPA:TOPI] [OR:*BACILLUS SUBTILIS*]
[EC:5.99.1.2] [DE:(UNTWISTING ENZYME) (SWIVELASE)] [SP:P39814]
[DB:swissprot] >pir:[LN:G69724] [AC:G69724] [PN:DNA topoisomerase I topA]
[GN:topA] [CL:DNA topoisomerase I] [OR:*Bacillus subtilis*] [DB:pir2]
>gp:[GI:g520753] [LN:BACSMF] [AC:L27797] [PN:DNA topoisomerase I] [FN:DNA
unwinding protein:removes negative] [OR:*Bacillus subtilis*] [SR:*Bacillus
subtilis* (strain 8G5) DNA] [DB:genpept-bct1] [DE:*Bacillus subtilis* (smf)
gene, 3' end, DNA topisomase gene, complete cds, (gid) gene, 5' end.]
[LE:673] [RE:2748] [DI:direct] >gp:[GI:e1185203:g2633984] [LN:BSUB0009]
[AC:Z99112:AL009126] [PN:DNA topoisomerase I] [GN:topA] [FN:DNA unwinding
protein removing negative] [OR:*Bacillus subtilis*] [DB:genpept-bct1]
[EC:5.99.1.2] [DE:*Bacillus subtilis* complete genome (section 9 of 21):from
1598421 to 1807200.] [NT:alternate gene name:topI] [SP:P39814] [LE:84640]
[RE:86715] [DI:direct] >gp:[GI:e332180:g2462970] [LN:BSYLQGCOD]
[AC:AJ000975] [PN:DNA Topoisomerase I] [GN:topA] [OR:*Bacillus subtilis*]
[DB:genpept-bct1] [DE:*Bacillus subtilis* ylqg to codV gene region.]
[SP:P39814] [LE:3808] [RE:5883] [DI:direct]

| ORF Name | NT ID | AA ID | NT LN | AA LN | Score | P-Value |
|---|---|---|---|---|---|---|
| AI7503000983__26353417_c1__753 | 530 | 4302 | 294 | 97 | 141 | 8.5e−10 |

Description
sp:[LN:YV12_CLOPE] [AC:Q46213] [OR:*CLOSTRIDIUM PERFRINGENS*] [DE:HYPOTHETICAL
10.7 KD PROTEIN IN VIRR 5'REGION (ORF2)] [SP:Q46213] [DB:swissprot]
>pir:[LN:S49553] [AC:S49553] [PN:hypothetical protein 2] [OR:*Clostridium
perfringens*] [DB:pir2] >gp:[GI:g498839] [LN:CPVIRRS] [AC:U04966]
[FN:unknown] [OR:*Clostridium perfringens*] [DB:genpept-bct1] [DE:*Clostridium
perfringens* JIR4025 extracellular toxin production regulatory locus ORF1 and
ORF3 genes, partial cds, and ORF2, ORF10c, virR, virS, and ORF4 genes,
complete cds.] [NT:ORF2] [LE:469] [RE:756] [DI:direct]

| ORF Name | NT ID | AA ID | NT LN | AA LN | Score | P-Value |
|---|---|---|---|---|---|---|
| AI7503000983__26354837_c2__946 | 531 | 4303 | 900 | 299 | 570 | 2.9e−55 |

Description
sp:[LN:DAPA_METJA] [AC:Q57695] [GN:DAPA:MJ0244] [OR:*METHANOCOCCUS
JANNASCHII*] [EC:4.2.1.52] [DE:DIHYDRODIPICOLINATE SYNTHASE, (DHDPS)]
[SP:Q57695] [DB:swissprot] >pir:[LN:E64330] [AC:E64330]
[PN:dihydrodipicolinate synthase,] [OR:*Methanococcus jannaschii*]
[EC:4.2.1.52] [DB:pir2] [MP:REV233451–232582] >gp:[GI:g1590977] [LN:U67480]
[AC:U67480:L77117] [PN:dihydrodipicolinate synthase (dapA)] [GN:MJ0244]
[OR:*Methanococcus jannaschii*] [DB:genpept-bct2] [DE:*Methanococcus jannaschii*
section 22 of 150 of the complete genome.] [NT:similar to GB:L08471
SP:Q04796 PID:142830] [LE:511] [RE:1380] [DI:complement]

-continued

| ORF Name | NT ID | AA ID | NT LN | AA LN | Score | P-Value |
|---|---|---|---|---|---|---|
| AI7503000983_26369016_c1_773 | 532 | 4304 | 387 | 128 | 105 | 5.6e−06 |

Description
gp:[GI:e139437:g1369938] [LN:BTP9011] [AC:X84706] [PN:scaffolding protein] [GN:b1 (sfp)] [OR:Bacteriophage B1] [DB:genpept-phg] [DE:Bacteriophage TP901-1 genomic region.] [NT:putative] [LE:<1] [RE:358] [DI:direct]

| ORF Name | NT ID | AA ID | NT LN | AA LN | Score | P-Value |
|---|---|---|---|---|---|---|
| AI7503000983_26460951_c2_839 | 533 | 4305 | 792 | 263 | 917 | 5.0e−92 |

Description
pir:[LN:F69708] [AC:F69708] [PN:uridylate kinase smbA] [GN:smbA] [CL:uridine 5'-monophosphate kinase] [OR:*Bacillus subtilis*] [DB:pir2] >gp:[GI:e1185242:g2634023] [LN:BSUB0009] [AC:Z99112:AL009126] [PN:uridylate kinase] [GN:smbA] [FN:pyrimidine biosynthesis] [OR:*Bacillus subtilis*] [DB:genpept-bct1] [EC:2.7.4.-] [DE:*Bacillus subtilis* complete genome (section 9 of 21):from 1598421 to 1807200.] [LE:120774] [RE:121496] [DI:direct]

| ORF Name | NT ID | AA ID | NT LN | AA LN | Score | P-Value |
|---|---|---|---|---|---|---|
| AI7503000983_26569432_f2_444 | 534 | 4306 | 168 | 55 | | |

Description
NO-HIT

| ORF Name | NT ID | AA ID | NT LN | AA LN | Score | P-Value |
|---|---|---|---|---|---|---|
| AI7503000983_26586537_f2_376 | 535 | 4307 | 156 | 51 | 70 | 0.028 |

Description
gp:[GI:d1045213:g5106116] [LN:AP000064] [AC:AP000064] [PN:125aa long hypothetical protein] [GN:APE2412] [OR:*Aeropyrum pernix*] [SR:*Aeropyrum pernix* (strain:K1) DNA] [DB:genpept] [DE:*Aeropyrum pernix* genomic DNA, section 7/7.] [LE:105148] [RE:105525] [DI:direct]

| ORF Name | NT ID | AA ID | NT LN | AA LN | Score | P-Value |
|---|---|---|---|---|---|---|
| AI7503000983_2734778_f1_31 | 536 | 4308 | 126 | 41 | | |

Description
NO-HIT

| ORF Name | NT ID | AA ID | NT LN | AA LN | Score | P-Value |
|---|---|---|---|---|---|---|
| AI7503000983_275427_c1_744 | 537 | 4309 | 1722 | 573 | 1379 | 5.5e−141 |

Description
pir:[LN:H69884] [AC:H69884] [PN:conserved hypothetical protein ymfA] [GN:ymfA] [CL:conserved hypothetical protein MG139] [OR:*Bacillus subtilis*] [DB:pir2] >gp:[GI:e1185269:g2634050] [LN:BSUB0009] [AC:Z99112:AL009126] [GN:ymfA] [FN:unknown] [OR:*Bacillus subtilis*] [DB:genpept-bct1] [DE:*Bacillus subtilis* complete genome (section 9 of 21):from 1598421 to 1807200.] [NT:similar to hypothetical proteins] [LE:150509] [RE:152056] [DI:direct]

| ORF Name | NT ID | AA ID | NT LN | AA LN | Score | P-Value |
|---|---|---|---|---|---|---|
| AI7503000983_2931337_f2_256 | 538 | 4310 | 780 | 259 | 771 | 1.5e−76 |

Description
gp:[GI:g3800827] [LN:AF076684] [AC:AF076684] [PN:oligopeptide transporter putative ATPase domain] [GN:opp-2D] [OR:*Staphylococcus aureus*] [DB:genpept-bct2] [DE:*Staphylococcus aureus* oligopeptide transporter putative membrane permease domain (opp-2B), oligopeptide transporter putative membrane permease domain (opp-2C), oligopeptide transporter putative ATPase domain (opp-2D), and oligopeptide transporter putative ATPase domain (opp-2F) genes, complete cds.] [LE:1966] [RE:27421 [DI:direct]

| ORF Name | NT ID | AA ID | NT LN | AA LN | Score | P-Value |
|---|---|---|---|---|---|---|
| AI7503000983_29781968_c3_995 | 539 | 4311 | 855 | 284 | 825 | 2.8e−82 |

Description
sp:[LN:GLPF_BACSU] [AC:P18156] [GN:GLPF] [OR:*BACILLUS SUBTILIS*] [DE:GLYCEROL UPTAKE FACILITATOR PROTEIN] [SP:P18156] [DB:swissprot] >pir:[LN:C47700] [AC:C47700:A45868:B69634:S18563] [PN:glycerol uptake facilitator glpF]

-continued

[GN:glpF] [CL:glycerol facilitator protein] [OR:*Bacillus subtilis*]
[DB:pir2] [MP:75 (degrees)] >gp:[GI:g142997] [LN:BACGLPPFK] [AC:M99611]
[PN:glycerol uptake facilitator] [GN:glpF] [OR:*Bacillus subtilis*]
[SR:*Bacillus subtilis* DNA] [DB:genpept-bct1] [DE:*Bacillus subtilis*
antiterminator regulatory protein (glpP), glycerol uptake facilitator (glpF)
genes, complete cds, glycerolkinase (glpK) gene, 5' end.] [NT:putative]
[LE:1085] [RE:1909] [DI:direct] >gp:[GI:e1182917:g2633251] [LN:BSUB0005]
[AC:Z99108:AL009126] [PN:glycerol uptake facilitator] [GN:glpF] [FN:glycerol
utilization] [OR:*Bacillus subtilis*] [DB:genpept-bct1] [DE:*Bacillus subtilis*
complete genome (section 5 of 21):from 802821 to 1011250.] [SP:P18156]
[LE:199186] [RE:200010] [DI:direct] >gp:[GI:e1182929:g2633263] [LN:BSUB0006]
[AC:Z99109:AL009126] [PN:glycerol uptake facilitator] [GN:glpF] [FN:glycerol
utilization] [OR:*Bacillus subtilis*] [DB:genpept-bct1] [DE:*Bacillus subtilis*
complete genome (section 6 of 21):from 999501 to 1209940.] [SP:P18156]
[LE:2506] [RE:3330] [DI:direct] >gp:[GI:e324940:g2226136] [LN:BSY14079]
[AC:Y14079] [PN:putative glycerol uptake facilitator] [GN:glpF] [OR:*Bacillus
subtilis*] [DB:genpept-bct1] [DE:*Bacillus subtilis* chromosomal DNA, region 75
degrees:glpPFKDoperon and downstream.] [NT:see EMBL M99611 and Swiss Prot
P18156.] [SP:P18156] [LE:2154] [RE:2978] [DI:direct]

| ORF Name | NT ID | AA ID | NT LN | AA LN | Score | P-Value |
|---|---|---|---|---|---|---|
| AI7503000983__29886011__f2__248 | 540 | 4312 | 135 | 44 | | |

Description
NO-HIT

| ORF Name | NT ID | AA ID | NT LN | AA LN | Score | P-Value |
|---|---|---|---|---|---|---|
| AI7503000983__30355313__c1__779 | 541 | 4313 | 1113 | 370 | 382 | 2.5e−35 |

Description
pir:[LN:C69901] [AC:C69901] [PN:probable two-component sensor histidine
kinase yocF] [GN:yocF] [CL:probable *Bacillus subtilis* two-component sensor
histidine kinase yocF] [OR:*Bacillus subtilis*] [DB:pir2] >gp:[GI:g2619013]
[LN:AF027868] [AC:AF027868] [PN:sensor kinase] [GN:yocF] [OR:*Bacillus
subtilis*] [DB:genpept-bct1] [DE:*Bacillus subtilis* chromosome region between
terC and odhAB.] [NT:similar to *B. subtilis* DegS sensor kinase (385 aa)]
[LE:70568] [RE:71680] [DI:direct] >gp:[GI:e1185391:g2634312] [LN:BSUB0011]
[AC:Z99114:AL009126] [GN:yocF] [FN:unknown] [OR:*Bacillus subtilis*]
[DB:genpept-bct1] [DE:*Bacillus subtilis* complete genome (section 11 of 21):
from 2000171 to 2207900.] [NT:similar to two-component sensor histidine
kinase] [LE:89659] [RE:90771] [DI:direct]

| ORF Name | NT ID | AA ID | NT LN | AA LN | Score | P-Value |
|---|---|---|---|---|---|---|
| AI7503000983__30656317__c2__838 | 542 | 4314 | 822 | 273 | 858 | 8.9e−86 |

Description
pir:[LN:S61496] [AC:S61496:H69601] [PN:transcription pleiotropic repressor
codY] [GN:codY] [OR:*Bacillus subtilis*] [DB:pir2] >gp:[GI:g535351]
[LN:BSU13634] [AC:U13634] [PN:CodY] [GN:codY] [OR:*Bacillus subtilis*]
[DB:genpept-bct1] [DE:*Bacillus subtilis* JH642 dipeptide permease operon
regulators, codV, codW, codX, and codY genes, complete cds.] [LE:3225]
[RE:4004] [DI:direct] >gp:[GI:e1185208:g2633989] [LN:BSUB0009]
[AC:Z99112:AL009126] [PN:transcriptional regulator] [GN:codY] [FN:negative
regulation of srfA and comK genes (in] [OR:*Bacillus subtilis*]
[DB:genpept-bct1] [DE:*Bacillus subtilis* complete genome (section 9 of 21):
from 1598421 to 1807200.] [SP:P39779] [LE:91098] [RE:91877] [DI:direct]

| ORF Name | NT ID | AA ID | NT LN | AA LN | Score | P-Value |
|---|---|---|---|---|---|---|
| AI7503000983__31275__c2__927 | 543 | 4315 | 171 | 56 | | |

Description
NO-HIT

| ORF Name | NT ID | AA ID | NT LN | AA LN | Score | P-Value |
|---|---|---|---|---|---|---|
| AI7503000983__31552__c1__755 | 544 | 4316 | 522 | 173 | 197 | 9.9e−16 |

Description
gp:[GI:d1045212:g5106115] [LN:AP000064] [AC:AP000064] [PN:197aa long
hypothetical protein] [GN:APE2411] [OR:*Aeropyrum pernix*] [SR:*Aeropyrum
pernix* (strain:K1) DNA] [DB:genpept] [DE:*Aeropyrum pernix* genomic DNA,
section 7/7.] [NT:motif=G-protein coupled receptors signature] [LE:104943]
[RE:105536] [DI:complement]

-continued

| ORF Name | NT ID | AA ID | NT LN | AA LN | Score | P-Value |
|---|---|---|---|---|---|---|
| AI7503000983_31697151_c2_826 | 545 | 4317 | 315 | 104 | 441 | 1.4e−41 |

Description
sp:[LN:RL19_BACSU] [AC:O31742] [GN:RPLS] [OR:*BACILLUS SUBTILIS*] [DE:50S
RIBOSOMAL PROTEIN L19] [SP:O31742] [DB:swissprot] >pir:[LN:E69696]
[AC:E69696] [PN:ribosomal protein L19 rplS] [GN:rplS] [CL:*Escherichia coli*
ribosomal protein L19] [OR:*Bacillus subtilis*] [DB:pir2]
>gp:[GI:e1185195:g2633976] [LN:BSUB0009] [AC:Z99112:AL009126] [PN:ribosomal
protein L19] [GN:rplS] [OR:*Bacillus subtilis*] [DB:genpept-bct1] [DE:*Bacillus
subtilis* complete genome (section 9 of 21):from 1598421 to 1807200.]
[SP:O31742] [LE:77012] [RE:77368] [DI:direct]

| ORF Name | NT ID | AA ID | NT LN | AA LN | Score | P-Value |
|---|---|---|---|---|---|---|
| AI7503000983_31803760_f1_9 | 546 | 4318 | 153 | 50 | 43 | 0.031 |

Description
gp:[GI:e1347527:g3877915] [LN:CEF58G1] [AC:Z81556] [GN:F58G1.9]
[OR:*Caenorhabditis elegans*] [DB:genpept-inv1] [DE:*Caenorhabditis elegans*
cosmid F58G1, complete sequence.] [NT:predicted using Genefinder]
[LE:13299:13426:13549] [RE:13379:13500:13656] [DI:direct Join]

| ORF Name | NT ID | AA ID | NT LN | AA LN | Score | P-Value |
|---|---|---|---|---|---|---|
| AI7503000983_31844658_c3_987 | 547 | 4319 | 138 | 45 | | |

Description
NO-HIT

| ORF Name | NT ID | AA ID | NT LN | AA LN | Score | P-Value |
|---|---|---|---|---|---|---|
| AI7503000983_3235828_c1_798 | 548 | 4320 | 138 | 45 | | |

Description
NO-HIT

| ORF Name | NT ID | AA ID | NT LN | AA LN | Score | P-Value |
|---|---|---|---|---|---|---|
| AI7503000983_3257827_c2_858 | 549 | 4321 | 705 | 234 | 356 | 1.4e−32 |

Description
pir:[LN:H69885] [AC:H69885] [PN:3-oxoacyl-acyl-carrier protein reductase
homolog ymfI] [GN:ymfI] [CL:short-chain alcohol dehydrogenase homology]
[OR:*Bacillus subtilis*] [DB:pir2] >gp:[GI:e1185278:g2634059] [LN:BSUB0009]
[AC:Z99112:AL009126] [GN:ymfI] [FN:unknown] [OR:*Bacillus subtilis*]
[DB:genpept-bct1] [DE:*Bacillus subtilis* complete genome (section 9 of 21):
from 1598421 to 1807200.] [NT:similar to 3-oxoacyl-acyl-carrier protein]
[LE:160607] [RE:161335] [DI:direct]

| ORF Name | NT ID | AA ID | NT LN | AA LN | Score | P-Value |
|---|---|---|---|---|---|---|
| AI7503000983_32611557_c3_966 | 550 | 4322 | 294 | 97 | 316 | 2.4e−28 |

Description
sp:[LN:EFTS_BACSU] [AC:P80700:O31748] [GN:TSF] [OR:*BACILLUS SUBTILIS*]
[DE:ELONGATION FACTOR TS (EF-TS)] [SP:P80700:O31748] [DB:swissprot]

| ORF Name | NT ID | AA ID | NT LN | AA LN | Score | P-Value |
|---|---|---|---|---|---|---|
| AI7503000983_33283167_c3_983 | 551 | 4323 | 1338 | 445 | 967 | 2.5e−97 |

Description
pir:[LN:G69885] [AC:G69885] [PN:processing proteinase homolog ymfH]
[GN:ymfH] [OR:*Bacillus subtilis*] [DB:pir2] >gp:[GI:e1185277:g2634058]
[LN:BSUB0009] [AC:Z99112:AL009126] [GN:ymfH] [FN:unknown] [OR:*Bacillus
subtilis*] [DB:genpept-bct1] [DE:*Bacillus subtilis* complete genome (section 9
of 21):from 1598421 to 1807200.] [NT:similar to processing protease]
[LE:159305] [RE:160552] [DI:direct]

| ORF Name | NT ID | AA ID | NT LN | AA LN | Score | P-Value |
|---|---|---|---|---|---|---|
| AI7503000983_33375260_f2_273 | 552 | 4324 | 165 | 54 | | |

Description
NO-HIT

-continued

| ORF Name | NT ID | AA ID | NT LN | AA LN | Score | P-Value |
|---|---|---|---|---|---|---|
| AI7503000983__3394390_f1__48 | 553 | 4325 | 123 | 40 | | |

Description
NO-HIT

| ORF Name | NT ID | AA ID | NT LN | AA LN | Score | P-Value |
|---|---|---|---|---|---|---|
| AI7503000983__34070261_c3__1010 | 554 | 4326 | 900 | 299 | 386 | 9.3e−36 |

Description
pir:[LN:A70039] [AC:A70039] [PN:ABC transporter (ATP-binding protein) homolog yvfR] [GN:yvfR] [CL:ATP-binding cassette homology] [OR:*Bacillus subtilis*] [DB:pir2] >gp:[GI:e1186097:g2635922] [LN:BSUB0018] [AC:Z99121:AL009126] [GN:yvfR] [FN:unknown] [OR:*Bacillus subtilis*] [DB:genpept-bct1] [DE:*Bacillus subtilis* complete genome (section 18 of 21): from 3399551 to 3609060.] [NT:similar to ABC transporter (ATP-binding protein)] [LE:97865] [RE:98770] [DI:complement] >gp:[GI:e313073:g1945718] [LN:BSZ94043] [AC:Z94043] [PN:hypothetical protein] [GN:yvfR] [OR:*Bacillus subtilis*] [DB:genpept-bct1] [DE:*B. subtilis* genomic DNA fragment (88 kb).] [NT:probable ABC transporter] [LE:82901] [RE:83806] [DI:direct]

| ORF Name | NT ID | AA ID | NT LN | AA LN | Score | P-Value |
|---|---|---|---|---|---|---|
| AI7503000983__34195135_c2__896 | 555 | 4327 | 1104 | 367 | 1236 | 7.8e−126 |

Description
sp:[LN:THRC_BACSU] [AC:P04990] [GN:THRC] [OR:*BACILLUS SUBTILIS*] [EC:4.2.99.2] [DE:THREONINE SYNTHASE,] [SP:P04990] [DB:swissprot] >pir:[LN:A25364] [AC:A25364:B31973:A69723] [PN:threonine synthase, thrC] [GN:thrC] [CL:threonine dehydratase] [OR:*Bacillus subtilis*] [EC:4.2.99.2] [DB:pir2] >gp:[GI:g40211] [LN:BSTHRBC] [AC:X04603] [PN:threonine synthase] [GN:thrC] [OR:*Bacillus subtilis*] [DB:genpept-bct1] [EC:4.2.99.2] [DE:*B. subtilis* thrB and thrC genes for homoserine kinase and threoninesynthase (EC 2.7.1.39 and EC 4.2.99.2, respectively).] [SP:P04990] [LE:248] [RE:1306] [DI:direct] >gp:[GI:e1184304:g2635722] [LN:BSUB0017] [AC:Z99120:AL009126] [PN:threonine synthase] [GN:thrC] [FN:threonine biosynthesis] [OR:*Bacillus subtilis*] [DB:genpept-bct1] [EC:4.2.99.2] [DE:*Bacillus subtilis* complete genome (section 17 of 21):from 3197001 to 3414420.] [NT:alternate gene name: thrB] [SP:P04990] [LE:115828] [RE:116886] [DI:complement]

| ORF Name | NT ID | AA ID | NT LN | AA LN | Score | P-Value |
|---|---|---|---|---|---|---|
| AI7503000983__34257817_c3__1038 | 556 | 4328 | 123 | 40 | | |

Description
NO-HIT

| ORF Name | NT ID | AA ID | NT LN | AA LN | Score | P-Value |
|---|---|---|---|---|---|---|
| AI7503000983__34571877_c1__746 | 557 | 4329 | 1275 | 424 | 484 | 3.8e−46 |

Description
gp:[GI:g3426364] [LN:AF082738] [AC:AF082738] [PN:unknown] [OR:*Streptococcus pyogenes*] [DB:genpept-bct2] [DE:*Streptococcus pyogenes* phosphotidylglycerophosphate synthase (pgsA) and ABC transporter ATP-binding protein (stpA) genes, complete cds; and unknown genes.] [NT:orf1] [LE:1] [RE:1245] [DI:direct]

| ORF Name | NT ID | AA ID | NT LN | AA LN | Score | P-Value |
|---|---|---|---|---|---|---|
| AI7503000983__34663177_c2__860 | 558 | 4330 | 1167 | 388 | 641 | 2.1e−65 |

Description
gp:[GI:g1842440] [LN:BSU87792] [AC:U87792] [PN:CinA] [GN:cinA] [FN:putative competence-damage inducible function] [OR:*Bacillus subtilis*] [DB:genpept-bct1] [DE:*Bacillus subtilis* tRNA-Ala, phosphatidylglycerophosphate synthase(pgsA) and CinA (cinA) genes, complete cds, and RecA (recA) gene, partial cds.] [LE:6007] [RE:7258] [DI:direct]

| ORF Name | NT ID | AA ID | NT LN | AA LN | Score | P-Value |
|---|---|---|---|---|---|---|
| AI7503000983__35187587_c3__1055 | 559 | 4331 | 588 | 195 | 370 | 4.6e−34 |

-continued

Description
pir:[LN:S34747] [AC:S34747] [PN:anthranilate synthase, component II]
[CL:glutamine amidotransferase:trpG homology] [OR:*Thermotoga maritima*]
[EC:4.1.3.27] [DB:pir2]

| ORF Name | NT ID | AA ID | NT LN | AA LN | Score | P-Value |
| --- | --- | --- | --- | --- | --- | --- |
| AI7503000983__35370318__c2__834 | 560 | 4332 | 930 | 309 | 1274 | 7.4e−130 |

Description
pir:[LN:F69719] [AC:F69719] [PN:succinate--CoA ligase (ADP-forming), alpha
chain] [GN:sucD] [CL:succinate--CoA ligase (ADP-forming) alpha chain]
[OR:*Bacillus subtilis*] [EC:6.2.1.5] [DB:pir2] >gp:[GI:e1185201:g2633982]
[LN:BSUB0009] [AC:Z99112:AL009126] [PN:succinyl-CoA synthetase (alpha
subunit)] [GN:sucD] [OR:*Bacillus subtilis*] [DB:genpept-bct1] [EC:6.2.1.5]
[DE:*Bacillus subtilis* complete genome (section 9 of 21):from 1598421 to
1807200.] [SP:P80865] [LE:82596] [RE:83498] [DI:direct]
>gp:[GI:e332178:g2462968] [LN:BSYLQGCOD] [AC:AJ000975] [PN:putative
succinyl-coA synthetase alpha chain] [GN:sucD] [OR:*Bacillus subtilis*]
[DB:genpept-bct1] [DE:*Bacillus subtilis* ylqg to codV gene region.]
[SP:P80865] [LE:1764] [RE:2666] [DI:direct]

| ORF Name | NT ID | AA ID | NT LN | AA LN | Score | P-Value |
| --- | --- | --- | --- | --- | --- | --- |
| AI7503000983__35557787__c3__1073 | 561 | 4333 | 1275 | 424 | 842 | 4.4e−84 |

Description
gp:[GI:g4982084] [LN:AE001799] [AC:AE001799:AE000512] [PN:aspartokinase II]
[GN:TM1518] [OR:*Thermotoga maritima*] [DB:genpept-bct2] [DE:*Thermotoga
maritima* section 111 of 136 of the complete genome.] [NT:similar to
PID:928811 SP:P53553 percent identity:] [LE:15047] [RE:16252]
[DI:complement]

| ORF Name | NT ID | AA ID | NT LN | AA LN | Score | P-Value |
| --- | --- | --- | --- | --- | --- | --- |
| AI7503000983__36134401__c2__897 | 562 | 4334 | 831 | 276 | 315 | 3.1e−28 |

Description
sp:[LN:YXEH_BACSU] [AC:P54947] [GN:YXEH:IP1B] [OR:*BACILLUS SUBTILIS*]
[DE:HYPOTHETICAL 30.2 KD PROTEIN IN IDH-DEOR INTERGENIC REGION] [SP:P54947]
[DB:swissprot] >pir:[LN:B70075] [AC:B70075] [PN:conserved hypothetical
protein yxeH] [GN:yxeH] [CL:*Methanobacterium thermoautotrophicum* conserved
hypothetical protein MTH1071] [OR:*Bacillus subtilis*] [DB:pir2]
>gp:[GI:e1184680:g2636501] [LN:BSUB0021] [AC:Z99124:AL009126] [GN:yxeH]
[FN:unknown] [OR:*Bacillus subtilis*] [DB:genpept-bct1] [DE:*Bacillus subtilis*
complete genome (section 21 of 21):from 3999780 to 4214814.] [NT:similar to
hypothetical proteins] [SP:P54947] [LE:63194] [RE:64006] [DI:complement]
>gp:[GI:d1008920:g14084933] [LN:D45912] [AC:D45912] [GN:yxeH] [OR:*Bacillus
subtilis*] [SR:*Bacillus subtilis* (strain:BGSC 1A1 (Marburg 168; trpC2)) DNA]
[DB:genpept-bct1] [DE:*Bacillus subtilis* genome sequence between the iol and
hut operon, partial and complete cds.] [NT:homologous to SwissProt:YIDA_ECOLI
hypothetical] [LE:7470] [RE:8282] [DI:direct]

| ORF Name | NT ID | AA ID | NT LN | AA LN | Score | P-Value |
| --- | --- | --- | --- | --- | --- | --- |
| AI7503000983__36142827__c1__814 | 563 | 4335 | 1812 | 603 | 780 | 1.6e−77 |

Description
gp:[GI:d1014255:g1651216] [LN:D88209] [AC:D88209] [PN:Pz-peptidase]
[OR:*Bacillus licheniformis*] [SR:*Bacillus licheniformis* (strain:N22) DNA]
[DB:genpept-bct1] [DE:*Bacillus licheniformis* DNA for Pz-peptidase, complete
cds.] [LE:238] [RE:2124] [DI:direct]

| ORF Name | NT ID | AA ID | NT LN | AA LN | Score | P-Value |
| --- | --- | --- | --- | --- | --- | --- |
| AI7503000983__36220061__c3__964 | 564 | 4336 | 1425 | 474 | 1399 | 4.2e−143 |

Description
Sp:[LN:HSLU_BACSU] [AC:P39778] [GN:HSLU:CLPY:CODX] [OR:*BACILLUS SUBTILIS*]
[DE:HEAT SHOCK PROTEIN HSLU] [SP:P39778] [DB:swissprot] >pir:[LN:E69601]
[AC:E69601:S61495:S72310] [PN:ATP-dependent Clp proteinase-like protein
clpY:codX protein] [GN:clpY:codX] [CL:heat shock protein
hslU:FtsH/SEC18/CDC48-type ATP-binding domain homology] [OR:*Bacillus
subtilis*] [DB:pir2] >gp:[GI:g535350] [LN:BSU13634] [AC:U13634] [PN:CodX]
[GN:codX] [OR:*Bacillus subtilis*] [DB:genpept-bct1] [DE:*Bacillus subtilis*
JH642 dipeptide permease operon regulators, codV, codW, codX, and codY genes,
complete cds.] [LE:1782] [RE:3185] [DI:direct] >gp:[GI:e1185207:g2633988]
[LN:BSUB0009] [AC:Z99112:AL009126] [PN:ATP-dependent Clp protease-like]
[GN:clpY] [OR:*Bacillus subtilis*] [DB:genpept-bct1] [DE:*Bacillus subtilis* complete genome (section 9 of 21):from 1598421 to 1807200.] [NT:alternate gene name:hslU, codX] [SP:P39778] [LE:89655] [RE:91058] [DI:direct]

| ORF Name | NT ID | AA ID | NT LN | AA LN | Score | P-Value |
|---|---|---|---|---|---|---|
| AI7503000983__36225938__c2__833 | 565 | 4337 | 1185 | 394 | 1557 | 7.6e−160 |

Description
sp:[LN:SUCC__BACSU] [AC:P80886] [GN:SUCC] [OR:*BACILLUS SUBTILIS*] [EC:6.2.1.5] [DE:(VEGETATIVE PROTEIN 63) (VEG63)] [SP:P80886] [DB:swissprot] >pir:[LN:E69719] [AC:E69719] [PN:succinate--CoA ligase (ADP-forming), beta chain] [GN:sucC] [CL:succinate--CoA ligase (ADP-forming) beta chain] [OR:*Bacillus subtilis*] [EC:6.2.1.5] [DB:pir2] >gp:[GI:e1185200:g2633981] [LN:BSUB0009] [AC:Z99112:AL009126] [PN:succinyl-CoA synthetase (beta subunit)] [GN:sucC] [OR:*Bacillus subtilis*] [DB:genpept-bct1] [EC:6.2.1.5] [DE:*Bacillus subtilis* complete genome (section 9 of 21):from 1598421 to 1807200.] [SP:P80886] [LE:81410] [RE:82567] [DI:direct] >gp:[GI:e332177:g2462967] [LN:BSYLQGCOD] [AC:AJ000975] [PN:putative succinyl-coA synthetase beta chain] [GN:sucC] [OR:*Bacillus subtilis*] [DB:genpept-bct1] [DE:*Bacillus subtilis* ylqg to codV gene region.] [SP:P80886] [LE:578] [RE:1735] [DI:direct]

| ORF Name | NT ID | AA ID | NT LN | AA LN | Score | P-Value |
|---|---|---|---|---|---|---|
| AI7503000983__3913307__f3__640 | 566 | 4338 | 135 | 44 | | |

Description
NO-HIT

| ORF Name | NT ID | AA ID | NT LN | AA LN | Score | P-Value |
|---|---|---|---|---|---|---|
| AI7503000983__3928177__f2__255 | 567 | 4339 | 360 | 119 | 91 | 0.00081 |

Description
gp:[GI:d1039115:g4514335] [LN:AB013370] [AC:AB013370] [PN:YndE] [GN:yndE] [OR:*Bacillus halodurans*] [SR:*Bacillus halodurans* (strain:C-125) DNA] [DB:genpept-bct1] [DE:*Bacillus halodurans* C-125 yndF, gerKA, yndF1 and yndF2 genes, partial and complete cds.] [LE:1025] [RE:1876] [DI:direct]

| ORF Name | NT ID | AA ID | NT LN | AA LN | Score | P-Value |
|---|---|---|---|---|---|---|
| AI7503000983__3937551__c1__820 | 568 | 4340 | 999 | 332 | 803 | 6.0e−80 |

Description
pir:[LN:B70461] [AC:B70461] [PN:aspartate-semialdehyde dehydrogenase,] [GN:asd] [CL:aspartate-semialdehyde dehydrogenase] [OR:*Aquifex aeolicus*] [EC:1.2.1.11] [DB:pir2] >gp:[GI:g2984139] [LN:AE000760] [AC:AE000760:AE000657] [PN:aspartate-semialdehyde dehydrogenase] [GN:asd] [OR:*Aquifex aeolicus*] [DB:genpept-bct2] [DE:*Aquifex aeolicus* section 92 of 109 of the complete genome.] [LE:7783] [RE:8805] [DI:direct]

| ORF Name | NT ID | AA ID | NT LN | AA LN | Score | P-Value |
|---|---|---|---|---|---|---|
| AI7503000983__3961702__c1__811 | 569 | 4341 | 1269 | 422 | 2249 | 3.5e−233 |

Description
pir:[LN:JC5325] [AC:JC5325:PC4317] [PN:methicillin resistance factor FEMA] [GN:femA] [CL:methicillin resistance factor femA] [OR:*Staphylococcus epidermidis*] [DB:pir2]

| ORF Name | NT ID | AA ID | NT LN | AA LN | Score | P-Value |
|---|---|---|---|---|---|---|
| AI7503000983__4025303__c2__923 | 570 | 4342 | 792 | 263 | 450 | 1.5e−42 |

Description
sp:[LN:TRPC__LACLA] [AC:Q01999] [GN:TRPC] [OR:*LACTOCOCCUS LACTIS*] [SR:, SUBSPLACTIS:*STREPTOCOCCUS LACTIS*] [EC:4.1.1.48] [DE:INDOLE-3-GLYCEROL PHOSPHATE SYNTHASE, (IGPS)] [SP:Q01999] [DB:swissprot] >pir:[LN:S35127] [AC:S35127] [PN:indole-3-glycerol-phosphate synthase,] [GN:trpC] [CL:indole-3-glycerol-phosphate synthase:trpC homology] [OR:*Lactococcus lactis* subsp. *lactis*] [EC:4.1.1.48] [DB:pir2] >gp:[GI:g149519] [LN:LACTRPOP] [AC:M87483] [PN:indoleglycerol phosphate synthase] [GN:trpC] [OR:*Lactococcus lactis*] [SR:*Lactococcus lactis* (strain IL1403, sub__species lactis) DNA] [DB:genpept-bct1] [EC:4.1.1.48] [DE:*L. lactis* trpE, trpG, trpD, trpF, trpC, trpB trpA genes, complete cds.] [LE:4089] [RE:4883] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000983__4062762__f3__555 | 571 | 4343 | 405 | 134 | 508 | 1.1e−48 |

Description
gp:[GI:g3135292] [LN:AF029731] [AC:AF029731] [PN:large conductance
mechanosensitive channel] [GN:mscL] [OR:*Staphylococcus aureus*]
[DB:genpept-bct2] [DE:*Staphylococcus aureus* large conductance
mechanosensitive channel(mscL) gene, complete cds.] [NT:MscL] [LE:49]
[RE:411] [DI:direct]

| ORF Name | NT ID | AA ID | NT LN | AA LN | Score | P-Value |
|---|---|---|---|---|---|---|
| AI7503000983__4063802__c1__808 | 572 | 4344 | 1497 | 498 | 808 | 1.8e−80 |

Description
sp:[LN:TRPE_LACLA] [AC:Q02001] [GN:TRPE] [OR:*LACTOCOCCUS LACTIS*]
[SR:, SUBSPLACTIS:*STREPTOCOCCUS LACTIS*] [EC:4.1.3.27] [DE:ANTHRANILATE
SYNTHASE COMPONENT I,] [SP:Q02001] [DB:swissprot] >pir:[LN:S35124]
[AC:S35124] [PN:anthranilate synthase, alpha chain] [GN:trpE]
[CL:anthranilate synthase component I] [OR:*Lactococcus lactis* subsp. *lactis*]
[EC:4.1.3.27] [DB:pir2] >gp:[GI:g149516] [LN:LACTRPOP] [AC:M87483]
[PN:anthranilate synthase alpha subunit] [GN:trpE] [OR:*Lactococcus lactis*]
[SR:*Lactococcus lactis* (strain IL1403, sub_species *lactis*) DNA]
[DB:genpept-bct1] [EC:4.1.3.27] [DE:*L. lactis* trpE, trpG, trpD, trpF, trpC,
trpB trpA genes, complete cds.] [LE:954] [RE:2324] [DI:direct]

| ORF Name | NT ID | AA ID | NT LN | AA LN | Score | P-Value |
|---|---|---|---|---|---|---|
| AI7503000983__40686__c1__737 | 573 | 4345 | 4089 | 1362 | 6425 | 0.0 |

Description
sp:[LN:DPO3_STAAU] [AC:Q53665:Q57110] [GN:POLC] [OR:*STAPHYLOCOCCUS AUREUS*]
[EC:2.7.7.7] [DE:DNA POLYMERASE III, ALPHA CHAIN POLC-TYPE, (POLIII)]
[SP:Q53665:Q57110] [DB:swissprot] >gp:[GI:d1013849:g1483182] [LN:D86727]
[AC:D86727:D45368] [PN:DNA polymerase III] [OR:*Staphylococcus aureus*]
[SR:*Staphylococcus aureus* (strain:IP8) DNA, clone:pBpolC] [DB:genpept-bct1]
[DE:*Staphylococcus aureus* DNA for DNA polymerase III, complete cds.] [LE:34]
[RE:4341] [DI:direct]

| ORF Name | NT ID | AA ID | NT LN | AA LN | Score | P-Value |
|---|---|---|---|---|---|---|
| AI7503000983__4069675__f2__274 | 574 | 4346 | 162 | 53 | | |

Description
NO-HIT

| ORF Name | NT ID | AA ID | NT LN | AA LN | Score | P-Value |
|---|---|---|---|---|---|---|
| AI7503000983__4080342__c3__996 | 575 | 4347 | 1515 | 504 | 1998 | 1.4e−206 |

Description
sp:[LN:GLPK_BACSU] [AC:P18157] [GN:GLPK] [OR:*BACILLUS SUBTILIS*]
[EC:2.7.1.30] [DE:(GLYCEROKINASE) (GK)] [SP:P18157] [DB:swissprot]
>pir:[LN:B45868] [AC:B45868:D47700:C69634:S18564] [PN:glycerol kinase,
glpK] [GN:glpK] [CL:xylulokinase] [OR:*Bacillus subtilis*] [EC:2.7.1.30]
[DB:pir2] [MP:75 (degrees)] >gp:[GI:g142992] [LN:BACGLPKD] [AC:M34393]
[OR:*Bacillus subtilis*] [SR:*B. subtilis* (strain W168) DNA] [DB:genpept-bct1]
[DE:*B. subtilis* glycerol kinase (glpK) and glycerol-3-phosphatedehydrogenase
(glpD) genes, complete cds.] [NT:glycerol kinase (glpK) (EC:2.7.1.30)]
[LE:698] [RE:2188] [DI:direct] >gp:[GI:e1182918:g2633252] [LN:BSUB0005]
[AC:Z99108:AL009126] [PN:glycerol kinase] [GN:glpK] [FN:glycerol
utilization] [OR:*Bacillus subtilis*] [DB:genpept-bct1] [EC:2.7.1.30]
[DE:*Bacillus subtilis* complete genome (section 5 of 21):from 802821
to 1011250.] [SP:P18157] [LE:200029] [RE:201519] [DI:direct]
>gp:[GI:e1182930:g2633264] [LN:BSUB0006] [AC:Z99109:AL009126] [PN:glycerol
kinase] [GN:glpK] [FN:glycerol utilization] [OR:*Bacillus subtilis*]
[DB:genpept-bct1] [EC:2.7.1.30] [DE:*Bacillus subtilis* complete genome
(section 6 of 21):from 999501 to 1209940.] [SP:P18157] [LE:3349] [RE:4839]
[DI:direct] >gp:[GI:e324941:g2226137] [LN:BSY14079] [AC:Y14079] [PN:glycerol
kinase] [GN:glpK] [OR:*Bacillus subtilis*] [DB:genpept-bct1] [DE:*Bacillus
subtilis* chromosomal DNA, region 75 degrees:glpPFKDoperon and downstream.]
[NT:see EMBL M34393 and Swiss Prot P18157.] [SP:P18157] [LE:2997] [RE:4487]
[DI:direct]

| ORF Name | NT ID | AA ID | NT LN | AA LN | Score | P-Value |
|---|---|---|---|---|---|---|
| AI7503000983__4089062__c2__906 | 576 | 4348 | 1176 | 391 | 380 | 4.0e−35 |

Description
pir:[LN:C71302] [AC:C71302] [PN:probable exonuclease] [GN:TP0626]

-continued

[OR:*Treponema pallidum* subsp. *pallidum*] [SR:, syphilis spirochete] [DB:pir2]
>gp:[GI:g3322921] [LN:AE001237] [AC:AE001237:AE000520] [PN:exonuclease,
putative] [GN:TP0626] [OR:*Treponema pallidum*] [DB:genpept-bct2]
[DE:*Treponema pallidum* section 53 of 87 of the complete genome.] [NT:similar
to SP:P23479 percent identity:32.68;] [LE:11246] [RE:12421] [DI:direct]

| ORF Name | NT ID | AA ID | NT LN | AA LN | Score | P-Value |
|---|---|---|---|---|---|---|
| AI7503000983_4093818_c2_859 | 577 | 4349 | 591 | 196 | 436 | 4.7e−41 |

Description
sp:[LN:PGSA_BACSU] [AC:P46322] [GN:PGSA] [OR:*BACILLUS SUBTILIS*] [EC:2.7.8.5]
[DE:(EC 2.7.8.5) (PHOSPHATIDYLGLYCEROPHOSPHATE SYNTHASE) (PGP SYNTHASE)]
[SP:P46322] [DB:swissprot] >gp:[GI:d1009402:g893358] [LN:BACPGS1A]
[AC:D50064] [PN:PgsA] [GN:pgs1A] [OR:*Bacillus subtilis*] [SR:*Bacillus
subtilis* (strain:Marburg168) DNA] [DB:genpept-bct1] [EC:2.7.8.5]
[DE:*Bacillus subtilis* pgs1A gene for phosphatidylglycerophosphatesynthase,
complete cds.] [LE:182] [RE:763] [DI:direct] >gp:[GI:g1842439] [LN:BSU87792]
[AC:U87792] [PN:phosphatidylglycerophosphate synthase] [GN:pgsA]
[FN:involved in the synthetic pathway for acidic] [OR:*Bacillus subtilis*]
[DB:genpept-bct1] [DE:*Bacillus subtilis* tRNA-Ala,
phosphatidylglycerophosphate synthase(pgsA) and CinA (cinA) genes, complete
cds, and RecA (recA) gene, partial cds.] [NT:PgsA] [LE:5407] [RE:5990]
[DI:direct]

| ORF Name | NT ID | AA ID | NT LN | AA LN | Score | P-Value |
|---|---|---|---|---|---|---|
| AI7503000983_4095286_c2_869 | 578 | 4350 | 375 | 124 | 246 | 6.4e−21 |

Description
pir:[LN:C69884] [AC:C69884] [PN:conserved hypothetical protein ymcA]
[GN:ymcA] [OR:*Bacillus subtilis*] [DB:pir2] >gp:[GI:e1185293:g2634074]
[LN:BSUB0009] [AC:Z99112:AL009126] [GN:ymcA] [FN:unknown] [OR:*Bacillus
subtilis*] [DB:genpept-bct1] [DE:*Bacillus subtilis* complete genome (section 9
of 21):from 1598421 to 1807200.] [NT:similar to hypothetical proteins]
[LE:175322] [RE:175753] [DI:direct]

| ORF Name | NT ID | AA ID | NT LN | AA LN | Score | P-Value |
|---|---|---|---|---|---|---|
| AI7503000983_4334383_f2_322 | 579 | 4351 | 135 | 44 | | |

Description
NO-HIT

| ORF Name | NT ID | AA ID | NT LN | AA LN | Score | P-Value |
|---|---|---|---|---|---|---|
| AI7503000983_4336536_c1_739 | 580 | 4352 | 315 | 104 | 211 | 3.3e−17 |

Description
sp:[LN:YLXR_BACSU] [AC:P32728] [GN:YLXR] [OR:*BACILLUS SUBTILIS*]
[DE:HYPOTHETICAL 10.4 KD PROTEIN IN NUSA-INFB INTERGENIC REGION (ORF3)]
[SP:P32728] [DB:swissprot] >pir:[LN:D36905] [AC:D36905:D69882:S31992]
[PN:conserved hypothetical protein ylxR:hypothetical protein 1 (nusA 3'
region)] [GN:ylxR] [OR:*Bacillus subtilis*] [DB:pir2] >gp:[GI:g580900]
[LN:BSORF1T7A] [AC:Z18631] [GN:ORF3] [OR:*Bacillus subtilis*]
[DB:genpept-bct1] [DE:*B. subtilis* infB-nusA operon.] [SP:P32728] [LE:2090]
[RE:2365] [DI:direct] >gp:[GI:e1185252:g2634033] [LN:BSUB0009]
[AC:Z99112:AL009126] [GN:ylxR] [FN:unknown] [OR:*Bacillus subtilis*]
[DB:genpept-bct1] [DE:*Bacillus subtilis* complete genome (section 9 of 21):
from 1598421 to 1807200.] [NT:alternate gene name:ymxB; similar to
hypothetical] [SP:P32728] [LE:134381] [RE:134656] [DI:direct]

| ORF Name | NT ID | AA ID | NT LN | AA LN | Score | P-Value |
|---|---|---|---|---|---|---|
| AI7503000983_4414675_c1_783 | 581 | 4353 | 132 | 43 | | |

Description
NO-HIT

| ORF Name | NT ID | AA ID | NT LN | AA LN | Score | P-Value |
|---|---|---|---|---|---|---|
| AI7503000983_4425068_f2_474 | 582 | 4354 | 2613 | 870 | 880 | 4.2e−88 |

Description
pir:[LN:G69801] [AC:G69801] [PN:hypothetical protein yfhO] [GN:yfhO]
[OR:*Bacillus subtilis*] [DB:pir2] >gp:[GI:e1182850:g2633184] [LN:BSUB0005]
[AC:Z99108:AL009126] [GN:yfhO] [FN:unknown] [OR:*Bacillus subtilis*]
[DB:genpept-bct1] [DE:*Bacillus subtilis* complete genome (section 5 of 21):
from 802821 to 1011250.] [LE:128691] [RE:131150] [DI:direct]

>gp:[GI:d1025397:g2804545] [LN:D85082] [AC:D85082] [PN:YfhO] [OR:*Bacillus subtilis*] [SR:*Bacillus subtilis* DNA] [DB:genpept-bct1] [DE:*Bacillus subtilis* DNA, genome sequence, 79 to 81 degree region.] [LE:21582] [RE:24041] [DI:direct]

| ORF Name | NT ID | AA ID | NT LN | AA LN | Score | P-Value |
|---|---|---|---|---|---|---|
| AI7503000983__4460063__f1__150 | 583 | 4355 | 123 | 40 | | |

Description
NO-HIT

| ORF Name | NT ID | AA ID | NT LN | AA LN | Score | P-Value |
|---|---|---|---|---|---|---|
| AI7503000983__447326__c2__871 | 584 | 4356 | 156 | 51 | | |

Description
NO-HIT

| ORF Name | NT ID | AA ID | NT LN | AA LN | Score | P-Value |
|---|---|---|---|---|---|---|
| AI7503000983__4493778__c3__952 | 585 | 4357 | 147 | 48 | | |

Description
NO-HIT

| ORF Name | NT ID | AA ID | NT LN | AA LN | Score | P-Value |
|---|---|---|---|---|---|---|
| AI7503000983__4572162__c3__970 | 586 | 4358 | 1290 | 429 | 932 | 1.3e−93 |

Description
pir:[LN:C69881] [AC:C69881] [PN:conserved hypothetical protein yluC] [GN:yluC] [OR:*Bacillus subtilis*] [DB:pir2] >gp:[GI:e1185247:g2634028] [LN:BSUB0009] [AC:Z99112:AL009126] [GN:yluC] [FN:unknown] [OR:*Bacillus subtilis*] [DB:genpept-bct1] [DE:*Bacillus subtilis* complete genome (section 9 of 21):from 1598421 to 1807200.] [NT:similar to hypothetical proteins] [LE:125000] [RE:126268] [DI:direct]

| ORF Name | NT ID | AA ID | NT LN | AA LN | Score | P-Value |
|---|---|---|---|---|---|---|
| AI7503000983__4687825__c3__955 | 587 | 4359 | 165 | 54 | | |

Description
NO-HIT

| ORF Name | NT ID | AA ID | NT LN | AA LN | Score | P-Value |
|---|---|---|---|---|---|---|
| AI7503000983__4719011__c2__841 | 588 | 4360 | 174 | 57 | | |

Description
NO-HIT

| ORF Name | NT ID | AA ID | NT LN | AA LN | Score | P-Value |
|---|---|---|---|---|---|---|
| AI7503000983__4740932__c1__825 | 589 | 4361 | 126 | 41 | | |

Description
NO-HIT

| ORF Name | NT ID | AA ID | NT LN | AA LN | Score | P-Value |
|---|---|---|---|---|---|---|
| AI7503000983__4798453__c1__790 | 590 | 4362 | 1026 | 341 | 242 | 2.7e−27 |

Description
pir:[LN:H69873] [AC:H69873] [PN:conserved hypothetical protein ylbC] [GN:ylbC] [OR:*Bacillus subtilis*] [DB:pir2] >gp:[GI:e334771:g2339999] [LN:BS16823KB] [AC:Z98682] [PN:YlbC protein] [GN:ylbC] [OR:*Bacillus subtilis*] [DB:genpept-bct1] [DE:*Bacillus subtilis* genomic DNA 23.9 kB fragment.] [LE:11510] [RE:12550] [DI:direct] >gp:[GI:e1185086:g2633867] [LN:BSUB0008] [AC:Z99111:AL009126] [GN:ylbC] [FN:unknown] [OR:*Bacillus subtilis*] [DB:genpept-bct1] [DE:*Bacillus subtilis* complete genome (section 8 of 21):from 1394791 to 1603020.] [NT:similar to hypothetical proteins from *B. subtilis*] [LE:170993] [RE:172033] [DI:direct]

| ORF Name | NT ID | AA ID | NT LN | AA LN | Score | P-Value |
|---|---|---|---|---|---|---|
| AI7503000983__4884675__c3__1057 | 591 | 4363 | 1212 | 403 | 1268 | 3.2e−129 |

-continued

Description
sp:[LN:TRPB_LACLA] [AC:Q01998] [GN:TRPB] [OR:*LACTOCOCCUS LACTIS*]
[SR:, SUBSPLACTIS:*STREPTOCOCCUS LACTIS*] [EC:4.2.1.20] [DE:TRYPTOPHAN SYNTHASE
BETA CHAIN,] [SP:Q01998] [DB:swissprot] >pir:[LN:S35129] [AC:S35129]
[PN:tryptophan synthase, beta chain] [GN:trpB] [CL:tryptophan synthase beta
chain:tryptophan synthase beta chain homology] [OR:*Lactococcus lactis* subsp.
*lactis*] [EC:4.2.1.20] [DB:pir2] >gp:[GI:g149521] [LN:LACTRPOP] [AC:M87483]
[PN:tryptophan synthase beta subunit] [GN:trpB] [OR:*Lactococcus lactis*]
[SR:*Lactococcus lactis* (strain IL1403, sub_species *lactis*) DNA]
[DB:genpept-bct1] [EC:4.2.1.20] [DE:*L. lactis* trpE, trpG, trpD, trpF, trpC,
trpB trpA genes, complete cds.] [LE:6514] [RE:7722] [DI:direct]

| ORF Name | NT ID | AA ID | NT LN | AA LN | Score | P-Value |
|---|---|---|---|---|---|---|
| AI7503000983_4890802_f2_275 | 592 | 4364 | 1152 | 383 | 819 | 1.2e−81 |

Description
sp:[LN:TYRA_BACSU] [AC:P20692] [GN:TYRA] [OR:*BACILLUS SUBTILIS*]
[EC:1.3.1.12] [DE:PREPHENATE DEHYDROGENASE, (PDH)] [SP:P20692]
[DB swissprot]

| ORF Name | NT ID | AA ID | NT LN | AA LN | Score | P-Value |
|---|---|---|---|---|---|---|
| AI7503000983_4891577_c2_879 | 593 | 4365 | 582 | 193 | 453 | 7.4e−43 |

Description
pir:[LN:G69657] [AC:G69657] [PN:tRNA isopentenylpyrophosphate transferase
miaA] [GN:miaA] [CL:delta(2)-isopentenylpyrophosphate transferase]
[OR:*Bacillus subtilis*] [DB:pir2] >gp:[GI:e1183392:g2634117] [LN:BSUB0010]
[AC:Z99113:AL009126] [PN:tRNA isopentenylpyrophosphate transferase]
[GN:miaA] [OR:*Bacillus subtilis*] [DB:genpept-bct1] [DE:*Bacillus subtilis*
complete genome (section 10 of 21):from 1781201 to 2014980.] [LE:84430]
[RE:85374] [DI:direct]

| ORF Name | NT ID | AA ID | NT LN | AA LN | Score | P-Value |
|---|---|---|---|---|---|---|
| AI7503000983_4942202_c3_1058 | 594 | 4366 | 123 | 40 | | |

Description
NO-HIT

| ORF Name | NT ID | AA ID | NT LN | AA LN | Score | P-Value |
|---|---|---|---|---|---|---|
| AI7503000983_4964686_f3_520 | 595 | 4367 | 204 | 67 | 195 | 1.6e−15 |

Description
pir:[LN:C70057] [AC:C70057] [PN:4-oxalocrotonate tautomerase homolog ywhB]
[GN:ywhB] [CL:4-oxalocrotonate tautomerase] [OR:*Bacillus subtilis*]
[DB:pir2] >gp:[GI:e267624:g1565237] [LN:BSTHRZ] [AC:Z80360] [PN:Unknown,
highly similar to *Pseudomonas putida*] [GN:ywhB] [OR:*Bacillus subtilis*]
[DB:genpept-bct1] [DE:*B. subtilis* thrZ downstream chromosomal region.]
[LE:2388] [RE:2576] [DI:complement] >gp:[GI:e1186254:g2636290] [LN:BSUB0020]
[AC:Z99123:AL009126] [GN:ywhB] [FN:unknown] [OR:*Bacillus subtilis*]
[DB:genpept-bct1] [DE:*Bacillus subtilis* complete genome (section 20 of 21):
from 3798401 to 4010550.] [NT:similar to 4-oxalocrotonate tautomerase]
[LE:54138] [RE:54326] [DI:direct]

| ORF Name | NT ID | AA ID | NT LN | AA LN | Score | P-Value |
|---|---|---|---|---|---|---|
| AI7503000983_5109378_f3_546 | 596 | 4368 | 615 | 204 | 469 | 1.5e−44 |

Description
pir:[LN:A69892] [AC:A69892] [PN:conserved hypothetical protein yneS]
[GN:yneS] [CL:*Escherichia coli* ygiH protein] [OR:*Bacillus subtilis*]
[DB:pir2] >gp:[GI:e249655:g1405459] [LN:BC170DEGR] [AC:Z73234] [PN:YneS]
[GN:yneS] [OR:*Bacillus subtilis*] [DB:genpept-bct1] [DE:*B. subtilis* DNA (26.2
kb fragment; 170 degree region).] [NT:similar to hypothetical protein MG247
from] [LE:13596] [RE:14177] [DI:complement] >gp:[GI:e1183465:g2634190]
[LN:BSUB0010] [AC:Z99113:AL009126] [GN:yneS] [FN:unknown] [OR:*Bacillus
subtilis*] [DB:genpept-bct1] [DE:*Bacillus subtilis* complete genome (section
10 of 21):from 1781201 to 2014980.] [NT:similar to hypothetical proteins]
[LE:149975] [RE:150556] [DI:complement]

| ORF Name | NT ID | AA ID | NT LN | AA LN | Score | P-Value |
|---|---|---|---|---|---|---|
| AI7503000983_5109625_c3_1011 | 597 | 4369 | 372 | 123 | 258 | 3.4e−22 |

Description
pir:[LN:D70039] [AC:D70039] [PN:two-component response regulator [YvfT]

-continued homolog yvfU] [GN:yvfU] [CL:regulatory protein comA:response regulator homology] [OR:*Bacillus subtilis*] [DB:pir2] >gp:[GI:e1186094:g2635919] [LN:BSUB0018] [AC:Z99121:AL009126] [GN:yvfU] [FN:unknown] [OR:*Bacillus subtilis*] [DB:genpept-bct1] [DE:*Bacillus subtilis* complete genome (section 18 of 21):from 3399551 to 3609060.] [NT:similar to two-component response regulator [YvfT] [LE:95389] [RE:95991] [DI:complement] >gp:[GI:e313075:g1945721] [LN:BSZ94043] [AC:Z94043] [PN:hypothetical protein] [GN:yvfU] [OR:*Bacillus subtilis*] [DB:genpept-bct1] [DE:*B. subtilis* genomic DNA fragment (88 kb).] [NT:probable two component regulatory system:] [LE:85680] [RE:86282] [DI:direct]

| ORF Name | NT ID | AA ID | NT LN | AA LN | Score | P-Value |
|---|---|---|---|---|---|---|
| AI7503000983_5120635_c2_903 | 598 | 4370 | 240 | 79 | 76 | 0.026 |

Description
sp:[LN:F801_SCHMA] [AC:P16463] [OR:*SCHISTOSOMA MANSONI*] [SR:, BLOOD FLUKE] [DE:FEMALE SPECIFIC 800 PROTEIN (FS800)] [SP:P16463] [DB:swissprot] >gp:[GI:g160990] [LN:SCMFS800] [AC:J03999] [PN:female-specific 800 protein] [GN:fs800] [OR:*Schistosoma mansoni*] [SR:*Schistosoma mansoni* (strain Puerto Rican) cDNA to mRNA] [DB:genpept-inv1] [DE:*Schistosoma mansoni* female-specific 800 protein (fs800) mRNA, complete cds.] [NT:putative] [LE:4] [RE:720] [DI:direct]

| ORF Name | NT ID | AA ID | NT LN | AA LN | Score | P-Value |
|---|---|---|---|---|---|---|
| AI7503000983_5195328_c1_749 | 599 | 4371 | 393 | 130 | 142 | 2.3e−09 |

Description
gp:[GI:g1842438] [LN:BSU87792] [AC:U87792] [PN:unknown] [OR:*Bacillus subtilis*] [DB:genpept-bct1] [DE:*Bacillus subtilis* tRNA-Ala, phosphatidylglycerophosphate synthase(pgsA) and CinA (cinA) genes, complete cds, and RecA (recA) gene, partial cds.] [NT:ORF307; hypothetical 34.7 kd protein] [LE:4436] [RE:5359] [DI:direct]

| ORF Name | NT ID | AA ID | NT LN | AA LN | Score | P-Value |
|---|---|---|---|---|---|---|
| AI7503000983_5198557_c1_734 | 600 | 4372 | 801 | 266 | 847 | 1.3e−84 |

Description
gp:[GI:d1032955:g3358087] [LN:AB004319] [AC:AB004319] [PN:undecaprenyl diphosphate synthase] [GN:upps] [OR:*Micrococcus luteus*] [SR:*Micrococcus luteus* (strain:B-P 26) DNA] [DB:genpept-bct1] [DE:*Micrococcus luteus* DNA for undecaprenyl diphosphate synthase, complete cds.] [LE:1] [RE:750] [DI:direct]

| ORF Name | NT ID | AA ID | NT LN | AA LN | Score | P-Value |
|---|---|---|---|---|---|---|
| AI7503000983_5212776_c2_832 | 601 | 4373 | 867 | 288 | 839 | 9.2e−84 |

Description
pir:[LN:F69880] [AC:F69880] [PN:conserved hypothetical protein ylqF] [GN:ylqF] [CL:conserved hypothetical protein MG442] [OR:*Bacillus subtilis*] [DB:pir2] >gp:[GI:e1185196:g2633977] [LN:BSUB0009] [AC:Z99112:AL009126] [GN:ylqF] [FN:unknown] [OR:*Bacillus subtilis*] [DB:genpept-bct1] [DE:*Bacillus subtilis* complete genome (section 9 of 21):from 1598421 to 1807200.] [NT:similar to hypothetical proteins] [LE:77511] [RE:78359] [DI:direct]

| ORF Name | NT ID | AA ID | NT LN | AA LN | Score | P-Value |
|---|---|---|---|---|---|---|
| AI7503000983_5355012_c1_770 | 602 | 4374 | 1359 | 452 | 2274 | 7.9e−236 |

Description
sp:[LN:GLNA_STAAU] [AC:Q59812] [GN:GLNA] [OR:*STAPHYLOCOCCUS AUREUS*] [EC:6.3.1.2] [DE:GLUTAMINE SYNTHETASE, (GLUTAMATE--AMMONIA LIGASE) (GS)] [SP:Q59812] [DB:swissprot] >gp:[GI:e214721:g1134886] [LN:SAGLNAR] [AC:X76490] [PN:glutamine synthetase] [GN:glnA] [OR:*Staphylococcus aureus*] [DB:genpept-bct1] [DE:*S. aureus* (bb270) glnA and glnR genes.] [SP:Q59812] [LE:1362] [RE:2702] [DI:direct]

| ORF Name | NT ID | AA ID | NT LN | AA LN | Score | P-Value |
|---|---|---|---|---|---|---|
| AI7503000983_553455_f3_540 | 603 | 4375 | 153 | 50 | | |

Description
NO-HIT

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000983_6258588_c1_802 | 604 | 4376 | 1470 | 489 | 1305 | 3.8e−133 |

Description
sp:[LN:ALST_BACSU] [AC:Q45068] [GN:ALST] [OR:*BACILLUS SUBTILIS*] [DE:AMINO
ACID CARRIER PROTEIN ALST] [SP:Q45068] [DB:swissprot] >pir:[LN:A69585]
[AC:A69585] [PN:amino acid carrier protein alsT] [GN:alsT]
[CL:sodium-dependent D-alanine/glycine transport protein] [OR:*Bacillus subtilis*] [DB:pir2] >gp:[GI:e249660:g1405464] [LN:BC170DEGR] [AC:Z73234]
[PN:AlsT] [GN:alsT] [FN:amino acid carrier protein] [OR:*Bacillus subtilis*]
[DB:genpept-bct1] [DE:*B. subtilis* DNA (26.2 kb fragment; 170 degree region).]
[NT:similar to sodium/proton dependent alanine carrier] [SP:Q45068]
[LE:20601] [RE:21998] [DI:direct] >gp:[GI:e1183470:g2634195] [LN:BSUB0010]
[AC:Z99113:AL009126] [PN:amino acid carrier protein] [GN:alsT] [OR:*Bacillus subtilis*] [DB:genpept-bct1] [DE:*Bacillus subtilis* complete genome (section
10 of 21):from 1781201 to 2014980.] [SP:Q45068] [LE:156980] [RE:158377]
[DI:direct]

| ORF Name | NT ID | AA ID | NT LN | AA LN | Score | P-Value |
|---|---|---|---|---|---|---|
| AI7503000983_6416566_c1_800 | 605 | 4377 | 2031 | 676 | 3180 | 0.0 |

Description
sp:[LN:PARE_STAAU] [AC:P50072] [GN:PARE:GRLB] [OR:*STAPHYLOCOCCUS AUREUS*]
[EC:5.99.1.-] [DE:TOPOISOMERASE IV SUBUNIT B,] [SP:P50072] [DB:swissprot]
>pir:[LN:S54426] [AC:S54426] [PN:DNA topoisomerase (ATP-hydrolyzing), chain
B] [CL:DNA topoisomerase (ATP-hydrolyzing) chain B] [OR:*Staphylococcus aureus*] [EC:5.99.1.3] [DB:pir2] >gp:[GI:d1011746:g1777320] [LN:D67075]
[AC:D67075] [PN:DNA topoisomerase IV GrlB subunit] [GN:grlB]
[OR:*Staphylococcus aureus*] [SR:*Staphylococcus aureus* (isolate:RN4220) DNA]
[DB:genpept-bct1] [DE:*Staphylococcus aureus* DNA for DNA topoisomerase IV
GrlB subunit, DNA topoisomerase IV GrlA subunit, complete cds.] [LE:385]
[RE:2376] [DI:direct] >gp:[GI:g561879] [LN:STAGYRASL] [AC:L25288]
[PN:gyrase-like protein beta subunit] [GN:grlB] [OR:*Staphylococcus aureus*]
[SR:*Staphylococcus aureus* (tissue library:FDA 574) DNA] [DB:genpept-bct1]
[DE:*Staphylococcus aureus* gyrase-like protein alpha and beta subunit(grlA
and grlB) genes, complete cds.] [LE:41] [RE:2032] [DI:direct]
>gp:[GI:e306312:g2302281] [LN:A48501] [AC:A48501] [OR:*Staphylococcus aureus*]
[DB:genpept-pat] [DE:Sequence 3 from Patent WO09603516.] [NT:unnamed protein
product] [LE:1] [RE:1992] [DI:direct]

| ORF Name | NT ID | AA ID | NT LN | AA LN | Score | P-Value |
|---|---|---|---|---|---|---|
| AI7503000983_6525_f3_577 | 606 | 4378 | 1035 | 344 | 729 | 4.2e−72 |

Description
sp:[LN:LYSP_ECOLI] [AC:P25737] [GN:LYSP:CADR] [OR:*ESCHERICHIA COLI*]
[DE:LYSINE-SPECIFIC PERMEASE] [SP:P25737] [DB:swissprot]

| ORF Name | NT ID | AA ID | NT LN | AA LN | Score | P-Value |
|---|---|---|---|---|---|---|
| AI7503000983_6641963_c3_1009 | 607 | 4379 | 1485 | 494 | 1302 | 8.0e−133 |

Description
sp:[LN:YWNE_BACSU] [AC:P71040] [GN:YWNE] [OR:*BACILLUS SUBTILIS*]
[DE:HYPOTHETICAL 55.8 KD PROTEIN IN SPOIIQ-MTA INTERGENIC REGION]
[SP:P71040] [DB:swissprot] >pir:[LN:G70063] [AC:G70063] [PN:cardiolipin
synthase homolog ywnE] [GN:ywnE] [CL:*Bacillus* probable cardiolipin
synthetase] [OR:*Bacillus subtilis*] [DB:pir2] >gp:[GI:e1184565:g2636184]
[LN:BSUB0019] [AC:Z99122:AL009126] [GN:ywnE] [FN:unknown] [OR:*Bacillus subtilis*] [DB:genpept-bct1] [DE:*Bacillus subtilis* complete genome (section
19 of 21):from 3597091 to 3809700.] [NT:similar to cardiolipin synthase]
[SP:P71040] [LE:164628] [RE:166076] [DI:direct] >gp:[GI:e269549:g1592701]
[LN:BSUEROP] [AC:Y08559] [PN:Unknown] [GN:ywnE] [OR:*Bacillus subtilis*]
[DB:genpept-bct1] [DE:*B. subtilis* urease operon and downstream DNA.]
[NT:Product similar to *Escherichia coli* cardiolipin] [SP:P71040] [LE:5155]
[RE:6603] [DI:complement] >gp:[GI:e1184565:g2636184] [LN:BSUB0019]
[AC:Z99122:AL009126] [GN:ywnE] [FN:unknown] [OR:*Bacillus subtilis*]
[DB:genpept] [DE:*Bacillus subtilis* complete genome (section 19 of 21):from
3597091 to 3809700.] [NT:similar to cardiolipin synthase] [SP:P71040]
[LE:164628] [RE:166076] [DI:direct]

| ORF Name | NT ID | AA ID | NT LN | AA LN | Score | P-Value |
|---|---|---|---|---|---|---|
| AI7503000983_6664127_c2_940 | 608 | 4380 | 438 | 145 | | |

Description
NO-HIT

-continued

| ORF Name | NT ID | AA ID | NT LN | AA LN | Score | P-Value |
|---|---|---|---|---|---|---|
| AI7503000983_6678140_c3_972 | 609 | 4381 | 348 | 115 | 328 | 3.8e−28 |

Description
pir:[LN:S52267] [AC:S52267] [PN:DNA polymerase III] [CL:DNA-directed DNA polymerase III alpha chain polC] [OR:*Staphylococcus aureus*] [DB:pir2]
>gp:[GI:g642270] [LN:SADNAPOL3] [AC:Z48003:L39156] [PN:DNA polymerase III] [OR:*Staphylococcus aureus*] [DB:genpept-bct1] [DE:*S. aureus* gene for DNA polymerase III.] [SP:Q53665] [LE:34] [RE:4281] [DI:direct]

| ORF Name | NT ID | AA ID | NT LN | AA LN | Score | P-Value |
|---|---|---|---|---|---|---|
| AI7503000983_6688126_c1_751 | 610 | 4382 | 1074 | 357 | 1661 | 7.2e−171 |

Description
sp:[LN:RECA_STAAU] [AC:Q02350] [GN:RECA] [OR:*STAPHYLOCOCCUS AUREUS*] [DE:RECA PROTEIN] [SP:Q02350] [DB:swissprot] >gp:[GI:g463285] [LN:STARECAA]
[AC:L25893] [GN:recA] [FN:genetic recombination] [OR:*Staphylococcus aureus*]
[SR:*Staphylococcus aureus* DNA] [DB:genpept-bct1] [DE:*Staphylococcus aureus* recA gene, complete cds.] [NT:putative] [LE:16] [RE:1059] [DI:direct]

| ORF Name | NT ID | AA ID | NT LN | AA LN | Score | P-Value |
|---|---|---|---|---|---|---|
| AI7503000983_673437_f3_529 | 611 | 4383 | 147 | 48 | | |

Description
NO-HIT

| ORF Name | NT ID | AA ID | NT LN | AA LN | Score | P-Value |
|---|---|---|---|---|---|---|
| AI7503000983_6818827_c3_1072 | 612 | 4384 | 1608 | 535 | 2088 | 4.1e−216 |

Description
pir:[LN:E69861] [AC:E69861] [PN:ABC transporter (ATP-binding protein) homolog ykpA] [GN:ykpA] [CL:ATP-binding cassette homology] [OR:*Bacillus subtilis*] [DB:pir2] >gp:[GI:e1185033:g2633814] [LN:BSUB0008]
[AC:Z99111:AL009126] [GN:ykpA] [FN:unknown] [OR:*Bacillus subtilis*]
[DB:genpept-bct1] [DE:*Bacillus subtilis* complete genome (section 8 of 21): from 1394791 to 1603020.] [NT:similar to ABC transporter (ATP-binding protein)] [LE:116988] [RE:118610] [DI:direct] >gp:[GI:g3282128]
[LN:AF012285] [AC:AF012285:AF012284:U51911] [PN:YkpA] [GN:ykpA] [OR:*Bacillus subtilis*] [DB:genpept-bct2] [DE:*Bacillus subtilis* mobA-nprE gene region.]
[NT:similar to *E. coli* hypothetical ABC transporter] [LE:17476] [RE:19098]
[DI:direct]

| ORF Name | NT ID | AA ID | NT LN | AA LN | Score | P-Value |
|---|---|---|---|---|---|---|
| AI7503000983_6837812_c1_735 | 613 | 4385 | 786 | 261 | 611 | 1.3e−59 |

Description
sp:[LN:CDSA_BACSU] [AC:O31752] [GN:CDSA] [OR:*BACILLUS SUBTILIS*]
[EC:2.7.7.41] [DE:SYNTHASE)] [SP:O31752] [DB:swissprot] >pir:[LN:G69597]
[AC:G69597] [PN:phosphatidate cytidylyltransferase cdsA] [GN:cdsA]
[OR:*Bacillus subtilis*] [DB:pir2] >gp:[GI:e1185245:g2634026] [LN:BSUB0009]
[AC:Z99112:AL009126] [PN:phosphatidate cytidylyltransferase] [GN:cdsA]
[FN:phospholipid biosynthesis] [OR:*Bacillus subtilis*] [DB:genpept-bct1]
[EC:2.7.7.41] [DE:*Bacillus subtilis* complete genome (section 9 of 21):from 1598421 to 1807200.] [SP:O31752] [LE:122972] [RE:123781] [DI:direct]

| ORF Name | NT ID | AA ID | NT LN | AA LN | Score | P-Value |
|---|---|---|---|---|---|---|
| AI7503000983_6929652_c1_822 | 614 | 4386 | 744 | 247 | 683 | 3.1e−67 |

Description
pir:[LN:F69866] [AC:F69866] [PN:tetrahydrodipicolinate succinylase homolog ykuQ] [GN:ykuQ] [OR:*Bacillus subtilis*] [DB:pir2] >gp:[GI:e1181922:g2632238]
[LN:BS16829KB] [AC:AJ222587] [PN:YkuQ protein] [GN:ykuQ] [OR:*Bacillus subtilis*] [DB:genpept-bct1] [DE:*Bacillus subtilis* 29kB DNA fragment from ykwC gene to cse15 gene.] [NT:homologous to acetyltransferases] [LE:23332]
[RE:24042] [DI:direct] >gp:[GI:e1185008:g2633789] [LN:BSUB0008]
[AC:Z99111:AL009126] [GN:ykuQ] [FN:unknown] [OR:*Bacillus subtilis*]
[DB:genpept-bct1] [DE:*Bacillus subtilis* complete genome (section 8 of 21): from 1394791 to 1603020.] [NT:similar to tetrahydrodipicolinate succinylase]
[LE:93588] [RE:94298] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000983__6929677__c1__766 | 615 | 4387 | 258 | 85 | 187 | 1.1e−14 |

Description
pir:[LN:B69884] [AC:B69884] [PN:host factor-1 protein homolog ymaH]
[GN:ymaH] [CL:host factor I] [OR:*Bacillus subtilis*] [DB:pir2]
>gp:[GI:e1183393:g2634118] [LN:BSUB0010] [AC:Z99113:AL009126] [GN:ymaH]
[FN:unknown] [OR:*Bacillus subtilis*] [DB:genpept-bct1] [DE:*Bacillus subtilis*
complete genome (section 10 of 21):from 1781201 to 2014980.] [NT:similar to
host factor-1 protein] [LE:85414] [RE:856351] [DI:direct]

| ORF Name | NT ID | AA ID | NT LN | AA LN | Score | P-Value |
|---|---|---|---|---|---|---|
| AI7503000983__6933390__c1__759 | 616 | 4388 | 552 | 183 | 402 | 1.9e−37 |

Description
sp:[LN:GLPP__BACSU] [AC:P30300] [GN:GLPP] [OR:*BACILLUS SUBTILIS*] [DE:GLYCEROL
UPTAKE OPERON ANTITERMINATOR REGULATORY PROTEIN] [SP:P30300] [DB:swissprot]
>pir:[LN:B47700] [AC:B47700:D69634] [PN:glycerol metabolism regulatory
protein GlpP] [GN:glpP] [OR:*Bacillus subtilis*] [DB:pir2] [MP:75 (degrees)]
>gp:[GI:g142996] [LN:BACGLPPFK] [AC:M99611] [PN:regulatory protein]
[GN:glpP] [FN:putative antiterminator] [OR:*Bacillus subtilis*] [SR:*Bacillus
subtilis* DNA] [DB:genpept-bct1] [DE:*Bacillus subtilis* antiterminator
regulatory protein (glpP), glycerol uptake facilitator (glpF) genes, complete
cds, glycerolkinase (glpK) gene, 5' end.] [LE:328] [RE:906] [DI:direct]
>gp:[GI:e1182916:g2633250] [LN:BSUB0005] [AC:Z99108:AL009126]
[PN:transcription antiterminator] [GN:glpP] [FN:control of mRNA stability of
glpD] [OR:*Bacillus subtilis*] [DB:genpept-bct1] [DE:*Bacillus subtilis*
complete genome (section 5 of 21):from 802821 to 1011250.] [SP:P30300]
[LE:198429] [RE:199007] [DI:direct] >gp:[GI:e1182928:g2633262] [LN:BSUB0006]
[AC:Z99109:AL009126] [PN:transcription antiterminator] [GN:glpP] [FN:control
of mRNA stability of glpD] [OR:*Bacillus subtilis*] [DB:genpept-bct1]
[DE:*Bacillus subtilis* complete genome (section 6 of 21):from 999501
to 1209940.] [SP:P30300] [LE:1749] [RE:2327] [DI:direct]
>gp:[GI:e324939:g2226135] [LN:BSY14079] [AC:Y14079] [PN:regulatory protein]
[GN:glpP] [FN:putative antiterminator] [OR:*Bacillus subtilis*]
[DB:genpept-bct1] [DE:*Bacillus subtilis* chromosomal DNA, region 75 degrees:
glpPFKDoperon and downstream.] [NT:see EMBL M99611 and Swiss Prot P30300.]
[SP:P30300] [LE:1397] [RE:1975] [DI:direct]

| ORF Name | NT ID | AA ID | NT LN | AA LN | Score | P-Value |
|---|---|---|---|---|---|---|
| AI7503000983__7064077__c1__740 | 617 | 4389 | 2187 | 728 | 2508 | 1.3e−260 |

Description
sp:[LN:IF2__BACSU] [AC:P17889:O31757] [GN:INFB] [OR:*BACILLUS SUBTILIS*]
[DE:TRANSLATION INITIATION FACTOR IF-2] [SP:P17889:O31757] [DB:swissprot]
>pir:[LN:A35269] [AC:A35269:B35269:S31994:G69644] [PN:translation
initiation factor IF-2] [GN:infB] [CL:translation initiation factor
IF-2:translation elongation factor Tu homology] [OR:*Bacillus subtilis*]
[DB:pir1] >gp:[GI:g143359] [LN:BACPSIF2A] [AC:M34836] [OR:*Bacillus subtilis*]
[SR:*B. subtilis* (strain RS410) DNA, clones lambda-JET[1, 2], pUK, an]
[DB:genpept-bct1] [DE:*B. subtilis* protein synthesis initiation factor 2
(infB) gene, complete cds.] [NT:protein synthesis initiation factor 2 (infB)]
[LE:381] [RE:2531] [DI:direct] >gp:[GI:g49319] [LN:BSORF1T7A] [AC:Z18631]
[GN:IF2] [OR:*Bacillus subtilis*] [DB:genpept-bct1] [DE:*B. subtilis* infB-nusA
operon.] [SP:P17889] [LE:2689] [RE:4839] [DI:direct]

| ORF Name | NT ID | AA ID | NT LN | AA LN | Score | P-Value |
|---|---|---|---|---|---|---|
| AI7503000983__7203176__c1__810 | 618 | 4390 | 801 | 266 | 426 | 5.4e−40 |

Description
sp:[LN:TRPA__METJA] [AC:Q60180] [GN:TRPA:MJ1038] [OR:*METHANOCOCCUS
JANNASCHII*] [EC:4.2.1.20] [DE:TRYPTOPHAN SYNTHASE ALPHA CHAIN,] [SP:Q60180]
[DB:swissprot] >pir:[LN:E64429] [AC:E64429] [PN:tryptophan synthase, alpha
chain] [CL:tryptophan synthase alpha chain:tryptophan synthase alpha chain
homology] [OR:*Methanococcus jannaschii*] [EC:4.2.1.20] [DB:pir2]
[MP:FOR969735–970589] >gp:[GI:g1591691] [LN:U67546] [AC:U67546:L77117]
[PN:tryptophan synthase alpha subunit (trpA)] [GN:MJ1038] [OR:*Methanococcus
jannaschii*] [DB:genpept-bct2] [DE:*Methanococcus jannaschii* section 88 of 150
of the complete genome.] [NT:similar to GB:M65060 SP:P26920 PID:149750]
[LE:5837] [RE:6691] [DI:direct]

| ORF Name | NT ID | AA ID | NT LN | AA LN | Score | P-Value |
|---|---|---|---|---|---|---|
| AI7503000983__7242250__c2__924 | 619 | 4391 | 681 | 226 | 306 | 2.8e−27 |

Description
gp:[GI:g5002553] [LN:AF074603] [AC:AF074603] [PN:NonF] [GN:nonF]

-continued

[OR:*Streptomyces griseus* subsp. *griseus*] [DB:genpept-bct2] [DE:*Streptomyces griseus* subsp. *griseus* nonactin biosynthesis gene cluster, partial sequence.] [LE:12384] [RE:13088] [DI:direct]

| ORF Name | NT ID | AA ID | NT LN | AA LN | Score | P-Value |
|---|---|---|---|---|---|---|
| AI7503000983_801552_f2_228 | 620 | 4392 | 381 | 126 | 74 | 0.011 |

Description
gp:[GI:g2454643] [LN:AF020905] [AC:AF020905] [PN:E5] [GN:E5] [OR:common chimpanzee papillomavirus 1] [DB:genpept-vrl] [DE:Common chimpanzee papillomavirus 1, complete genome.] [LE:3901] [RE:4185] [DI:direct]

| ORF Name | NT ID | AA ID | NT LN | AA LN | Score | P-Value |
|---|---|---|---|---|---|---|
| AI7503000983_835252_f1_13 | 621 | 4393 | 156 | 51 | | |

Description
NO-HIT

| ORF Name | NT ID | AA ID | NT LN | AA LN | Score | P-Value |
|---|---|---|---|---|---|---|
| AI7503000983_837550_c2_914 | 622 | 4394 | 246 | 81 | | |

Description
NO-HIT

| ORF Name | NT ID | AA ID | NT LN | AA LN | Score | P-Value |
|---|---|---|---|---|---|---|
| AI7503000983_869052_c2_876 | 623 | 4395 | 1677 | 558 | 1700 | 5.3e−175 |

Description
sp:[LN:GLPD_BACSU] [AC:P18158] [GN:GLPD] [OR:*BACILLUS SUBTILIS*]
[EC:1.1.99.5] [DE:AEROBIC GLYCEROL-3-PHOSPHATE DEHYDROGENASE,] [SP:P18158]
[DB:swissprot] >pir:[LN:C45868] [AC:C45868:A69634:S18565]
[PN:glycerol-3-phosphate dehydrogenase, glpD] [GN:glpD] [OR:*Bacillus subtilis*] [EC:1.1.99.5] [DB:pir2] >gp:[GI:g142993] [LN:BACGLPKD] [AC:M34393]
[OR:*Bacillus subtilis*] [SR:*B. subtilis* (strain W168) DNA] [DB:genpept-bct1]
[DE:*B. subtilis* glycerol kinase (glpK) and glycerol-3-phosphatedehydrogenase (glpD) genes, complete cds.] [NT:glycerol-3-phosphate dehydrogenase (glpD)]
[EC] [LE:2329] [RE:3996] [DI:direct] >gp:[GI:e1182919:g2633253]
[LN:BSUB0005] [AC:Z99108:AL009126] [PN:glycerol-3-phosphate dehydrogenase]
[GN:glpD] [FN:glycerol utilization] [OR:*Bacillus subtilis*] [DB:genpept-bct1]
[EC:1.1.99.5] [DE:*Bacillus subtilis* complete genome (section 5 of 21):from 802821 to 1011250.] [SP:P18158] [LE:201660] [RE:203327] [DI:direct]
>gp:[GI:e1182931:g2633265] [LN:BSUB0006] [AC:Z99109:AL009126]
[PN:glycerol-3-phosphate dehydrogenase] [GN:glpD] [FN:glycerol utilization]
[OR:*Bacillus subtilis*] [DB:genpept-bct1] [EC:1.1.99.5] [DE:*Bacillus subtilis* complete genome (section 6 of 21):from 999501 to 1209940.] [SP:P18158]
[LE:4980] [RE:6647] [DI:direct] >gp:[GI:e324942:g2226138] [LN:BSY14079]
[AC:Y14079] [PN:glycerol-3-phosphate dehydrogenase] [GN:glpD] [OR:*Bacillus subtilis*] [DB:genpept-bct1] [DE:*Bacillus subtilis* chromosomal DNA, region 75 degrees:glpPFKDoperon and downstream.] [NT:see EMBL M34393 and Swiss Prot P18158.] [SP:P18158] [LE:4628] [RE:6295] [DI:direct]

| ORF Name | NT ID | AA ID | NT LN | AA LN | Score | P-Value |
|---|---|---|---|---|---|---|
| AI7503000983_891700_c2_865 | 624 | 4396 | 867 | 288 | 599 | 2.5e−58 |

Description
pir:[LN:S22397] [AC:522397] [PN:pyruvate synthase, beta chain] [CL:pyruvate synthase beta chain] [OR:*Halobacterium halobium*] [EC:1.2.7.1] [DB:pir2]
>gp:[GI:g43499] [LN:HHFEROXI] [AC:X64521] [PN:ferredoxin oxidoreductase]
[OR:*Halobacterium halobium*] [DB:genpept-bct1] [EC:1.2.7.1] [DE:*H. halobium* gene for pyruvate:ferredoxin oxidoreductase.] [NT:beta-subunit; pyruvate synthase] [LE:2057] [RE:2995] [DI:direct]

| ORF Name | NT ID | AA ID | NT LN | AA LN | Score | P-Value |
|---|---|---|---|---|---|---|
| AI7503000983_892186_f1_171 | 625 | 4397 | 129 | 42 | | |

Description
NO-HIT

| ORF Name | NT ID | AA ID | NT LN | AA LN | Score | P-Value |
|---|---|---|---|---|---|---|
| AI7503000983_893826_f2_384 | 626 | 4398 | 123 | 40 | 49 | 0.031 |

Description

-continued pir:[LN:D64600] [AC:D64600] [PN:conserved hypothetical integral membrane protein HP0644] [OR:*Helicobacter pylori*] [DB:pir2] >gp:[GI:g2313764] [LN:AE000578] [AC:AE000578:AE000511] [PN:conserved hypothetical integral membrane] [GN:HP0644] [OR:*Helicobacter pylori* 26695] [DB:genpept-bct2] [DE:*Helicobacter pylori* 26695 section 56 of 134 of the complete genome.] [NT:similar to SP:P25254 percent identity:30.26;] [LE:6414] [RE:6707] [DI:direct]

| ORF Name | NT ID | AA ID | NT LN | AA LN | Score | P-Value |
|---|---|---|---|---|---|---|
| AI7503000983_9767263_c2_866 | 627 | 4399 | 639 | 212 | 280 | 1.6e−24 |

Description
pir:[LN:A69922] [AC:A69922] [PN:phage-related replication protein homolog yoqZ] [GN:yoqZ] [CL:phage-related replication protein] [OR:*Bacillus subtilis*] [DB:pir2] >gp:[GI:e1185518:g2634439] [LN:BSUB0011] [AC:Z99114:AL009126] [GN:yoqZ] [FN:unknown] [OR:*Bacillus subtilis*] [DB:genpept-bct1] [DE:*Bacillus subtilis* complete genome (section 11 of 21): from 2000171 to 2207900.] [NT:similar to phage-related protein] [LE:189032] [RE:189856] [DI:complement] >gp:[GI:g3025599] [LN:AF020713] [AC:AF020713] [GN:yoqZ] [OR:Bacteriophage SPBc2] [DB:genpept-phg] [DE:Bacteriophage SPBc2 complete genome.] [NT:similar to bacteriophage SPP1 ORF37.1 product] [LE:95664] [RE:96488] [DI:direct]

| ORF Name | NT ID | AA ID | NT LN | AA LN | Score | P-Value |
|---|---|---|---|---|---|---|
| AI7503000983_978450_c1_804 | 628 | 4400 | 2049 | 682 | 965 | 4.1e−97 |

Description
gp:[GI:d1025380:g2804528] [LN:D85082] [AC:D85082] [PN:YfiX] [OR:*Bacillus subtilis*] [SR:*Bacillus subtilis* DNA] DB:genpept-bct1] [DE:*Bacillus subtilis* DNA, genome sequence, 79 to 81 degree region.] [LE:7094] [RE:8926] [DI:direct]

| ORF Name | NT ID | AA ID | NT LN | AA LN | Score | P-Value |
|---|---|---|---|---|---|---|
| AI7503000983_9798180_c1_792 | 629 | 4401 | 204 | 67 | | |

Description
NO-HIT

| ORF Name | NT ID | AA ID | NT LN | AA LN | Score | P-Value |
|---|---|---|---|---|---|---|
| AI7503000983_9804202_c1_732 | 630 | 4402 | 627 | 208 | 704 | 1.9e−69 |

Description
pir:[LN:B69727] [AC:B69727] [PN:translation elongation factor EF-Ts tsf] [GN:tsf] [CL:translation elongation factor EF-Ts] [OR:*Bacillus subtilis*] [DB:pir2] >gp:[GI:e1185241:g2634022] [LN:BSUB0009] [AC:Z99112:AL009126] [PN:elongation factor Ts] [GN:tsf] [OR:*Bacillus subtilis*] [DB:genpept-bct1] [DE:*Bacillus subtilis* complete genome (section 9 of 21):from 1598421 to 1807200.] [SP:P80700] [LE:119747] [RE:120628] [DI:direct]

| ORF Name | NT ID | AA ID | NT LN | AA LN | Score | P-Value |
|---|---|---|---|---|---|---|
| AI7503000983_9807807_c1_748 | 631 | 4403 | 873 | 290 | 522 | 3.6e−50 |

Description
gp:[GI:g1842437] [LN:BSU87792] [AC:U87792] [PN:unknown] [OR:*Bacillus subtilis*] [DB:genpept-bct1] [DE:*Bacillus subtilis* tRNA-Ala, phosphatidylglycerophosphate synthase(pgsA) and CinA (cinA) genes, complete cds, and RecA (recA) gene, partial cds.] [NT:hypothetical 17.9 kDa protein; ORF158] [LE:3676] [RE:4152] [DI:direct]

| ORF Name | NT ID | AA ID | NT LN | AA LN | Score | P-Value |
|---|---|---|---|---|---|---|
| AI7503000983_9814213_f3_499 | 632 | 4404 | 471 | 156 | 232 | 1.9e−19 |

Description
pir:[LN:C69419] [AC:C69419] [PN:phosphate ABC transporter, periplasmic phosphate-binding protein (phoX) homolog] [CL:sphX protein] [OR:*Archaeoglobus fulgidus*] [DB:pir2] >gp:[GI:g2649219] [LN:AE001010] [AC:AE001010:AE000782] [PN:phosphate ABC transporter, periplasmic] [GN:AF1356] [OR:*Archaeoglobus fulgidus*] [DB:genpept-bct2] [DE:*Archaeoglobus fulgidus* section 97 of 172 of the complete genome.] [NT:similar to PID:1052826 percent identity:25.09;] [LE:4300] [RE:5283] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000983_9862675_f2_310 | 633 | 4405 | 135 | 44 | | |

Description
NO-HIT

| ORF Name | NT ID | AA ID | NT LN | AA LN | Score | P-Value |
|---|---|---|---|---|---|---|
| AI7503000983_995967_c2_888 | 634 | 4406 | 747 | 248 | 341 | 5.4e−31 |

Description
pir:[LN:B70039] [AC:B70039] [PN:hypothetical protein yvfS] [GN:yvfS]
[OR:*Bacillus subtilis*] [DB:pir2] >gp:[GI:e1186096:g2635921] [LN:BSUB0018]
[AC:Z99121:AL009126] [GN:yvfS] [FN:unknown] [OR:*Bacillus subtilis*]
[DB:genpept-bct1] [DE:*Bacillus subtilis* complete genome (section 18 of 21):
from 3399551 to 3609060.] [LE:97127] [RE:97864] [DI:complement]
>gp:[GI:e313010:g1945719] [LN:BSZ94043] [AC:Z94043] [PN:hypothetical
protein] [GN:yvfS] [OR:*Bacillus subtilis*] [DB:genpept-bct1] [DE:*B. subtilis*
genomic DNA fragment (88 kb).] [NT:probable permease] [LE:83807] [RE:84544]
[DI:direct]

| ORF Name | NT ID | AA ID | NT LN | AA LN | Score | P-Value |
|---|---|---|---|---|---|---|
| AI7503000984_10017151_f3_388 | 635 | 4407 | 132 | 43 | | |

Description
NO-HIT

| ORF Name | NT ID | AA ID | NT LN | AA LN | Score | P-Value |
|---|---|---|---|---|---|---|
| AI7503000984_10039050_f1_17 | 636 | 4408 | 165 | 54 | | |

Description
NO-HIT

| ORF Name | NT ID | AA ID | NT LN | AA LN | Score | P-Value |
|---|---|---|---|---|---|---|
| AI7503000984_10193760_f1_89 | 637 | 4409 | 165 | 54 | | |

Description
NO-HIT

| ORF Name | NT ID | AA ID | NT LN | AA LN | Score | P-Value |
|---|---|---|---|---|---|---|
| AI7503000984_10553125_f3_371 | 638 | 4410 | 810 | 269 | 335 | 1.6e−31 |

Description
gp:[GI:g211700] [LN:CHKCX] [AC:M13496] [PN:type X collagen] [OR:*Gallus
gallus*] [SR:Chicken red blood cell DNA, clone pYN92E1; and embryo
chondrocyte] [DB:genpept-vrt] [DE:Chicken type X collagen gene.] [LE:<380]
[RE:2208] [DI:direct]

| ORF Name | NT ID | AA ID | NT LN | AA LN | Score | P-Value |
|---|---|---|---|---|---|---|
| AI7503000984_10665903_c1_491 | 639 | 4411 | 378 | 125 | 151 | 6.0e−10 |

Description
sp:[LN:YCGC_ECOLI] [AC:P37349:P76013] [GN:YCGC] [OR:*ESCHERICHIA COLI*]
[DE:HYPOTHETICAL 51.6 KD PROTEIN IN TREA-PTH INTERGENIC REGION]
[SP:P37349:P76013] [DB:swissprot] >pir:[LN:C64866] [AC:C64866
[PN:trehalase precursor] [GN:ycgC] [CL:phosphotransferase system
phosphohistidine-containing protein homology] [OR:*Escherichia coli*]
[DB:pir2] >gp:[GI:d1037041:g4062781] [LN:D90754] [AC:D90754:AB001340]
[PN:Hypothetical protein in treA 5'region.] [GN:ycgC] [OR:*Escherichia coli*]
[SR:*Escherichia coli*(strain:K12) DNA, clone:Kohara clone #245]
[DB:genpept-bct1] [DE:*Escherichia coli* genomic DNA. (26.8–27.1 mm).]
[NT:ORF_ID:o245#7; similar to SwissProt Accession] [LE:9793] [RE:11214]
[DI:complement] >gp:[GI:g1787448] [LN:AE000218] [AC:AE000218:U00096]
[PN:putative PTS system enzyme I] [GN:ycgC] [FN:putative transport; Not
classified] [OR:*Escherichia coli*] [DB:genpept-bct2] [DE:*Escherichia coli*
K-12 MG1655 section 108 of 400 of the complete genome.] [NT:f473; 100 pct
identical to fragment YCGC_ECOLI] [LE:3099] [RE:4520] [DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000984__10828312__f1__104 | 640 | 4412 | 1617 | 538 | 272 | 1.2e−20 |

Description
pir:[LN:D69796] [AC:D69796] [PN:two-component sensor histidine kinase
homolog yesM] [GN:yesM] [OR:*Bacillus subtilis*] [DB:pir2]
>gp:[GI:e1182674:g2633008] [LN:BSUB0004] [AC:Z99107:AL009126] [GN:yesM]
[FN:unknown] [OR:*Bacillus subtilis*] [DB:genpept-bct1] [DE:*Bacillus subtilis*
complete genome (section 4 of 21):from 600701 to 813890.] [NT:similar to
two-component sensor histidine kinase] [LE:157527] [RE:159260] [DI:direct]

| ORF Name | NT ID | AA ID | NT LN | AA LN | Score | P-Value |
|---|---|---|---|---|---|---|
| AI7503000984__1182765__c3__673 | 641 | 4413 | 7215 | 2404 | 2909 | 0.0 |

Description
gp:[GI:g2982196] [LN:AF007865] [AC:AF007865] [PN:bacitracin synthetase 3]
[GN:bacC] [OR:*Bacillus licheniformis*] [DB:genpept-bct2] [DE:*Bacillus
licheniformis* bacitracin synthetase operon, complete sequence; BacS (bacS),
BcrA (bcrA), BcrB (bcrB), and BcrC (bcrC) genes, complete cds.] [NT:peptide
synthetase; BA3; BacC] [LE:25258] [RE:44337] (DI:direct]

| ORF Name | NT ID | AA ID | NT LN | AA LN | Score | P-Value |
|---|---|---|---|---|---|---|
| AI7503000984__11832518__c2__558 | 642 | 4414 | 144 | 47 | | |

Description
NO-HIT

| ORF Name | NT ID | AA ID | NT LN | AA LN | Score | P-Value |
|---|---|---|---|---|---|---|
| AI7503000984__11895058__c1__444 | 643 | 4415 | 939 | 312 | 164 | 5.1e−10 |

Description
pir:[LN:S25140] [AC:S25140] [PN:serine proteinase homolog] [OR:*Enterococcus
faecalis*] [DB:pir2] >gp:[GI:g43338] [LN:EFSPREG] [AC:Z12296]
[PN:Staphylococcal serine proteinase homologue] [GN:sprE] [OR:*Enterococcus*
faecalis] [DB:genpept-bct1] [DE:*E. faecalis* sprE gene for serine proteinase
homologue.] [LE:91] [RE:945] [DI:direct]

| ORF Name | NT ID | AA ID | NT LN | AA LN | Score | P-Value |
|---|---|---|---|---|---|---|
| AI7503000984__12554627__c3__625 | 644 | 4416 | 216 | 71 | | |

Description
NO-HIT

| ORF Name | NT ID | AA ID | NT LN | AA LN | Score | P-Value |
|---|---|---|---|---|---|---|
| AI7503000984__1367200__f2__264 | 645 | 4417 | 624 | 207 | 104 | 0.00095 |

Description
Sp:[LN:VS10__ROTBS] [AC:P34718] [GN:S10] [OR:*BOVINE ROTAVIRUS*] [SR:GROUP C/
SHINTOKU,] [DE:MINOR OUTER CAPSID PROTEIN (NS26)] [SP:P34718] [DB:swissprot]

| ORF Name | NT ID | AA ID | NT LN | AA LN | Score | P-Value |
|---|---|---|---|---|---|---|
| AI7503000984__1367202__c1__489 | 646 | 4418 | 963 | 320 | 516 | 1.1e−60 |

Description
pir:[LN:E64866] [AC:E64866] [PN:hypothetical protein b1200] [OR:*Escherichia
coli*] [DB:pir2] >gp:[GI:d1037043:g4062783] [LN:D90754] [AC:D90754:AB001340]
[PN:Hypothetical protein] [OR:*Escherichia coli*] [SR:*Escherichia
coli* (strain:K12) DNA, clone:Kohara clone #245] [DB:genpept-bct1]
[DE:*Escherichia coli* genomic DNA. (26.8–27.1 min).] [NT:ORF__ID:o246#2;
similar to PIR Accession Number] [LE:11865] [RE:12965] [DI:complement]
>gp:[GI:g1787450] [LN:AE000218] [AC:AE000218:U00096] [PN:putative
dihydroxyacetone kinase (EC 2.7.1.2)] [GN:b1200] [FN:putative enzyme; Not
classified] [OR:*Escherichia coli*] [DB:genpept-bct2] [DE:*Escherichia coli*
K-12 MG1655 section 108 of 400 of the complete genome.] [NT:f366; 35 pct
identical (32 gaps) to 355 residues] [LE:5171] [RE:6271] [DI:complement]

| ORF Name | NT ID | AA ID | NT LN | AA LN | Score | P-Value |
|---|---|---|---|---|---|---|
| AI7503000984__1367340__c1__424 | 647 | 4419 | 843 | 280 | 250 | 9.9e−31 |

Description
gp:[GI:e187587:g1420862] [LN:SPOPPDACA] [AC:X89237]
EPN:oligopeptidepermease] [GN:oppD] [OR:*Streptococcus pyogenes*]
[DB:genpept-bct1] [DE:*S. pyogenes* DNA for oppA, oppB, oppC, oppD, oppF, and -continued dacA genes.] [LE:5854] [RE:6924] [DI:direct]

| ORF Name | NT ID | AA ID | NT LN | AA LN | Score | P-Value |
|---|---|---|---|---|---|---|
| AI7503000984__13707008__f3__321 | 648 | 4420 | 231 | 76 | | |

Description
NO-HIT

| ORF Name | NT ID | AA ID | NT LN | AA LN | Score | P-Value |
|---|---|---|---|---|---|---|
| AI7503000984__1385962__c3__666 | 649 | 4421 | 984 | 327 | 1016 | 1.6e−102 |

Description
sp:[LN:BIOB_BACSU] [AC:P53557] [GN:BIOB] [OR:*BACILLUS SUBTILIS*] [EC:2.8.1.6]
[DE:BIOTIN SYNTHASE, (BIOTIN SYNTHETASE)] [SP:P53557] [DB:swissprot]
>pir:[LN:D69594] [AC:D69594] [PN:biotin synthetase bioB] [GN:bioB]
[CL:biotin synthetase] [OR:*Bacillus subtilis*] [DB:pir2] >gp:[GI:g1277029]
[LN:BSU51868] [AC:U51868] [PN:biotin synthase] [GN:bioB] [FN:biotin pathway]
[OR:*Bacillus subtilis*] [DB:genpept-bct1] [DE:*Bacillus subtilis* biotin
biosynthetic operon genes, complete and partial cds.] [LE:6088] [RE:7095]
[DI:direct] >gp:[GI:e1185893:g2635504] [LN:BSUB0016] [AC:Z99119:AL009126]
[PN:biotin synthetase] [GN:bioB] [FN:biotin biosynthesis] [OR:*Bacillus
subtilis*] [DB:genpept-bct1] [EC:2.8.1.—] [DE:*Bacillus subtilis* complete
genome (section 16 of 21) from 2997771 to 3213410.] [SP:P53557] [LE:91793]
[RE:92800] [DI:complement] >gp:[GI:g2293187] [LN:AF008220] [AC:AF008220]
[PN:biotin synthase] [GN:bioB] [OR:*Bacillus subtilis*] [DB:genpept-bct2]
[DE:*Bacillus subtilis* rrnB-dnaB genomic region.] [LE:87627] [RE:88634]
[DI:direct]

| ORF Name | NT ID | AA ID | NT LN | AA LN | Score | P-Value |
|---|---|---|---|---|---|---|
| AI7503000984__14492327__c1__486 | 650 | 4422 | 429 | 142 | 495 | 2.6e−47 |

Description
sp:[LN:FOSB_STAEP] [AC:Q03377] [GN:FOSB] [OR:*STAPHYLOCOCCUS EPIDERMIDIS*]
[DE:FOSFOMYCIN RESISTANCE PROTEIN] [SP:Q03377] [DB:swissprot]
>pir:[LN:B48175] [AC:B48175] [PN:fosfomycin resistance protein B]
[CL:fosfomycin resistance protein] [OR:*Staphylococcus epidermidis*] [DB:pir2]
>gp:[GI:g46982] [LN:SEFOSB] [AC:X54227] [GN:fosB] [OR:*Staphylococcus
epidermidis*] [DB:genpept-bct1] [DE:*S. epidermidis* plasmid pIP1842 fosB gene
for FOSB.] [SP:Q03377] [LE:714] [RE:1133] [DI:direct]

| ORF Name | NT ID | AA ID | NT LN | AA LN | Score | P-Value |
|---|---|---|---|---|---|---|
| AI7503000984__14510962__c1__446 | 651 | 4423 | 138 | 45 | | |

Description
NO-HIT

| ORF Name | NT ID | AA ID | NT LN | AA LN | Score | P-Value |
|---|---|---|---|---|---|---|
| AI7503000984__14895212__c3__639 | 652 | 4424 | 822 | 273 | 980 | 1.1e−98 |

Description
gp:[GI:g3800821] [LN:AF076683] [AC:AF076683] [PN:oligopeptide transporter
putative ATPase domain] [GN:opp-1D] [OR:*Staphylococcus aureus*]
[DB:genpept-bct2] [DE:*Staphylococcus aureus* oligopeptide transporter
putative substrate binding domain (opp-1A), oligopeptide transporter putative
membrane permease domain (opp-1B), oligopeptide transporter putative membrane
permease domain (opp-1C), oligopeptide transporter putative ATPase domain
(opp-1D), and oligopeptide transporter putative ATPase domain (opp-1F) genes,
complete cds; and unknown gene.] [LE:3335] [RE:4150] [DI:direct]

| ORF Name | NT ID | AA ID | NT LN | AA LN | Score | P-Value |
|---|---|---|---|---|---|---|
| AI7503000984__157625__c1__428 | 653 | 4425 | 930 | 309 | 111 | 0.00054 |

Description
gp:[GI:e1407888:g4493994] [LN:PFMAL3P7] [AC:AL034559] [GN:MAL3P7.44]
[OR:*Plasmodium falciparum*] [SR:malaria parasite *P. falciparum*]
[DB:genpept-inv1] [DE:*Plasmodium falciparum* MAL3P7, complete sequence.]
[NT:predicted using hexExon; MAL3P7.44 (PFC1065w),] [LE:188885] [RE:191470]
[DI:direct]

| ORF Name | NT ID | AA ID | NT LN | AA LN | Score | P-Value |
|---|---|---|---|---|---|---|
| AI7503000984__162550__c3__650 | 654 | 4426 | 198 | 65 | 49 | 0.035 |

-continued

Description
sp:[LN:YPMB_BACSU] [AC:P54396] [GN:YPMB] [OR:*BACILLUS SUBTILIS*]
[DE:HYPOTHETICAL 17.9 KD PROTEIN IN DING-ASPB INTERGENIC REGION] [SP:P54396]
[DB:swissprot] >pir:[LN:F69938] [AC:F69938] [PN:hypothetical protein ypmB]
[GN:ypmB] [OR:*Bacillus subtilis*] [DB:pir2] >gp:[GI:g1146245] [LN:BACYPIA]
[AC:L47709] [GN:ypmB] [FN:hypothetical] [OR:*Bacillus subtilis*]
[DB:genpept-bct1] [DE:*Bacillus subtilis* (clone YAC15-6B) ypiABF genes,
qcrABC genes, ypjABCDEFGHI genes, birA gene, panBCD genes, dinG gene, ypmB
gene, aspB gene, asnS gene, dnaD gene, nth gene and ypoC gene,
complete cds's.] [NT:putative] [LE:18616] [RE:19101] [DI:direct]
>gp:[GI:e1183683:g2634656] [LN:BSUB0012] [AC:Z99115:AL009126] [GN:ypmB]
[FN:unknown] [OR:*Bacillus subtilis*] [DB:genpept-bct1] [DE:*Bacillus subtilis*
complete genome (section 12 of 21):from 2195541 to 2409220.] [SP:P54396]
[LE:152566] [RE:153051] [DI:complement]

| ORF Name | NT ID | AA ID | NT LN | AA LN | Score | P-Value |
|---|---|---|---|---|---|---|
| AI7503000984_162578_c1_425 | 655 | 4427 | 984 | 327 | 338 | 1.1e−30 |

Description
pir:[LN:A69867] [AC:A69867] [PN:conserved hypothetical protein ykuT]
[GN:ykuT] [OR:*Bacillus subtilis*] [DB:pir2] >gp:[GI:e1181925:g2632241]
[LN:BS16829KB] [AC:AJ222587] [PN:YkuT protein] [GN:ykuT] [OR:*Bacillus
subtilis*] [DB:genpept-bct1] [DE:*Bacillus subtilis* 29 kB DNA fragment from
ykwC gene to cse15 gene.] [LE:25580] [RE:26383] [DI:complement]
>gp:[GI:e1185011:g2633792] [LN:BSUB0008] [AC:Z99111:AL009126] [GN:ykuT]
[FN:unknown] [OR:*Bacillus subtilis*] [DB:genpept-bct1] [DE:*Bacillus subtilis*
complete genome (section 8 of 21):from 1394791 to 1603020.] [NT:similar to
hypothetical proteins] [LE:95836] [RE:96639] [DI:complement]

| ORF Name | NT ID | AA ID | NT LN | AA LN | Score | P-Value |
|---|---|---|---|---|---|---|
| AI7503000984_16486075_f2_138 | 656 | 4428 | 153 | 50 | | |

Description
NO-HIT

| ORF Name | NT ID | AA ID | NT LN | AA LN | Score | P-Value |
|---|---|---|---|---|---|---|
| AI7503000984_165902_c3_674 | 657 | 4429 | 627 | 208 | 185 | 1.8e−14 |

Description
sp:[LN:LP14_BACSU] [AC:P39144] [GN:LPA-14] [OR:*BACILLUS SUBTILIS*]
[DE:LIPOPEPTIDE ANTIBIOTICS ITURIN A AND SURFACTIN BIOSYNTHESIS PROTEIN]
[SP:P39144] [DB:swissprot] >pir:[LN:I39875] [AC:I39875] [PN:siderophore
biosynthesis regulatory protein sfp:lipopeptide antibiotics iturin
A:surfactin production protein] [GN:lpa-14:sfb:sfp:sfp(0)] [CL:siderophore
biosynthesis regulatory protein sfp] [OR:*Bacillus subtilis*] [DB:pir2]
>gp:[GI:d1005421:g473916] [LN:BACLPA14] [AC:D21876] [PN:lipopeptide
antibiotics iturin A] [GN:lpa-14] [OR:*Bacillus subtilis*] [SR:*Bacillus
subtilis* (strain:RB14) DNA] [DB:genpept-bct1] [DE:*B. subtilis* lpa-14 gene
encoding lipopeptide antibiotics iturin A.] [LE:1] [RE:675] [DI:direct]

| ORF Name | NT ID | AA ID | NT LN | AA LN | Score | P-Value |
|---|---|---|---|---|---|---|
| AI7503000984_187561_c1_470 | 658 | 4430 | 879 | 292 | | |

Description
NO-HIT

| ORF Name | NT ID | AA ID | NT LN | AA LN | Score | P-Value |
|---|---|---|---|---|---|---|
| AI7503000984_194010_c3_607 | 659 | 4431 | 1512 | 503 | 1381 | 3.4e−141 |

Description
gp:[GI:d1039113:g4514332] [LN:AB013369] [AC:AB013369] [OR:*Bacillus
halodurans*] [SR:*Bacillus halodurans* (strain:C-125) DNA] [DB:genpept-bct1]
[DE:*Bacillus halodurans* C-125 yesT and comEC genes, partial and complete
cds.] [NT:unknown] [LE:4328] [RE:5830] [DI:direct]

| ORF Name | NT ID | AA ID | NT LN | AA LN | Score | P-Value |
|---|---|---|---|---|---|---|
| AI7503000984_19688401_c2_516 | 660 | 4432 | 126 | 41 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000984_19773387_f3_363 | 661 | 4433 | 1248 | 415 | 746 | 6.6e−74 |

Description
sp:[LN:STPA_STAAU] [AC:P81297] [OR:*STAPHYLOCOCCUS AUREUS*] [EC:3.4.22.—]
[DE:STAPHOPAIN,] [SP:P81297] [DB:swissprot]

| ORF Name | NT ID | AA ID | NT LN | AA LN | Score | P-Value |
|---|---|---|---|---|---|---|
| AI7503000984_20585963_f3_396 | 662 | 4434 | 897 | 298 | 657 | 1.8e−64 |

Description
gp:[GI:g929972] [LN:BAU30714] [AC:U30714] [OR:*Bacillus anthracis*]
[SR:plasmid pXO1] [DB:genpept-bct1] [DE:*Bacillus anthracis* Weybridge A toxin
plasmid pXO1 right inverted repeat element (WeyAR) bordering the
toxin-encoding region, ORFA and ORFB genes, complete cds.] [NT:ORFB; similar
to *B. anthracis* SterneL element ORFB;] [LE:512] [RE:1336] [DI:direct]
>gp:[GI:g929975] [LN:BAU30715] [AC:U30715] [OR:*Bacillus anthracis*]
[SR:plasmid pXO1] [DB:genpept-bct1] [DE:*Bacillus anthracis* Sterne toxin
plasmid pXO1 left inverted repeat element (SterneL) bordering the
toxin-encoding region, ORFB and truncated ORFA genes, complete cds.]
[NT:ORFB; similar to *B. anthracis* WeyAR element ORFB;] [LE:458] [RE:1282]
[DI:direct] >gp:[GI:g4894312] [LN:AF065404] [AC:AF065404] [PN:pXO1-96]
[OR:*Bacillus anthracis*] [DB:genpept-bct2] [DE:*Bacillus anthracis* virulence
plasmid PXO1, complete sequence.] [LE:116307] [RE:117131] [DI:direct]

| ORF Name | NT ID | AA ID | NT LN | AA LN | Score | P-Value |
|---|---|---|---|---|---|---|
| AI7503000984_20704012_f1_106 | 663 | 4435 | 240 | 79 | | |

Description
NO-HIT

| ORF Name | NT ID | AA ID | NT LN | AA LN | Score | P-Value |
|---|---|---|---|---|---|---|
| AI7503000984_20979688_c2_511 | 664 | 4436 | 786 | 261 | 369 | 5.9e−34 |

Description
sp:[LN:NIKC_ECOLI] [AC:P33592] [GN:NIKC] [OR:*ESCHERICHIA COLI*] [DE:NICKEL
TRANSPORT SYSTEM PERMEASE PROTEIN NIKC] [SP:P33592] [DB:swissprot]
>pir:[LN:S39596] [AC:S39596:S47697:A65145] [PN:nikC protein] [GN:nikC]
[CL:oligopeptide permease protein oppB] [OR:*Escherichia coli*] [DB:pir2]
>gp:[GI:g581141] [LN:ECNIK] [AC:X73143] [PN:NikC] [GN:nikC] [OR:*Escherichia
coli*] [DB:genpept-bct1] [DE:*E. coli* DNA sequence of nik locus.] [SP:P33592]
[LE:2942] [RE:3775] [DI:direct] >gp:[GI:g912461] [LN:ECOUW76] [AC:U00039]
[GN:nikC] [OR:*Escherichia coli*] [SR:*Escherichia coli* (sub_strain MG1655,
strain K-12) (library:lambda] [DB:genpept-bct1] [DE:*E. coli* chromosomal
region from 76.0 to 81.5 minutes.] [LE:30444] [RE:31277] [DI:direct]
>gp:[GI:g1789889] [LN:AE000423] [AC:AE000423:U00096] [PN:transport of
nickel, membrane protein] [GN:nikC] [FN:transport; Transport of small
molecules:] [OR:*Escherichia coli*] [DB:genpept-bct2] [DE:*Escherichia coli*
K-12 MG1655 section 313 of 400 of the complete genome.] [NT:o277] [LE:7496]
[RE:8329] [DI:direct]

| ORF Name | NT ID | AA ID | NT LN | AA LN | Score | P-Value |
|---|---|---|---|---|---|---|
| AI7503000984_212827_f3_295 | 665 | 4437 | 1482 | 493 | 429 | 2.6e−40 |

Description
pir:[LN:G70006] [AC:G70006] [PN:multidrug resistance protein homolog yubD]
[GN:yubD] [OR:*Bacillus subtilis*] [DB:pir2] >gp:[GI:e1185986:g2635597]
[LN:BSUB0016] [AC:Z99119:AL009126] [GN:yubD] [FN:unknown] [OR:*Bacillus
subtilis*] [DB:genpept-bct1] [DE:*Bacillus subtilis* complete genome (section
16 of 21):from 2997771 to 3213410.] [NT:similar to multidrug resistance
protein] [LE:193143] [RE:194678] [DI:complement]

| ORF Name | NT ID | AA ID | NT LN | AA LN | Score | P-Value |
|---|---|---|---|---|---|---|
| AI7503000984_21588287_f2_271 | 666 | 4438 | 126 | 41 | | |

Description
NO-HIT

| ORF Name | NT ID | AA ID | NT LN | AA LN | Score | P-Value |
|---|---|---|---|---|---|---|
| AI7503000984_21907016_f1_123 | 667 | 4439 | 132 | 43 | | |

Description
NO-HIT

-continued

| ORF Name | NT ID | AA ID | NT LN | AA LN | Score | P-Value |
|---|---|---|---|---|---|---|
| AI7503000984_22042337_c2_588 | 668 | 4440 | 1434 | 477 | 981 | 8.3e−99 |

Description
pir:[LN:F69763] [AC:F69763] [PN:multidrug resistance protein homolog ycnB]
[GN:ycnB] [CL:lincomycin-resistance protein lmrB] [OR:*Bacillus subtilis*]
[DB:pir2] >gp:[GI:e1182351:g2632685] [LN:BSUB0003] [AC:Z99106:AL009126]
[GN:ycnB] [FN:unknown] [OR:*Bacillus subtilis*] [DB:genpept-bct1] [DE:*Bacillus subtilis* complete genome (section 3 of 21):from 402751 to 611850.]
[NT:similar to multidrug resistance protein] [LE:32866] [RE:34284]
[DI:complement] >gp:[GI:d1009651:g1805454] [LN:D50453] [AC:D50453]
[PN:homologue of multidrug resistance protein B,] [GN:ycnB] [OR:*Bacillus subtilis*] [SR:*Bacillus subtilis* (strain:168 trpC2) DNA] [DB:genpept-bct1]
[DE:*Bacillus subtilis* DNA for 25–36 degree region containing theamyE-srfA
region, complete cds.] [LE:115269] [RE:116687] [DI:complement]

| ORF Name | NT ID | AA ID | NT LN | AA LN | Score | P-Value |
|---|---|---|---|---|---|---|
| AI7503000984_222323413_c2_518 | 669 | 4441 | 144 | 47 | | |

Description
NO-HIT

| ORF Name | NT ID | AA ID | NT LN | AA LN | Score | P-Value |
|---|---|---|---|---|---|---|
| AI7503000984_22464127_f2_191 | 670 | 4442 | 153 | 50 | | |

Description
NO-HIT

| ORF Name | NT ID | AA ID | NT LN | AA LN | Score | P-Value |
|---|---|---|---|---|---|---|
| AI7503000984_22537818_c2_513 | 671 | 4443 | 150 | 49 | | |

Description
NO-HIT

| ORF Name | NT ID | AA ID | NT LN | AA LN | Score | P-Value |
|---|---|---|---|---|---|---|
| AI7503000984_22664140_f3_335 | 672 | 4444 | 1395 | 464 | 191 | 1.0e−11 |

Description
pir:[LN:F69280] [AC:F69280] [PN:iron (II) transporter (feoB-1) homolog]
[CL:ferrous iron transport protein B:translation elongation factor Tu
homology] [OR:*Archaeoglobus fulgidus*] [DB:pir2] >gp:[GI:g2650395]
[LN:AE001089] [AC:AE001089:AE000782] [PN:iron (II) transporter (feoB-1)]
[GN:AF0246] [OR:*Archaeoglobus fulgidus*] [DB:genpept-bct2] [DE:*Archaeoglobus fulgidus* section 18 of 172 of the complete genome.] [NT:similar to GB:L77117
SP:Q57986 PID:1591272 percent] [LE:10039] [RE:11958] [DI:complement]

| ORF Name | NT ID | AA ID | NT LN | AA LN | Score | P-Value |
|---|---|---|---|---|---|---|
| AI7503000984_22664550_c2_512 | 673 | 4445 | 663 | 220 | 275 | 5.4e−24 |

Description
pir:[LN:C65145] [AC:C65145:S39598:S47699] [PN:nikE protein] [GN:nikE]
[CL:unassigned ATP-binding cassette proteins:ATP-binding cassette homology]
[OR:*Escherichia coli*] [DB:pir2] >gp:[GI:g466616] [LN:ECOUW76] [AC:U00039]
[GN:nikE] [OR:*Escherichia coli*] [SR:*Escherichia coli* (sub_strain MG1655,
strain K-12) (library:lambda] [DB:genpept-bct1] [DE:*E. coli* chromosomal
region from 76.0 to 81.5 minutes.] [LE:32038] [RE:32844] [DI:direct]
>gp:[GI:g1789891] [LN:AE000423] [AC:AE000423:U00096] [PN:ATP-binding protein
of nickel transport system] [GN:nikE] [FN:transport; Transport of small
molecules:] [OR:*Escherichia coli*] [DB:genpept-bct2] [DE:*Escherichia coli*
K-12 MG1655 section 313 of 400 of the complete genome.] [NT:o268] [LE:9090]
[RE:9896] [DI:direct]

| ORF Name | NT ID | AA ID | NT LN | AA LN | Score | P-Value |
|---|---|---|---|---|---|---|
| AI7503000984_22853432_c1_448 | 674 | 4446 | 384 | 127 | 152 | 2.4e−10 |

Description
sp:[LN:INVO_PIG] [AC:P18175] [GN:IVL] [OR:*SUS SCROFA*] [SR:,PIG]
[DE:INVOLUCRIN] [SP:P18175] [DB:swissprot] >pir:[LN:I46592] [AC:I46592]
[PN:involucrin] [CL:involucrin] [OR:*Sus scrofa domestica*] [SR:, domestic
pig] [DB:pir2] >gp:[GI:g164523] [LN:PIGINVOLA] [AC:M34441] [OR:*Sus scrofa*]

-continued

[SR:Pig (Yorkshire) adult skin keratinocyte DNA] [DB:genpept-mam] [DE:Pig involucrin gene, complete cds.] [NT:involucrin] [LE:1] [RE:1044] [DI:direct]

| ORF Name | NT ID | AA ID | NT LN | AA LN | Score | P-Value |
|---|---|---|---|---|---|---|
| AI7503000984_23444425_c1_426 | 675 | 4447 | 846 | 281 | 362 | 3.2e−33 |

Description
pir:[LN:B69834] [AC:B69834] [PN:conserved hypothetical protein yhjK] [GN:yhjK] [OR:*Bacillus subtilis*] [DB:pir2] >gp:[GI:e1183056:g2633390] [LN:BSUB0006] [AC:Z99109:AL009126] [GN:yhjK] [FN:unknown] [OR:*Bacillus subtilis*] [DB:genpept-bct1] [DE:*Bacillus subtilis* complete genome (section 6 of 21):from 999501 to 1209940.] [NT:similar to hypothetical proteins] [LE:127427] [RE:128287] [DI:complement] >gp:[GI:e324984:g2226183] [LN:BSY14081] [AC:Y14081] [PN:hypothetical protein] [GN:yhjK] [OR:*Bacillus subtilis*] [DB:genpept-bct1] [DE:*Bacillus subtilis* chromosomal DNA, region 92 degrees:region between comK and addAB.] [NT:Similarity to a large family of hypothetical] [LE:9722] [RE:10582] [DI:complement]

| ORF Name | NT ID | AA ID | NT LN | AA LN | Score | P-Value |
|---|---|---|---|---|---|---|
| AI7503000984_23470290_c2_554 | 676 | 4448 | 915 | 304 | 1205 | 1.5e−122 |

Description
gp:[GI:g3800820] [LN:AF076683] [AC:AF076683] [PN:oligopeptide transporter putative membrane] [GN:opp-1C] [OR:*Staphylococcus aureus*] [DB:genpept-bct2] [DE:*Staphylococcus aureus* oligopeptide transporter putative substrate binding domain (opp-1A), oligopeptide transporter putative membrane permease domain (opp-1B), oligopeptide transporter putative membrane permease domain (opp-1C), oligopeptide transporter putative ATPase domain (opp-1D), and oligopeptide transporter putative ATPase domain (opp-1F) genes, complete cds; and unknown gene.] [LE:2469] [RE:3338] [DI:direct]

| ORF Name | NT ID | AA ID | NT LN | AA LN | Score | P-Value |
|---|---|---|---|---|---|---|
| AI7503000984_235837_c1_471 | 677 | 4449 | 1425 | 474 | | |

Description
NO-HIT

| ORF Name | NT ID | AA ID | NT LN | AA LN | Score | P-Value |
|---|---|---|---|---|---|---|
| AI7503000984_23601510_c1_488 | 678 | 4450 | 1137 | 378 | 911 | 2.2e−91 |

Description
sp:[LN:GLDA_BACST] [AC:P32816] [GN:GLDA:GLD] [OR:*BACILLUS STEAROTHERMOPHILUS*] [EC:1.1.1.6] [DE:GLYCEROL DEHYDROGENASE, (GLDH)] [SP:P32816] [DB:swissprot] >pir:[LN:JQ1474] [AC:JQ1474:S38514] [PN:glycerol dehydrogenase,] [GN:gldA] [CL:glycerol dehydrogenase:lactaldehyde reductase homology] [OR:*Bacillus stearothermophilus*] [EC:1.1.1.6] [DB:pir2] >gp:[GI:g142978] [LN:BACGLDA] [AC:M65289] [PN:glycerol dehydrogenase] [GN:gld] [OR:*Bacillus stearothermophilus*] [SR:*Bacillus stearothermophilus* (sub_species nondiastaticus) (library] [DB:genpept-bct1] [EC:1.1.1.6] [DE:*Bacillus stearothermophilus* glycerol dehydrogenase (proposed gld) gene, complete cds.] [LE:742] [RE:1854] [DI:direct]

| ORF Name | NT ID | AA ID | NT LN | AA LN | Score | P-Value |
|---|---|---|---|---|---|---|
| AI7503000984_23652218_c1_459 | 679 | 4451 | 168 | 55 | 83 | 0.0012 |

Description
sp:[LN:GGI3_STAHA] [AC:P11699] [OR:*STAPHYLOCOCCUS HAEMOLYTICUS*] [DE:ANTIBACTERIAL PROTEIN 3 (GONOCOCCAL GROWTH INHIBITOR 3)] [SP:P11699] [DB:swissprot] >pir:[LN:BXSA3] [AC:S00601] [PN:antibacterial protein 3:gonococcal growth inhibitor 3] [CL:*Staphylococcus haemolyticus* antibacterial protein] [OR:*Staphylococcus haemolyticus*] [DB:pir1]

| ORF Name | NT ID | AA ID | NT LN | AA LN | Score | P-Value |
|---|---|---|---|---|---|---|
| AI7503000984_23860307_c3_641 | 680 | 4452 | 1218 | 405 | 1603 | 1.0e−164 |

Description
gp:[GI:g3800823] [LN:AF076683] [AC:AF076683] [PN:unknown] [OR:*Staphylococcus aureus*] [DB:genpept-bct2] [DE:*Staphylococcus aureus* oligopeptide transporter putative substrate binding domain (opp-1A), oligopeptide transporter putative membrane permease domain (opp-1B), oligopeptide transporter putative membrane permease domain (opp-1C), oligopeptide transporter putative ATPase domain -continued (opp-1D), and oligopeptide transporter putative ATPase domain (opp-1F) genes, complete cds; and unknown gene.] [NT:orfX] [LE:4904] [RE:6097] [DI:direct]

| ORF Name | NT ID | AA ID | NT LN | AA LN | Score | P-Value |
|---|---|---|---|---|---|---|
| AI7503000984_24000275_f3_303 | 681 | 4453 | 1026 | 341 | 1033 | 2.5e−104 |

Description
sp:[LN:OTCC_HAEIN] [AC:P44770] [GN:ARCB:HI0596] [OR:*HAEMOPHILUS INFLUENZAE*]
[EC:2.1.3.3] [DE:ORNITHINE CARBAMOYLTRANSFERASE, CATABOLIC, (OTCASE)]
[SP:P44770] [DB:swissprot] >pir:[LN:H64079] [AC:H64079] [PN:ornithine
carbamoyltransferase,] [CL:ornithine carbamoyltransferase:
aspartate/ornithine carbamoyltransferase homology] [OR:*Haemophilus
influenzae*] [EC:2.1.3.3] [DB:pir2] >gp:[GI:g1573585] [LN:U32741]
[AC:U32741:L42023] [PN:ornithine carbamoyltransferase (arcB)] [GN:HI0596]
[OR:*Haemophilus influenzae* Rd] [DB:genpept-bct2] [DE:*Haemophilus influenzae*
Rd section 56 of 163 of the complete genome.] [NT:similar to GB:X05637
SP:P08308 PID:45288 percent] [LE:3467] [RE:4471] [DI:complement]

| ORF Name | NT ID | AA ID | NT LN | AA LN | Score | P-Value |
|---|---|---|---|---|---|---|
| AI7503000984_24095387_c1_438 | 682 | 4454 | 129 | 42 | | |

Description
NO-HIT

| ORF Name | NT ID | AA ID | NT LN | AA LN | Score | P-Value |
|---|---|---|---|---|---|---|
| AI7503000984_24105393_c2_562 | 683 | 4455 | 768 | 255 | 711 | 3.4e−70 |

Description
gp:[GI:e1456529:g4914622] [LN:LMAJ9627] [AC:AJ009627] [PN:pyruvate-formate
lyase activating enzyme] [GN:pflC] [OR:*Listeria monocytogenes*]
[DB:genpept-bct1] [DE:*Listeria monocytogenes* pflC, orfA, lltB and orfC
genes.] [NT:putative; similar to *Streptococcus mutans* PflC] [LE:149]
[RE:895] [DI:direct]

| ORF Name | NT ID | AA ID | NT LN | AA LN | Score | P-Value |
|---|---|---|---|---|---|---|
| AI7503000984_24225375_c2_533 | 684 | 4456 | 213 | 70 | 97 | 3.9e−05 |

Description
gp:[GI:g3212079] [LN:AF068633] [AC:AF068633] [PN:phenol soluble modulin beta
1] [FN:inflammatory protein] [OR:*Staphylococcus epidermidis*]
[DB:genpept-bct2] [DE:*Staphylococcus epidermidis* phenol soluble modulin beta
1 and phenolsoluble modulin beta 2 genes, complete cds.] [NT:PSM beta 1]
[LE:669] [RE:803] [DI:direct] >gp:[GI:g3212080] [LN:AF068633] [AC:AF068633]
[PN:phenol soluble modulin beta 2] [FN:inflammatory protein]
[OR:*Staphylococcus epidermidis*] [DB:genpept-bct2] [DE:*Staphylococcus
epidermidis* phenol soluble modulin beta 1 and phenolsoluble modulin beta 2
genes, complete cds.] [NT:PSM beta 2] [LE:859] [RE:993] [DI:direct]

| ORF Name | NT ID | AA ID | NT LN | AA LN | Score | P-Value |
|---|---|---|---|---|---|---|
| AI7503000984_24257881_f1_68 | 685 | 4457 | 138 | 45 | | |

Description
NO-HIT

| ORF Name | NT ID | AA ID | NT LN | AA LN | Score | P-Value |
|---|---|---|---|---|---|---|
| AI7503000984_24266041_f1_22 | 686 | 4458 | 129 | 42 | | |

Description
NO-HIT

| ORF Name | NT ID | AA ID | NT LN | AA LN | Score | P-Value |
|---|---|---|---|---|---|---|
| AI7503000984_24391678_f1_120 | 687 | 4459 | 171 | 56 | | |

Description
NO-HIT

| ORF Name | NT ID | AA ID | NT LN | AA LN | Score | P-Value |
|---|---|---|---|---|---|---|
| AI7503000984_24407677_f3_293 | 688 | 4460 | 234 | 77 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000984__24650300_c1__476 | 689 | 4461 | 1365 | 454 | 1037 | 9.6e−105 |

Description
sp:[LN:BRNQ_LACDL] [AC:P54104] [GN:BRNQ] [OR:*LACTOBACILLUS DELBRUECKII*]
[SR:,SUBSPLACTIS] [DE:CHAIN AMINO ACID UPTAKE CARRIER)] [SP:P54104]
[DB:swissprot] >pir:[LN:S60180] [AC:S60180 ] [PN:branched-chain amino acid
carrier brnQ] [GN:brnQ] [CL:branched-chain amino acid transport system II
carrier protein braZ] [OR:*Lactobacillus delbrueckii*] [DB:pir2]
>gp:[GI:g732813] [LN:LDBRNQGN] [AC:Z48676] [PN:branched-chain amino acid
carrier] [GN:brnQ] [FN:transport of branched-chain amino acids (Leu,]
[OR:*Lactobacillus delbrueckii*] [DB:genpept-bct1] [DE:*L. delbrueckii* brnQ gene
for branched-chain amino acid carrier.] [SP:P54104] [LE:611] [RE:1951]
[DI:direct]

| ORF Name | NT ID | AA ID | NT LN | AA LN | Score | P-Value |
|---|---|---|---|---|---|---|
| AI7503000984__24664012_f2__199 | 690 | 4462 | 453 | 150 | 82 | 0.0052 |

Description
gp:[GI:d1025730:g2879910] [LN:D85752] [AC:D85752] [GN:bacD] [OR:*Enterococcus faecalis*] [SR:*Enterococcus faecalis* plasmid:pPD1 DNA] [DB:genpept-bct1]
[DE:*Enterococcus faecalis* plasmid pPD1 bacA, bacB, bacC, bacD, bacE, bacF,
bacG, bacH and bacI genes, complete cds.] [LE:3977] [RE:4324] [DI:direct]

| ORF Name | NT ID | AA ID | NT LN | AA LN | Score | P-Value |
|---|---|---|---|---|---|---|
| AI7503000984__24711588_c2__589 | 691 | 4463 | 225 | 74 | | |

Description
NO-HIT

| ORF Name | NT ID | AA ID | NT LN | AA LN | Score | P-Value |
|---|---|---|---|---|---|---|
| AI7503000984__24884688_c2__509 | 692 | 4464 | 528 | 175 | 216 | 5.6e−17 |

Description
gp:[GI:g3800818] [LN:AF076683] [AC:AF076683] [PN:oligopeptide transporter
putative substrate] [GN:opp-1A] [OR:*Staphylococcus aureus*] [DB:genpept-bct2]
[DE:*Staphylococcus aureus* oligopeptide transporter putative substrate binding
domain (opp-1A), oligopeptide transporter putative membrane permease domain
(opp-1B), oligopeptide transporter putative membrane permease domain
(opp-1C), oligopeptide transporter putative ATPase domain (opp-1D), and
oligopeptide transporter putative ATPase domain (opp-1F) genes, complete cds;
and unknown gene.] [LE:64] [RE:1524] [DI:direct]

| ORF Name | NT ID | AA ID | NT LN | AA LN | Score | P-Value |
|---|---|---|---|---|---|---|
| AI7503000984__24886552_c3__635 | 693 | 4465 | 792 | 263 | 603 | 9.4e−59 |

Description
gp:[GI:d1037145:g4062842] [LN:AB009078] [AC:AB009078] [PN:L-2.3-butanediol
dehydrogenase] [OR:*Brevibacterium saccharolyticum*] [SR:*Brevibacterium
saccharolyticum* DNA] [DB:genpept-bct1] [DE:*Brevibacterium saccharolyticum*
gene for L-2.3-butanedioldehydrogenase, complete cds.] [LE:1743] [RE:2519]
[DI:direct]

| ORF Name | NT ID | AA ID | NT LN | AA LN | Score | P-Value |
|---|---|---|---|---|---|---|
| AI7503000984__25429665_c1__496 | 694 | 4466 | 1338 | 445 | 267 | 4.3e−21 |

Description
pir:[LN:S58131] [AC:S58131] [PN:integral membrane protein LmrP]
[OR:*Lactococcus lactis*] [DB:pir2] >gp:[GI:g1052754] [LN:LLLMRP] [AC:X89779]
[PN:LmrP integral membrane protein] [GN:lmrP] [OR:*Lactococcus lactis*]
[DB:genpept-bct1] [DE:*L. lactis* DNA for LmrP gene.] [LE:634] [RE:1860]
[DI:direct]

| ORF Name | NT ID | AA ID | NT LN | AA LN | Score | P-Value |
|---|---|---|---|---|---|---|
| AI7503000984__25476378_f1__13 | 695 | 4467 | 159 | 52 | | |

Description
NO-HIT

-continued

| ORF Name | NT ID | AA ID | NT LN | AA LN | Score | P-Value |
|---|---|---|---|---|---|---|
| AI7503000984_25894687_c3_624 | 696 | 4468 | 243 | 80 | | |

Description
NO-HIT

| ORF Name | NT ID | AA ID | NT LN | AA LN | Score | P-Value |
|---|---|---|---|---|---|---|
| AI7503000984_26182681_c3_595 | 697 | 4469 | 528 | 175 | | |

Description
NO-HIT

| ORF Name | NT ID | AA ID | NT LN | AA LN | Score | P-Value |
|---|---|---|---|---|---|---|
| AI7503000984_26208450_f1_24 | 698 | 4470 | 165 | 54 | | |

Description
NO-HIT

| ORF Name | NT ID | AA ID | NT LN | AA LN | Score | P-Value |
|---|---|---|---|---|---|---|
| AI7503000984_26229678_f1_27 | 699 | 4471 | 177 | 58 | | |

Description
NO-HIT

| ORF Name | NT ID | AA ID | NT LN | AA LN | Score | P-Value |
|---|---|---|---|---|---|---|
| AI7503000984_26265641_c2_543 | 700 | 4472 | 147 | 48 | | |

Description
NO-HIT

| ORF Name | NT ID | AA ID | NT LN | AA LN | Score | P-Value |
|---|---|---|---|---|---|---|
| AI7503000984_26367135_c1_508 | 701 | 4473 | 2079 | 692 | 1496 | 2.2e−153 |

Description
sp:[LN:LIP_STAEP] [AC:Q02510] [GN:GEHC] [OR:*STAPHYLOCOCCUS EPIDERMIDIS*]
[EC:3.1.1.3] [DE:LIPASE PRECURSOR, (GLYCEROL ESTER HYDROLASE)] [SP:Q02510]
[DB:swissprot] >pir:[LN:A47705] [AC:A47705] [PN:triacylglycerol lipase,]
[CL:*Staphylococcus* triacyiglycerol lipase] [OR:*Staphylococcus epidermidis*]
[EC:3.1.1.3] [DB:pir2] >gp:[GI:g153022] [LN:STAGEHC] [AC:M95577] [PN:lipase]
[GN:gehC] [OR:*Staphylococcus epidermidis*] [SR:*Staphylococcus epidermidis*
(strain 9) DNA] [DB:genpept-bct1] [DE:*Staphylococcus epidermidis* lipase
(gehC) gene, complete cds.] [NT:GTG start codon] [LE:121] [RE:2187]
[DI:direct]

| ORF Name | NT ID | AA ID | NT LN | AA LN | Score | P-Value |
|---|---|---|---|---|---|---|
| AI7503000984_26369027_f2_260 | 702 | 4474 | 984 | 327 | 1350 | 6.5e−138 |

Description
pir:[LN:E69806] [AC:E69806] [PN:conserved hypothetical protein yfjN]
[GN:yfjN] [OR:*Bacillus subtilis*] [DB:pir2] >gp:[GI:e1182793:g2633127]
[LN:BSUB0005] [AC:Z99108:AL009126] [GN:yfjN] [FN:unknown] [OR:*Bacillus
subtilis*] [DB:genpept-bct1] [DE:*Bacillus subtilis* complete genome (section 5
of 21):from 802821 to 1011250.] [NT:similar to hypothetical proteins]
[LE:73112] [RE:74089] [DI:direct] >gp:[GI:d1025211:g2780398] [LN:D78509]
[AC:D78509] [PN:YfjN] [OR:*Bacillus subtilis*] [SR:*Bacillus subtilis*
(strain:AC327) DNA] [DB:genpept-bct1] [DE:*Bacillus subtilis* YfjG-YfjR genes,
complete cds.] [LE:12236] [RE:13213] [DI:complement]

| ORF Name | NT ID | AA ID | NT LN | AA LN | Score | P-Value |
|---|---|---|---|---|---|---|
| AI7503000984_2660936_f2_253 | 703 | 4475 | 513 | 170 | 373 | 2.2e−34 |

Description
sp:[LN:Y318_HAEIN] [AC:P43984] [GN:HI0318] [OR:*HAEMOPHILUS INFLUENZAE*]
[DE:HYPOTHETICAL PROTEIN HI0318] [SP:P43984] [DB:swissprot] >pir:[LN:B64006]
[AC:B64006] [PN:hypothetical protein HI0318] [OR:*Haemophilus influenzae*]
[DB:pir2] >gp:[GI:g1573288] [LN:U32717] [AC:U32717:L42023] [PN:conserved
hypothetical protein] [GN:HI0318] [OR:*Haemophilus influenzae* Rd]
[DB:genpept-bct2] [DE:*Haemophilus influenzae* Rd section 32 of 163 of the
complete genome.] [NT:similar to SP:P54158 PID:1256620 GB:AL009126]
[LE:4064] [RE:4582] [DI:direct]

| ORF Name | NT ID | AA ID | NT LN | AA LN | Score | P-Value |
|---|---|---|---|---|---|---|
| AI7503000984_26759430_c3_654 | 704 | 4476 | 978 | 325 | 872 | 2.9e−87 |

Description
pir:[LN:E69670] [AC:E69670] [PN:glycine betaine/carnitine/choline ABC
transporter (osmoprotec) opuCC] [GN:opuCC] [OR:*Bacillus subtilis*] [DB:pir2]
>gp:[GI:e1186069:g2635894] [LN:BSUB0018] [AC:Z99121:AL009126] [PN:glycine
betaine/carnitine/choline ABC] [GN:opuCC] [FN:high affinity transport of
glycine betaine,] [OR:*Bacillus subtilis*] [DB:genpept-bct1] [DE:*Bacillus
subtilis* complete genome (section 18 of 21):from 3399551 to 3609060.]
[NT:alternate gene name:yvbC] [LE:67766] [RE:68677] [DI:complement]

| ORF Name | NT ID | AA ID | NT LN | AA LN | Score | P-Value |
|---|---|---|---|---|---|---|
| AI7503000984_26760076_f3_305 | 705 | 4477 | 1578 | 525 | 1550 | 4.2e−159 |

Description
sp:[LN:YFCC_HAEIN] [AC:P44023] [GN:HI0594] [OR:*HAEMOPHILUS INFLUENZAE*]
[DE:HYPOTHETICAL PROTEIN HI0594] [SP:P44023] [DB:swissprot] >pir:[LN:E64010]
[AC:E64010] [PN:hypothetical protein HI0594] [CL:*Haemophilus influenzae*
conserved hypothetical protein HI0594] [OR:*Haemophilus influenzae*] [DB:pir2]
>gp:[GI:g1573583] [LN:U32741] [AC:U32741:L42023] [PN:conserved hypothetical
transmembrane protein] [GN:HI0594] [OR:*Haemophilus influenzae* Rd]
[DB:genpept-bct2] [DE:*Haemophilus influenzae* Rd section 56 of 163 of the
complete genome.] [NT:similar to GB:AE000783 percent identity:35.02;]
[LE:891] [RE:2420] [DI:complement]

| ORF Name | NT ID | AA ID | NT LN | AA LN | Score | P-Value |
|---|---|---|---|---|---|---|
| AI7503000984_26774137_c2_574 | 706 | 4478 | 126 | 41 | | |

Description
NO-HIT

| ORF Name | NT ID | AA ID | NT LN | AA LN | Score | P-Value |
|---|---|---|---|---|---|---|
| AI7503000984_272593_c3_636 | 707 | 4479 | 879 | 292 | 82 | 0.0082 |

Description
sp:[LN:YORB_LISMO] [AC:P33382] [OR:*LISTERIA MONOCYTOGENES*] [DE:HYPOTHETICAL
12.0 KD PROTEIN IN PLCB-LDH INTERGENIC REGION (ORFB)] [SP:P33382]
[DB:swissprot] >pir:[LN:I43868] [AC:I43868] [PN:ORFB] [CL:hypothetical
protein MJ1413] [OR:*Listeria monocytogenes*] [DB:pir2] >gp:[GI:g149648]
[LN:LISACTLDH] [AC:M82881] [OR:*Listeria monocytogenes*] [SR:*Listeria
monocytogenes* (strain L028) DNA] [DB:genpept-bct1] [DE:*Listeria
monocytogenes* lecithinase, lactate dehydrogenase (actA) gene complete cds,
(plcB) gene complete cds, (ldh) gene complete cds.] [NT:ORFB] [LE:4094]
[RE:4426] [DI:complement]

| ORF Name | NT ID | AA ID | NT LN | AA LN | Score | P-Value |
|---|---|---|---|---|---|---|
| AI7503000984_2906307_f1_60 | 708 | 4480 | 126 | 41 | | |

Description
NO-HIT

| ORF Name | NT ID | AA ID | NT LN | AA LN | Score | P-Value |
|---|---|---|---|---|---|---|
| AI7503000984_2928437_c1_477 | 709 | 4481 | 921 | 306 | 375 | 1.4e−34 |

Description
pir:[LN:A69401] [AC:A69401] [PN:conserved hypothetical protein AF1210]
[OR:*Archaeoglobus fulgidus*] [DB:pir2] >gp:[GI:g2649377] [LN:AE001021]
[AC:AE001021:AE000782] [PN:conserved hypothetical protein] [GN:AF1210]
[OR:*Archaeoglobus fulgidus*] [DB:genpept-bct2] [DE:*Archaeoglobus fulgidus*
section 86 of 172 of the complete genome.] [NT:similar to GP:1654020 percent
identity:34.56;] [LE:12088] [RE:13029] [DI:complement]

| ORF Name | NT ID | AA ID | NT LN | AA LN | Score | P-Value |
|---|---|---|---|---|---|---|
| AI7503000984_2929718_c1_463 | 710 | 4482 | 1959 | 652 | 3345 | 0.0 |

Description
gp:[GI:g3789932] [LN:AF090142] [AC:AF090142] [PN:lipase precursor] [GN:gehD]
[OR:*Staphylococcus epidermidis*] [DB:genpept-bct2] [EC:3.1.1.3]
[DE:*Staphylococcus epidermidis* lipase precursor (gehD) gene, complete cds.]
[NT:GehD] [LE:293] [RE:2224] [DI:direct]

| ORF Name | NT ID | AA ID | NT LN | AA LN | Score | P-Value |
|---|---|---|---|---|---|---|
| AI7503000984__29398437__f2__132 | 711 | 4483 | 234 | 77 | | |

Description
NO-HIT

| ORF Name | NT ID | AA ID | NT LN | AA LN | Score | P-Value |
|---|---|---|---|---|---|---|
| AI7503000984__3003137__f2__215 | 712 | 4484 | 906 | 301 | 294 | 5.2e−26 |

Description
pir:[LN:H70313] [AC:H70313] [PN:cobalamin synthesis related protein CobW]
[GN:cobW] [OR:*Aquifex aeolicus*] [DB:pir2] >gp:[GI:g2982874] [LN:AE000675]
[AC:AE000675:AE000657] [PN:cobalamin synthesis related protein CobW]
[GN:cobW] [OR:*Aquifex aeolicus*] [DB:genpept-bct2] [DE:*Aquifex aeolicus*
section 7 of 109 of the complete genome.] [LE:11287] [RE:12165] [DI:direct]

| ORF Name | NT ID | AA ID | NT LN | AA LN | Score | P-Value |
|---|---|---|---|---|---|---|
| AI7503000984__30103592__c3__600 | 713 | 4485 | 132 | 43 | | |

Description
NO-HIT

| ORF Name | NT ID | AA ID | NT LN | AA LN | Score | P-Value |
|---|---|---|---|---|---|---|
| AI7503000984__30251551__f3__412 | 714 | 4486 | 159 | 52 | 73 | 0.027 |

Description
sp:[LN:YO21__BPHP1] [AC:P51723] [OR:BACTERIOPHAGE HP1] [DE:HYPOTHETICAL 19.2
KD PROTEIN IN REP-HOL INTERGENIC REGION (ORF21)] [SP:P51723] [DB:swissprot]
>pir:[LN:S69527] [AC:S69527] [PN:hypothetical protein 21] [OR:phage HP1]
[DB:pir2] >gp:[GI:g1046248] [LN:BHU24159]
[AC:U24159:U06847:M28366:M12911:M22941:M12910:M15313] [OR:Bacteriophage HP1]
[DB:genpept-phg] [DE:Bacteriophage HP1 strain HP1c1, complete genome.]
[NT:orf21] [LE:17028] [RE:17528] [DI:direct]

| ORF Name | NT ID | AA ID | NT LN | AA LN | Score | P-Value |
|---|---|---|---|---|---|---|
| AI7503000984__30271882__c3__618 | 715 | 4487 | 720 | 239 | 268 | 3.0e−23 |

Description
gp:[GI:g490316] [LN:A02585] [AC:A02585] [GN:bioD] [OR:synthetic construct]
[DB:genpept-pat] [DE:Synthetic (LORF1) bioD gene.] [LE:39] [RE:764]
[DI:direct]

| ORF Name | NT ID | AA ID | NT LN | AA LN | Score | P-Value |
|---|---|---|---|---|---|---|
| AI7503000984__30272531__f2__228 | 716 | 4488 | 144 | 47 | | |

Description
NO-HIT

| ORF Name | NT ID | AA ID | NT LN | AA LN | Score | P-Value |
|---|---|---|---|---|---|---|
| AI7503000984__30351677__c3__598 | 717 | 4489 | 804 | 267 | | |

Description
NO-HIT

| ORF Name | NT ID | AA ID | NT LN | AA LN | Score | P-Value |
|---|---|---|---|---|---|---|
| AI7503000984__30742307__c2__572 | 718 | 4490 | 669 | 222 | 640 | 1.1e−62 |

Description
pir:[LN:F69670] [AC:F69670] [PN:glycine betaine/carnitine/choline ABC
transporter (membrane p) opuCD] [GN:opuCD] [CL:glycine
betaine/carnitine/choline ABC transporter] [OR:*Bacillus subtilis*] [DB:pir2]
>gp:[GI:g2271392] [LN:AF009352] [AC:AF009352] [PN:transmembrane protein]
[GN:opuCD] [OR:*Bacillus subtilis*] [DB:genpept-bct1] [DE:*Bacillus subtilis*
osmoprotectant transport system OpuC including ATPase (opuCA), transmembrane
protein (opuCB), osmoprotectant binding protein precursor (opuCC) and
transmembrane protein (opuCD) genes, complete cds.] [NT:OpuCD; part of the
osmoprotectant transport system] [LE:3627] [RE:4316] [DI:direct]
>gp:[GI:e1186068:g2635893] [LN:BSUB0018] [AC:Z99121:AL009126] [PN:glycine
betaine/carnitine/choline ABC] [GN:opuCD] [FN:high affinity transport of
glycine betaine,] [OR:*Bacillus subtilis*] [DB:genpept-bct1] [DE:*Bacillus
subtilis* complete genome (section 18 of 21):from 3399551 to 3609060.]

-continued

[NT:alternate gene name:yvbB] [LE:67059] [RE:67748] [DI:complement]

| ORF Name | NT ID | AA ID | NT LN | AA LN | Score | P-Value |
|---|---|---|---|---|---|---|
| AI7503000984__3125687__f1__114 | 719 | 4491 | 132 | 43 | | |

Description
NO-HIT

| ORF Name | NT ID | AA ID | NT LN | AA LN | Score | P-Value |
|---|---|---|---|---|---|---|
| AI7503000984__31287513__c1__464 | 720 | 4492 | 150 | 49 | | |

Description
NO-HIT

| ORF Name | NT ID | AA ID | NT LN | AA LN | Score | P-Value |
|---|---|---|---|---|---|---|
| AI7503000984__3163552__c3__597 | 721 | 4493 | 963 | 320 | 356 | 1.4e−32 |

Description
gp:[GI:g3800819] [LN:AF076683] [AC:AF076683] [PN:oligopeptide transporter putative membrane] [GN:opp-1B] [OR:*Staphylococcus aureus*] [DB:genpept-bct2] [DE:*Staphylococcus aureus* oligopeptide transporter putative substrate binding domain (opp-1A), oligopeptide transporter putative membrane permease domain (opp-1B), oligopeptide transporter putative membrane permease domain (opp-1C), oligopeptide transporter putative ATPase domain (opp-1D), and oligopeptide transporter putative ATPase domain (opp-1F) genes, complete cds; and unknown gene.] [LE:1537] [RE:2472] [DI:direct]

| ORF Name | NT ID | AA ID | NT LN | AA LN | Score | P-Value |
|---|---|---|---|---|---|---|
| AI7503000984__3174187__f2__222 | 722 | 4494 | 330 | 109 | | |

Description
NO-HIT

| ORF Name | NT ID | AA ID | NT LN | AA LN | Score | P-Value |
|---|---|---|---|---|---|---|
| AI7503000984__32609682__f3__403 | 723 | 4495 | 129 | 42 | | |

Description
NO-HIT

| ORF Name | NT ID | AA ID | NT LN | AA LN | Score | P-Value |
|---|---|---|---|---|---|---|
| AI7503000984__32615677__c2__544 | 724 | 4496 | 1035 | 344 | 510 | 6.7e−49 |

Description
pir:[LN:A69756] [AC:A69756] [PN:adhesion protein homolog ycdH] [GN:ycdH] [CL:adhesin B] [OR:*Bacillus subtilis*] [DB:pir2] >gp:[GI:d1023108:g2415736] [LN:AB000617] [AC:AB000617] [PN:YcdH] [GN:ycdH] [OR:*Bacillus subtilis*] [SR:*Bacillus subtilis* (strain:168 trpC2) DNA] [DB:genpept-bct1] [DE:*Bacillus subtilis* genomic DNA, 22 to 25 degree region, complete cds.] [NT:homologue of adhesion protein precursor of] [LE:21421] [RE:22380] [DI:direct]
>gp:[GI:e1182237:g2632571] [LN:BSUB0002] [AC:Z99105:AL009126] [GN:ycdH] [FN:unknown] [OR:*Bacillus subtilis*] [DB:genpept-bct1] [DE:*Bacillus subtilis* complete genome (section 2 of 21):from 194651 to 415810.] [NT:similar to adhesion protein] [LE:113236] [RE:114195] [DI:direct]

| ORF Name | NT ID | AA ID | NT LN | AA LN | Score | P-Value |
|---|---|---|---|---|---|---|
| AI7503000984__32755__f2__185 | 725 | 4497 | 195 | 64 | | |

Description
NO-HIT

| ORF Name | NT ID | AA ID | NT LN | AA LN | Score | P-Value |
|---|---|---|---|---|---|---|
| AI7503000984__33241562__f2__147 | 726 | 4498 | 144 | 47 | | |

Description
NO-HIT

| ORF Name | NT ID | AA ID | NT LN | AA LN | Score | P-Value |
|---|---|---|---|---|---|---|
| AI7503000984__33479716__c3__634 | 727 | 4499 | 1401 | 466 | 421 | 1.8e−39 |

-continued

Description
gp:[GI:e1429016:g4753872] [LN:SCH10] [AC:AL049754] [PN:putative
transmembrane efflux protein] [GN:SCH10.26c] [OR:*Streptomyces coelicolor*]
[DB:genpept-bct1] [DE:*Streptomyces coelicolor* cosmid H10.] [NT:SCH10.26c,
probable transmembrane efflux protein,] [LE:22729] [RE:24183]
[DI:complement]

| ORF Name | NT ID | AA ID | NT LN | AA LN | Score | P-Value |
|---|---|---|---|---|---|---|
| AI7503000984__34171927__c1__468 | 728 | 4500 | 144 | 47 | | |

Description
NO-HIT

| ORF Name | NT ID | AA ID | NT LN | AA LN | Score | P-Value |
|---|---|---|---|---|---|---|
| AI7503000984__34277062__c3__602 | 729 | 4501 | 153 | 50 | | |

Description
NO-HIT

| ORF Name | NT ID | AA ID | NT LN | AA LN | Score | P-Value |
|---|---|---|---|---|---|---|
| AI7503000984__34408552__f1__21 | 730 | 4502 | 126 | 41 | | |

Description
NO-HIT

| ORF Name | NT ID | AA ID | NT LN | AA LN | Score | P-Value |
|---|---|---|---|---|---|---|
| AI7503000984__34429837__f1__39 | 731 | 4503 | 948 | 315 | 769 | 2.4e−76 |

Description
sp:[LN:ARCL__ECOLI] [AC:Q46807] [GN:YQEA] [OR:*ESCHERICHIA COLI*] [DE:CARBAMATE
KINASE-LIKE PROTEIN 1] [SP:Q46807] [DB:swissprot] >pir:[LN:B65071]
[AC:B65071] [PN:hypothetical protein b2874] [CL:carbamate kinase]
[OR:*Escherichia coli*] [DB:pir2] >gp:[GI:g887824] [LN:ECU28375] [AC:U28375]
[OR:*Escherichia coli*] [DB:genpept-bct1] [DE:*Escherichia coli* K-12 genome;
approximately 64 to 65 minutes.] [NT:ORF__o310] [LE:21276] [RE:22208]
[DI:direct] >gp:[GI:g1789238] [LN:AE000370] [AC:AE000370:U00096]
[PN:putative kinase] [GN:yqeA] [FN:putative enzyme; Not classified]
[OR:*Escherichia coli*] [DB:genpept-bct2] [DE:*Escherichia coli* K-12 MG1655
section 260 of 400 of the complete genome.] [NT:o310; This 310 aa ORF is 45
pct identical (21 gaps)] [LE:11360] [RE:12292] [DI:direct]

| ORF Name | NT ID | AA ID | NT LN | AA LN | Score | P-Value |
|---|---|---|---|---|---|---|
| AI7503000984__34631527__f1__109 | 732 | 4504 | 336 | 111 | 374 | 1.7e−34 |

Description
gp:[GI:d1045996:g5360820] [LN:D86934] [AC:D86934] [PN:transposase]
[OR:*Staphylococcus aureus*] [SR:*Staphylococcus aureus* (strain:N315) DNA,
clone__lib:library of N31] [DB:genpept] [DE:*Staphylococcus aureus* genes, mec
region, partial and complete cds.] [NT:ORF N026; putative] [LE:19527]
[RE:19751] [DI:direct]

| ORF Name | NT ID | AA ID | NT LN | AA LN | Score | P-Value |
|---|---|---|---|---|---|---|
| AI7503000984__34642135__c3__663 | 733 | 4505 | 246 | 81 | 79 | 0.020 |

Description
gp:[GI:g488889] [LN:A12521] [AC:A12521] [PN:Acidic Basic Repeat Antigen
Rhoptry (ABRA)] [OR:*Plasmodium falciparum*] [SR:malaria parasite *P.
falciparum*] [DB:genpept-pat] [DE:Ag189 clone.] [LE:1:61] [RE:45:963]
[DI:directJoin]

| ORF Name | NT ID | AA ID | NT LN | AA LN | Score | P-Value |
|---|---|---|---|---|---|---|
| AI7503000984__34657677__c3__615 | 734 | 4506 | 2994 | 997 | 2435 | 6.9e−253 |

Description
gp:[GI:g4185565] [LN:AF115379] [AC:AF115379] [PN:surface protein Pls]
[GN:pls] [OR:*Staphylococcus aureus*] [DB:genpept-bct2] [DE:*Staphylococcus
aureus* surface protein Pls (pls) gene, complete cds.] [NT:methicillin
resistant; contains a DS repeat area] [LE:1] [RE:4914] [DI:direct]

-continued

| ORF Name | NT ID | AA ID | NT LN | AA LN | Score | P-Value |
|---|---|---|---|---|---|---|
| AI7503000984__35312766__f2__151 | 735 | 4507 | 195 | 64 | | |

Description
NO-HIT

| ORF Name | NT ID | AA ID | NT LN | AA LN | Score | P-Value |
|---|---|---|---|---|---|---|
| AI7503000984__35331905__c3__612 | 736 | 4508 | 318 | 105 | 81 | 0.012 |

Description
gp:[GI:g5052610] [LN:AF145660] [AC:AF145660] [PN:BcDNA.GH10614]
[GN:BcDNA.GH10614] [OR:*Drosophila melanogaster*] [SR:fruit fly]
[DB:genpept-inv2] [DE:*Drosophila melanogaster* clone GH10614 BcDNA.GH10614
(BcDNA.GH10614) mRNA, complete cds.] [LE:14] [RE:964] [DI:direct]

| ORF Name | NT ID | AA ID | NT LN | AA LN | Score | P-Value |
|---|---|---|---|---|---|---|
| AI7503000984__36042152__c3__616 | 737 | 4509 | 3246 | 1081 | 2306 | 1.8e−251 |

Description
gp:[GI:g4185565] [LN:AF115379] [AC:AF115379] [PN:surface protein Pls]
[GN:pls] [OR:*Staphylococcus aureus*] [DB:genpept-bct2] [DE:*Staphylococcus
aureus* surface protein Pls (pls) gene, complete cds.] [NT:methicillin
resistant; contains a DS repeat area] [LE:1] [RE:4914] [DI:direct]

| ORF Name | NT ID | AA ID | NT LN | AA LN | Score | P-Value |
|---|---|---|---|---|---|---|
| AI7503000984__31613752__f1__90 | 738 | 4510 | 1128 | 375 | 172 | 1.7e−10 |

Description
sp:[LN:YPDA_BACSU] [AC:P50736] [GN:YPDA] [OR:*BACILLUS SUBTILIS*]
[DE:HYPOTHETICAL 36.3 KD PROTEIN IN RECQ-CMK INTERGENIC REGION] [SP:P50736]
[DB:swissprot] >pir:[LN:A69934] [AC:A69934] [PN:thioredoxin reductase
homolog ypdA] [GN:ypdA] [OR:*Bacillus subtilis*] [DB:pir2]
>gp:[GI:e1183740:g2634713] [LN:BSUB0012] [AC:Z99115:AL009126] [GN:ypdA]
[FN:unknown] [OR:*Bacillus subtilis*] [DB:genpept-bct1] [DE:*Bacillus subtilis*
complete genome (section 12 of 21):from 2195541 to 2409220.] [NT:similar to
thioredoxin reductase] [SP:P50736] [LE:204681] [RE:205655] [DI:complement]
>gp:[GI:e1185564:g2634730] [LN:BSUB0013] [AC:Z99116:AL009126] [GN:ypdA]
[FN:unknown] [OR:*Bacillus subtilis*] [DB:genpept-bct1] [DE:*Bacillus subtilis*
complete genome (section 13 of 21):from 2395261 to 2613730.] [NT:similar to
thioredoxin reductase] [SP:P50736] [LE:4961] [RE:5935] [DI:complement]
>gp:[GI:g1146207] [LN:BACSERA] [AC:L47648] [GN:ypdA] [OR:*Bacillus subtilis*]
[DB:genpept-bct2] [DE:*Bacillus subtilis* phosphoglycerate dehydrogenase
(serA), ypaA, ferredoxin (fer), ypbB, recS, ypbD, ypbE, ypbF, ypbG,
ypbH, glutamate dehydrogenase (ypcA), ypdA, ypdB, ypdC, spore cortexlytic
enzyme (sleB), ypeB, ypfA, ypfB, cytidine monophosphatekinase (cmk), ypfD,
ypgA, yphA, yphB, yphC, NAD+ dependent glycerol-3-phosphate dehydrogenase
(glyc), yphE and yphF genes, complete cds.] [NT:putative] [LE:10742]
[RE:11716] [DI:direct]

| ORF Name | NT ID | AA ID | NT LN | AA LN | Score | P-Value |
|---|---|---|---|---|---|---|
| AI7503000984__36601703__c1__467 | 739 | 4511 | 939 | 312 | 406 | 7.0e−38 |

Description
sp:[LN:APBE_TREPA] [AC:O83774] [GN:APBE:TP0796] [OR:*TREPONEMA PALLIDUM*]
[DE:THIAMINE BIOSYNTHESIS LIPOPROTEIN APBE PRECURSOR] [SP:O83774]
[DB:swissprot] >pir:[LN:C71281] [AC:C71281] [PN:conserved hypothetical
protein TP0796] [GN:TP0796] [CL:hypothetical protein HI0172] [OR:*Treponema
pallidum* subsp. *pallidum*] [SR:, syphilis spirochete] [DB:pir2]
>gp:[GI:g3323101] [LN:AE001250] [AC:AE001250:AE000520] [PN:conserved
hypothetical protein] [GN:TP0796] [OR:*Treponema pallidum*] [DB:genpept-bct2]
[DE:*Treponema pallidum* section 66 of 87 of the complete genome.] [NT:similar
to GB:L42023 SP:P44550 PID:1003244] [LE:10082] [RE:11170] [DI:complement]

| ORF Name | NT ID | AA ID | NT LN | AA LN | Score | P-Value |
|---|---|---|---|---|---|---|
| AI7503000984__3939215__f2__247 | 740 | 4512 | 984 | 327 | 377 | 8.3e−35 |

Description
gp:[GI:g2766193] [LN:SHU75349] [AC:U75349] [PN:periplasmic-iron-binding
protein BhiC] [GN:bhi operon] [OR:*Brachyspira hyodysenteriae*]
[DB:genpept-bct2] [DE:*Serpulina hyodysenteriae* bhi operon, complete
sequence.] [LE:1674] [RE:2693] [DI:direct]

-continued

| ORF Name | NT ID | AA ID | NT LN | AA LN | Score | P-Value |
| --- | --- | --- | --- | --- | --- | --- |
| AI7503000984__3948408__c3__655 | 741 | 4513 | 777 | 248 | 315 | 3.1e−28 |

Description
sp:[LN:XYNC__CALSA] [AC:P23553] [GN:XYNC] [OR:*CALDOCELLUM SACCHAROLYTICUM*]
[SR:,*CALDICELLULOSIRUPTOR SACCHAROLYTICUS*] [EC:3.1.—.—] [DE:ACETYL ESTERASE,
(ACETYLXYLOSIDASE)] [SP:P23553] [DB:swissprot] >pir:[LN:B37202] [AC:B37202]
[PN:acetylesterase, (XynC)] [OR:*Caldocellum saccharolyticum*] [EC:3.1.1.6]
[DB:pir2] >gp:[GI:g144297] [LN:CDCXYNAB] [AC:M34459]
[OR:*Caldicellulosiruptor saccharolyticus*] [SR:*C. saccharolyticus* DNA, clone
pNZ1400] [DB:genpept-bct1] [DE:*C. saccharolyticum* xylanase A (XynA),
beta-xylosidase (XynB) andacetyl esterase (XynC) genes, complete cds.]
[NT:acetyl esterase (XynC)] [LE:1257] [RE:2057] [DI:direct]
>gp:[GI:g2645420] [LN:AF005383] [AC:AF005383] [PN:acetylxylosidase]
[GN:XynC] [OR:*Caldicellulosiruptor saccharolyticus*] [DB:genpept-bct2]
[DE:*Caldicellulosiruptor saccharolyticus* putative transport protein (XynG),
putative transport protein (XynH), xylanase (XynF), xylanase (XynE), xylanase
(XynD), xylanase (XynA), acetylxylosidase (XynC) and xylanase (XynB) genes,
complete cds.] [LE:13673] [RE:14473] [DI:direct]

| ORF Name | NT ID | AA ID | NT LN | AA LN | Score | P-Value |
| --- | --- | --- | --- | --- | --- | --- |
| AI7503000984__4062925__f2__246 | 742 | 4514 | 393 | 130 | 103 | 7.8e−07 |

Description
gp:[GI:g2072447] [LN:LLU93364] [AC:U93364] [PN:EpsJ] [GN:epsJ]
[OR:*Lactococcus lactis* subsp. *cremoris*] [DB:genpept-bct2] [DE:*Lactococcus
lactis cremoris* plasmid pNZ4000 insertion sequence IS982 putative transposase
gene and eps gene cluster (epsRXABCDEFGHIJKL), complete cds.] [LE:10209]
[RE:11399] [DI:direct] >gp:[GI:g2072447] [LN:AF036485]
[AC:AF036485:AF036486:AF036487:U93364] [PN:EpsJ] [GN:epsJ] [OR:Plasmid
pNZ4000] [DB:genpept] [DE:Plasmid pNZ4000, complete sequence.] [LE:16729]
[RE:17919] [DI:complement]

| ORF Name | NT ID | AA ID | NT LN | AA LN | Score | P-Value |
| --- | --- | --- | --- | --- | --- | --- |
| AI7503000984__4072680__f1__75 | 743 | 4515 | 774 | 257 | 311 | 8.2e−28 |

Description
pir:[LN:A70039] [AC:A70039] [PN:ABC transporter (ATP-binding protein)
homolog yvfR] [GN:yvfR] [CL:ATP-binding cassette homology] [OR:*Bacillus
subtilis*] [DB:pir2] >gp:[GI:e1186097:g2635922] [LN:BSUB0018]
[AC:Z99121:AL009126] [GN:yvfR] [FN:unknown] [OR:*Bacillus subtilis*]
[DB:genpept-bct1] [DE:*Bacillus subtilis* complete genome (section 18 of 21):
from 3399551 to 3609060.] [NT:similar to ABC transporter (ATP-binding
protein)] [LE:97865] [RE:98770] [DI:complement] >gp:[GI:e313073:g1945718]
[LN:BSZ94043] [AC:Z94043] [PN:hypothetical protein] [GN:yvfR] [OR:*Bacillus
subtilis*] [DB:genpept-bct1] [DE:*B. subtilis* genomic DNA fragment (88 kb).]
[NT:probable ABC transporter] [LE:82901] [RE:83806] [DI:direct]

| ORF Name | NT ID | AA ID | NT LN | AA LN | Score | P-Value |
| --- | --- | --- | --- | --- | --- | --- |
| AI7503000984__4079382__f3__313 | 744 | 4516 | 243 | 80 | | |

Description
NO-HIT

| ORF Name | NT ID | AA ID | NT LN | AA LN | Score | P-Value |
| --- | --- | --- | --- | --- | --- | --- |
| AI7503000984__4094052__f3__330 | 745 | 4517 | 219 | 72 | | |

Description
NO-HIT

| ORF Name | NT ID | AA ID | NT LN | AA LN | Score | P-Value |
| --- | --- | --- | --- | --- | --- | --- |
| AI7503000984__4098385__f1__115 | 746 | 4518 | 129 | 42 | | |

Description
NO-HIT

| ORF Name | NT ID | AA ID | NT LN | AA LN | Score | P-Value |
| --- | --- | --- | --- | --- | --- | --- |
| AI7503000984__4101063__f1__113 | 747 | 4519 | 396 | 131 | 88 | 0.022 |

Description
pir:[LN:T02638] [AC:T02638] [PN:G2 protein homolog] [GN:g2]
[OR:*Dictyostelium discoideum*] [DB:pir2] >gp:[GI:g3068587] [LN:AF000580]

-continued

[AC:AF000580] [PN:G2-like] [GN:g2] [OR:*Dictyostelium discoideum*]
[DB:genpept-inv1] [DE:*Dictyostelium discoideum* plasmid Ddp5, complete
genome.] [NT:similar to plasmid Ddp1. g2/g3/d4 protein; possible] [LE:11232]
[RE:12167] [DI:direct]

| ORF Name | NT ID | AA ID | NT LN | AA LN | Score | P-Value |
|---|---|---|---|---|---|---|
| AI7503000984_4101640_c2_545 | 748 | 4520 | 3054 | 1017 | 680 | 1.9e−66 |

Description
sp:[LN:YQIG_BACSU] [AC:P54524] [GN:YQIG] [OR:*BACILLUS SUBTILIS*] [EC:1.—.—.—]
[DE:PROBABLE NADH-DEPENDENT FLAVIN OXIDOREDUCTASE YQIG,] [SP:P54524]
[DB:swissprot] >pir:[LN:C69961] [AC:C69961] [PN:NADH-dependent flavin
oxidoreductase homolog yqiG] [GN:yqiG] [OR:*Bacillus subtilis*] [DB:pir2]
>gp:[GI:d1013261:g1303926] [LN:BACJH642] [AC:D84432:D82370] [PN:YqiG]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:202096] [RE:203214] [DI:complement]
>gp:[GI:e1185689:g2634855] [LN:BSUB0013] [AC:Z99116:AL009126] [GN:yqiG]
[FN:unknown] [OR:*Bacillus subtilis*] [DB:genpept-bct1] [DE:*Bacillus subtilis*
complete genome (section 13 of 21):from 2395261 to 2613730.] [NT:similar to
NADH-dependent flavin oxidoreductase] [SP:P54524] [LE:120407] [RE:121525]
[DI:direct]

| ORF Name | NT ID | AA ID | NT LN | AA LN | Score | P-Value |
|---|---|---|---|---|---|---|
| AI7503000984_4705053_c2_536 | 749 | 4521 | 1221 | 406 | 454 | 5.8e−43 |

Description
sp:[LN:BIOF_HAEIN] [AC:P44422] [GN:BIOF:HI1553] [OR:*HAEMOPHILUS INFLUENZAE*]
[EC:2.3.1.47] [DE:LIGASE)] [SP:P44422] [DB:swissprot] >pir:[LN:D64129]
[AC:D64129] [PN:8-amino-7-oxononanoate synthase homolog]
[CL:5-aminolevulinate synthase] [OR:*Haemophilus influenzae*] [DB:pir2]
>gp:[GI:g1574397] [LN:U32830] [AC:U32830:L42023] [PN:8-amino-7-oxononanoate
synthase (bioF)] [GN:HI1553] [OR:*Haemophilus influenzae* Rd]
[DB:genpept-bct2] [DE:*Haemophilus influenzae* Rd section 145 of 163 of the
complete genome.] [NT:similar to SP:P53556 PID:1277027 PID:2293185] [LE:7529]
[RE:8671] [DI:complement]

| ORF Name | NT ID | AA ID | NT LN | AA LN | Score | P-Value |
|---|---|---|---|---|---|---|
| AI7503000984_4722131_f2_268 | 750 | 4522 | 141 | 46 | | |

Description
NO-HIT

| ORF Name | NT ID | AA ID | NT LN | AA LN | Score | P-Value |
|---|---|---|---|---|---|---|
| AI7503000984_4765_f2_245 | 751 | 4523 | 321 | 106 | 90 | 0.0025 |

Description
gp:[GI:g5306152] [LN:AF160864] [AC:AF160864] [PN:haem lyase] [GN:yejR]
[OR:Mitochondrion *Tetrahymena pyriformis*] [SR:*Tetrahymena pyriformis*]
[DB:genpept] [DE:*Tetrahymena pyriformis* mitochondrial DNA, complete genome.]
[NT:ATA initiation codon; ATG codon 128 nt downstream] [LE:18212] [RE:19750]
[DI:complement]

| ORF Name | NT ID | AA ID | NT LN | AA LN | Score | P-Value |
|---|---|---|---|---|---|---|
| AI7503000984_4773518_c3_664 | 752 | 4524 | 885 | 294 | 563 | 1.6e−54 |

Description
gp:[GI:e312302:g1944618] [LN:SEGAPLPP] [AC:Y12602] [PN:acid phosphatase]
[GN:lppC] [FN:cell membrane lipoprotein] [OR:*Streptococcus equisimilis*]
[DB:genpept-bct1] [DE:*Streptococcus equisimilis* gapC and lppC genes.]
[LE:1390] [RE:2247] [DI:direct]

| ORF Name | NT ID | AA ID | NT LN | AA LN | Score | P-Value |
|---|---|---|---|---|---|---|
| AI7503000984_4782963_c1_460 | 753 | 4525 | 1365 | 454 | 1105 | 6.0e−112 |

Description
pir:[LN:B70316] [AC:B70316] [PN:DAPA aminotransferase] [GN:bioA]
[CL:beta-alanine--pyruvate transaminase] [OR:*Aquifex aeolicus*] [DB:pir2]
>gp:[GI:g2982887] [LN:AE000676] [AC:AE000676:AE000657] [PN:DAPA
aminotransferase] [GN:bioA] [OR:*Aquifex aeolicus*] [DB:genpept-bct2]
[DE:*Aquifex aeolicus* section 8 of 109 of the complete genome.] [LE:10739]
[RE:12100] [DI:complement]

-continued

| ORF Name | NT ID | AA ID | NT LN | AA LN | Score | P-Value |
|---|---|---|---|---|---|---|
| AI7503000984_4797177_c2_566 | 754 | 4526 | 588 | 195 | 308 | 1.7e−27 |

Description
gp:[GI:d1011096:g1001205] [LN:SYCSLLE] [AC:D64003:AB001339] [PN:hypothetical protein] [OR:*Synechocystis* sp.] [SR:*Synechocystis* sp. (strain:PCC6803) DNA] [DB:genpept-bct1] [DE:*Synechocystis* sp. PCC6803 complete genome, 22/27, 2755703–2868766.] [NT:ORF_ID:slr0895] [LE:7468] [RE:8031] [DI:direct]

| ORF Name | NT ID | AA ID | NT LN | AA LN | Score | P-Value |
|---|---|---|---|---|---|---|
| AI7503000984_4798202_c3_623 | 755 | 4527 | 816 | 271 | 103 | 0.023 |

Description
pir:[LN:B71605] [AC:B71605] [PN:hypothetical protein PFB0850c] [GN:PFB0850c] [OR:*Plasmodium falciparum*] [DB:pir2] >gp:[GI:g3845292] [LN:AE001420] [AC:AE001420:AE001362] [PN:hypothetical protein] [GN:PFB0850c] [OR:*Plasmodium falciparum*] [SR:malaria parasite *P. falciparum*] [DB:genpept-inv2] [DE:*Plasmodium falciparum* chromosome 2, section 57 of 73 of the complete sequence.] [NT:predicted by GlimmerM] [LE:11963] [RE:14386] [DI:complement]

| ORF Name | NT ID | AA ID | NT LN | AA LN | Score | P-Value |
|---|---|---|---|---|---|---|
| AI7503000984_4800077_f3_350 | 756 | 4528 | 156 | 51 | | |

Description
NO-HIT

| ORF Name | NT ID | AA ID | NT LN | AA LN | Score | P-Value |
|---|---|---|---|---|---|---|
| AI7503000984_4859628_c3_603 | 757 | 4529 | 195 | 64 | | |

Description
NO-HIT

| ORF Name | NT ID | AA ID | NT LN | AA LN | Score | P-Value |
|---|---|---|---|---|---|---|
| AI7503000984_4867842_c3_652 | 758 | 4530 | 978 | 325 | 486 | 2.3e−46 |

Description
pir:[LN:E69400] [AC:E69400] [PN:3-hydroxyacyl-CoA dehydrogenase (hbd-8) homolog] [OR:*Archaeoglobus fulgidus*] [DB:pir2] >gp:[GI:g2649379] [LN:AE001021] [AC:AE001021:AE000782] [PN:3-hydroxyacyl-CoA dehydrogenase (hbd-8)] [GN:AF1206] [OR:*Archaeoglobus fulgidus*] [DB:genpept-bct2] [DE:*Archaeoglobus fulgidus* section 86 of 172 of the complete genome.] [NT:similar to PID:1055222 SP:P52041 percent identity:] [LE:9126] [RE:10073] [DI:complement]

| ORF Name | NT ID | AA ID | NT LN | AA LN | Score | P-Value |
|---|---|---|---|---|---|---|
| AI7503000984_4884812_f3_314 | 759 | 4531 | 1257 | 418 | 579 | 1.1e−78 |

Description
gp:[GI:e1358508:g3980137] [LN:LMO34616] [AC:AJ007319] [PN:succinyl-diaminopimelate desuccinylase] [GN:dapE] [OR:*Listeria monocytogenes*] [DB:genpept-bct1] [DE:*Listeria monocytogenes* ascB, inlG, inlH, inlE, dapE genes.] [LE:5533] [RE:6672] [DI:direct]

| ORF Name | NT ID | AA ID | NT LN | AA LN | Score | P-Value |
|---|---|---|---|---|---|---|
| AI7503000984_4895061_c2_561 | 760 | 4532 | 2271 | 756 | 2671 | 6.8e−278 |

Description
pir:[LN:S01788] [AC:S01788:B32305:F64829] [PN:formate C-acetyltransferase, 1:pyruvate formate-lyase I] [GN:pflB:pfl] [CL:formate C-acetyltransferase 1:glycyl radical homology] [OR:*Escherichia coli*] [EC:2.3.1.54] [DB:pir1] [MP:20.5] >gp:[GI:d1036624:g1651427] [LN:D90728] [AC:D90728:AB001340] [PN:Formate c-acetyltransferase (EC 2.3.1.54).] [GN:pfl] [OR:*Escherichia coli*] [SR:*Escherichia coli* (strain:K12) DNA, clone:Kohara clone #216] [DB:genpept-bct1] [DE:*Escherichia coli* genomic DNA. (20.4–20.8 min).] [NT:ORF_ID:o216#7; similar to PIR Accession Number] [LE:6965] [RE:9247] [DI:complement] >gp:[GI:g42370] [LN:ECPFL] [AC:X08035] [OR:*Escherichia coli*] [DB:genpept-bct1] [DE:*E. coli* pfl gene for pyruvate formate-lyase (EC 2.3.1.54).] [NT:pyruvate formate-lyase (AA 1–760)] [SP:P09373] [LE:101] [RE:2383] [DI:direct] >gp:[GI:g1787131] [LN:AE000192] [AC:AE000192:U00096] [PN:formate acetyltransferase 1] [GN:pflB] [FN:enzyme; Energy metabolism, carbon:Anaerobic] [OR:*Escherichia coli*] [DB:genpept-bct2] [EC:2.3.1.54]

-continued

[DE:*Escherichia coli* K-12 MG1655 section 82 of 400 of the complete genome.]
[NT:f760; 100 pct identical to PFLB_*ECOLI* SW:P09373] [LE:5588] [RE:7870]
[DI:complement]

| ORF Name | NT ID | AA ID | NT LN | AA LN | Score | P-Value |
|---|---|---|---|---|---|---|
| AI7503000984_4974091_c2_569 | 761 | 4533 | 504 | 167 | 93 | 0.00087 |

Description
pir:[LN:B71359] [AC:B71359] [PN:conserved hypothetical protein TP0156]
[GN:TP0156] [OR:*Treponema pallidum* subsp. *pallidum*] [SR:, syphilis
spirochete] [DB:pir2] >gp:[GI:g3322423] [LN:AE001200] [AC:AE001200:AE000520]
[PN:conserved hypothetical protein] [GN:TP0156] [OR:*Treponema pallidum*]
[DB:genpept-bct2] [DE:*Treponema pallidum* section 16 of 87 of the complete
genome.] [NT:similar to GB:L42023 SP:P44679 PID:1003656] [LE:2984] [RE:3388]
[DI:complement]

| ORF Name | NT ID | AA ID | NT LN | AA LN | Score | P-Value |
|---|---|---|---|---|---|---|
| AI7503000984_505301_f3_345 | 762 | 4534 | 291 | 96 | | |

Description
NO-HIT

| ORF Name | NT ID | AA ID | NT LN | AA LN | Score | P-Value |
|---|---|---|---|---|---|---|
| AI7503000984_5109785_c3_670 | 763 | 4535 | 255 | 84 | 76 | 0.010 |

Description
gp:[GI:g4103231] [LN:AF021085] [AC:AF021085] [PN:cytochrome b] [GN:cytb]
[OR:Mitochondrion *Edaphus* sp.] [SR:*Edaphus* sp] [DB:genpept-inv2] [DE:*Edaphus*
sp. cytochrome b (cytb) gene, mitochondrial gene encoding mitochondrial
protein, partial cds.] [LE:<1] [RE:>465] DI:direct]

| ORF Name | NT ID | AA ID | NT LN | AA LN | Score | P-Value |
|---|---|---|---|---|---|---|
| AI7503000984_5113413_c3_653 | 764 | 4536 | 642 | 213 | 579 | 3.3e−56 |

Description
pir:[LN:D69670] [AC:D69670] [PN:glycine betaine/carnitine/choline ABC
transporter (membrane p) opuCB] [GN:opuCB] [CL:glycine
betaine/carnitine/choline ABC transporter] [OR:*Bacillus subtilis*] [DB:pir2]
>gp:[GI:g2271390] [LN:AF009352] [AC:AF009352] [PN:transmembrane protein]
[GN:opuCB] [OR:*Bacillus subtilis*] [DB:genpept-bct1] [DE:*Bacillus subtilis*
osmoprotectant transport system OpuC including ATPase (opuCA), transmembrane
protein (opuCB), osmoprotectant binding protein precursor (opuCC) and
transmembrane protein (opuCD) genes, complete cds.] [NT:OpuCB; part of the
osmoprotectant transport system] [LE:2025] [RE:2678] [DI:direct]
>gp:[GI:e1186070:g2635895] [LN:BSUB0018] [AC:Z99121:AL009126] [PN:glycine
betaine/carnitine/choline ABC] [GN:opuCB] [FN:high affinity transport of
glycine betaine,] [OR:*Bacillus subtilis*] [DB:genpept-bct1] [DE:*Bacillus
subtilis* complete genome (section 18 of 21):from 3399551 to 3609060.]
[NT:alternate gene name:yvbD] [LE:68697] [RE:69350] [DI:complement]

| ORF Name | NT ID | AA ID | NT LN | AA LN | Score | P-Value |
|---|---|---|---|---|---|---|
| AI7503000984_5160925_c1_443 | 765 | 4537 | 192 | 63 | | |

Description
NO-HIT

| ORF Name | NT ID | AA ID | NT LN | AA LN | Score | P-Value |
|---|---|---|---|---|---|---|
| AI7503000984_5189037_c3_620 | 766 | 4538 | 711 | 236 | 351 | 4.7e−32 |

Description
pir:IILN:H64461] [AC:H64461] [PN:6-carboxyhexanoate--CoA ligase,]
[CL:6-carboxyhexanoate--CoA ligase bioW] [OR:*Methanococcus jannaschii*]
[EC:6.2.1.14] [DB:pir2] [MP:FOR1244632-1245345] >gp:[GI:g1591935]
[LN:U67570] [AC:U67570:L77117] [PN:6-carboxyhexanoate-CoA ligase (bioW)]
[GN:MJ1297] [OR:*Methanococcus jannaschii*] [DB:genpept-bct2]
[DE:*Methanococcus jannaschii* section 112 of 150 of the complete genome.]
[NT:similar to GB:M29291 SP:P22822 PID:142594 percent] [LE:6098] [RE:6811]
[DI:direct]

| ORF Name | NT ID | AA ID | NT LN | AA LN | Score | P-Value |
|---|---|---|---|---|---|---|
| AI7503000984_5860630_c2_564 | 767 | 4539 | 171 | 56 | | |

-continued

| Description |
|---|
| NO-HIT |

| ORF Name | NT ID | AA ID | NT LN | AA LN | Score | P-Value |
|---|---|---|---|---|---|---|
| AI7503000984_6056567_c1_490 | 768 | 4540 | 579 | 192 | 320 | 9.1e−29 |

Description
pir:[LN:D64866] [AC:D64866] [PN:hypothetical protein b1199] [OR:*Escherichia coli*] [DB:pir2] >gp:[GI:g1787449] [LN:AE000218] [AC:AE000218:U00096] [PN:putative dihydroxyacetone kinase (EC 2.7.1.2)] [GN:b1199] [FN:putative enzyme; Not classified] [OR:*Escherichia coli*] [DB:genpept-bct2] [DE:*Escherichia coli* K-12 MG1655 section 108 of 400 of the complete genome.] [NT:f210; 30 pct identical (16 gaps) to 181 residues] [LE:4528] [RE:5160] [DI:complement]

| ORF Name | NT ID | AA ID | NT LN | AA LN | Score | P-Value |
|---|---|---|---|---|---|---|
| AI7503000984_625262_c1_430 | 769 | 4541 | 228 | 75 | 54 | 0.013 |

Description
gp:[GI:g765037] [LN:DROMTTRND] [AC:M18022] [PN:NADH dehydrogenase subunit 2] [OR:Mitochondrion *Drosophila melanogaster*] [SR:fruit fly] [DB:genpept-inv2] [DE:*D. melanogaster* Trp-tRNA, Cys-tRNA, Tyr-tRNA, NADH dehydrogenase subunit 2 (3' end) cytochrome oxidase subunit 1 (5' end) genes.] [LE:<1] [RE:462] [DI:direct]

| ORF Name | NT ID | AA ID | NT LN | AA LN | Score | P-Value |
|---|---|---|---|---|---|---|
| AI7503000984_6302217_c3_638 | 770 | 4542 | 948 | 315 | 1335 | 2.5e−136 |

Description
gp:[GI:g3800819] [LN:AF076683] [AC:AF076683] [PN:oligopeptide transporter putative membrane] [GN:opp-1B] [OR:*Staphylococcus aureus*] [DB:genpept-bct2] [DE:*Staphylococcus aureus* oligopeptide transporter putative substrate binding domain (opp-1A), oligopeptide transporter putative membrane permease domain (opp-1B), oligopeptide transporter putative membrane permease domain (opp-1C), oligopeptide transporter putative ATPase domain (opp-1D), and oligopeptide transporter putative ATPase domain (opp-1F) genes, complete cds; and unknown gene.] [LE:1537] [RE:2472] [DI:direct]

| ORF Name | NT ID | AA ID | NT LN | AA LN | Score | P-Value |
|---|---|---|---|---|---|---|
| AI7503000984_6725817_c3_658 | 771 | 4543 | 165 | 54 | | |

| Description |
|---|
| NO-HIT |

| ORF Name | NT ID | AA ID | NT LN | AA LN | Score | P-Value |
|---|---|---|---|---|---|---|
| AI7503000984_7072825_c1_435 | 772 | 4544 | 774 | 257 | 459 | 1.7e−43 |

Description
gp:[GI:g4980796] [LN:AE001711] [AC:AE001711:AE000512] [PN:oxidoreductase, short chain] [GN:TM0297] [OR:*Thermotoga maritima*] [DB:genpept-bct2] [DE:*Thermotoga maritima* section 23 of 136 of the complete genome.] [NT:similar to SP:P50167 PID:763164 percent identity:] [LE:7161] [RE:7934] [DI:direct]

| ORF Name | NT ID | AA ID | NT LN | AA LN | Score | P-Value |
|---|---|---|---|---|---|---|
| AI7503000984_800300_c1_458 | 773 | 4545 | 585 | 194 | 313 | 5.0e−28 |

Description
pir:[LN:S23693] [AC:S23693] [PN:erythrocyte membrane-associated antigen (clone pPf K19)] [OR:*Plasmodium falciparum*] [DB:pir2]

| ORF Name | NT ID | AA ID | NT LN | AA LN | Score | P-Value |
|---|---|---|---|---|---|---|
| AI7503000984_814140_c1_437 | 774 | 4546 | 1422 | 473 | 1168 | 1.3e−118 |

Description
sp:[LN:UHPT_ECOLI] [AC:P13408:P76727] [GN:UHPT] [OR:*ESCHERICHIA COLI*] [DE:HEXOSE PHOSPHATE TRANSPORT PROTEIN] [SP:P13408:P76727] [DB:swissprot] >pir:[LN:MMECHP] [AC:A30395:H41853:C65168:Q00500:S30079] [PN:hexose phosphate transport protein uhpT] [GN:uhpT] [CL:hexose phosphate transport protein uhpT] [OR:*Escherichia coli*] [DB:pir1] [MP:82 min] >gp:[GI:g148115] [LN:ECOUHP] [AC:M17102] [OR:*Escherichia coli*] [SR:*E. coli* DNA, clone pRJK10] [DB:genpept-bct1] [DE:*E. coli* uhp operon encoding UhpA, UhpB, UhpC, and UhpT -continued protein, (encoding hexose phosphate transport protein), complete cds, and
anilvBN operon encoded protein, 3' end.] [NT:hexose phosphate transport
protein UhpT] [LE:3722] [RE:5113] [DI:direct] >gp:[GI:g148120]
[LN:ECOUHPABCT] [AC:M89479] [PN:hexosephosphate transport protein] [GN:uhpT]
[OR:*Escherichia coli*] [SR:*Escherichia coli* DNA] [DB:genpept-bct1]
[DE:*Escherichia coli* uhpABCT operon encoding hexosephosphateutilization
protein (uhpA) gene, complete cds, and hexosephosphate transport protein
(uhpB, uhpC, uhpT) genes, complete cds.] [LE:3722] [RE:5113] [DI:direct]
>gp:[GI:g2367259] [LN:AE000444] [AC:AE000444:U00096] [PN:hexose phosphate
transport protein] [GN:uhpT] [FN:transport; Transport of small molecules:]
[OR:*Escherichia coli*] [DB:genpept-bct2] [DE:*Escherichia coli* K-12 MG1655
section 334 of 400 of the complete genome.] [NT:f463; 99 pct identical amino
acid sequence and] [LE:5590] [RE:6981] [DI:complement]

| ORF Name | NT ID | AA ID | NT LN | AA LN | Score | P-Value |
|---|---|---|---|---|---|---|
| AI7503000984__81525__f3__398 | 775 | 4547 | 135 | 44 | | |

Description
NO-HIT

| ORF Name | NT ID | AA ID | NT LN | AA LN | Score | P-Value |
|---|---|---|---|---|---|---|
| AI7503000984__816878__c3__637 | 776 | 4548 | 1632 | 543 | 2188 | 1.0e−226 |

Description
gp:[GI:g3800818] [LN:AF076683] [AC:AF076683] [PN:oligopeptide transporter
putative substrate] [GN:opp-1A] [OR:*Staphylococcus aureus*] [DB:genpept-bct2]
[DE:*Staphylococcus aureus* oligopeptide transporter putative substrate binding
domain (opp-1A), oligopeptide transporter putative membrane permease domain
(opp-1B), oligopeptide transporter putative membrane permease domain
(opp-1C), oligopeptide transporter putative ATPase domain (opp-1D), and
oligopeptide transporter putative ATPase domain (opp-1F) genes, complete cds;
and unknown gene.] [LE:64] [RE:1524] [DI:direct]

| ORF Name | NT ID | AA ID | NT LN | AA LN | Score | P-Value |
|---|---|---|---|---|---|---|
| AI7503000984__822150__f2__262 | 777 | 4549 | 516 | 171 | 89 | 0.028 |

Description
gp:[GI:d1006984:g567946] [LN:PXMTGBP] [AC:D30753] [PN:21K protein]
[FN:Presumably cell to cell movement] [OR:Potato mop-top virus] [SR:Potato
mop-top virus (individual__isolate Todd) (library:Tb2-1] [DB:genpept-vrl]
[DE:Potato mop-top virus RNA for 51K protein, 13K protein, 21K protein and 8K
protein, complete cds.] [NT:putative] [LE:1961] [RE:2533] [DI:direct]

| ORF Name | NT ID | AA ID | NT LN | AA LN | Score | P-Value |
|---|---|---|---|---|---|---|
| AI7503000984__875765__c2__525 | 778 | 4550 | 210 | 69 | | |

Description
NO-HIT

| ORF Name | NT ID | AA ID | NT LN | AA LN | Score | P-Value |
|---|---|---|---|---|---|---|
| AI7503000984__969157__c1__420 | 779 | 4551 | 1026 | 341 | 220 | 8.5e−16 |

Description
gp:[GI:g3800818] [LN:AF076683] [AC:AF076683] [PN:oligopeptide transporter
putative substrate] [GN:opp-1A] [OR:*Staphylococcus aureus*] [DB:genpept-bct2]
[DE:*Staphylococcus aureus* oligopeptide transporter putative substrate binding
domain (opp-1A), oligopeptide transporter putative membrane permease domain
(opp-1B), oligopeptide transporter putative membrane permease domain
(opp-1C), oligopeptide transporter putative ATPase domain (opp-1D), and
oligopeptide transporter putative ATPase domain (opp-1F) genes, complete cds;
and unknown gene.] [LE:64] [RE:1524] [DI:direct]

| ORF Name | NT ID | AA ID | NT LN | AA LN | Score | P-Value |
|---|---|---|---|---|---|---|
| AI7503000984__9806718__c1__474 | 780 | 4552 | 762 | 253 | 862 | 3.4e−86 |

Description
gp:[GI:g3800822] [LN:AF076683] [AC:AF076683] [PN:oligopeptide transporter
putative ATPase domain] [GN:opp-1F] [OR:*Staphylococcus aureus*]
(DB:genpept-bct2] [DE:*Staphylococcus aureus* oligopeptide transporter
putative substrate binding domain (opp-1A), oligopeptide transporter putative
membrane permease domain (opp-1B), oligopeptide transporter putative membrane
permease domain (opp-1C), oligopeptide transporter putative ATPase domain -continued (opp-1D), and oligopeptide transporter putative ATPase domain (opp-1F) genes, complete cds; and unknown gene.] [LE:4137] [RE:4892] [DI:direct]

| ORF Name | NT ID | AA ID | NT LN | AA LN | Score | P-Value |
|---|---|---|---|---|---|---|
| AI7503000984_984686_c1_478 | 781 | 4553 | 1221 | 406 | 1172 | 4.8e−119 |

Description
pir:[LN:C69670] [AC:C69670] [PN:glycine betaine/carnitine/choline ABC transporter (ATP-binding) opuCA] [GN:opuCA] [CL:glycine betaine/proline transport protein proV:ATP-binding cassette homology:CBS homology] [OR:*Bacillus subtilis*] [DB:pir2] >gp:[GI:g2271389] [LN:AF009352] [AC:AF009352] [PN:ATPase] [GN:opuCA] [OR:*Bacillus subtilis*] [DB:genpept-bct1] [DE:*Bacillus subtilis* osmoprotectant transport system OpuC including ATPase (opuCA), transmembrane protein (opuCB), osmoprotectant binding protein precursor (opuCC) and transmembrane protein (opuCD) genes, complete cds.] [NT:OpuCA; part of the osmoprotectant transport system] [LE:860] [RE:2002] [DI:direct] >gp:[GI:e1186071:g2635896] [LN:BSUB0018] [AC:Z99121:AL009126] [PN:glycine betaine/carnitine/choline ABC] [GN:opuCA] [FN:high affinity transport of glycine betaine,] [OR:*Bacillus subtilis*] [DB:genpept-bct1] [DE:*Bacillus subtilis* complete genome (section 18 of 21):from 3399551 to 3609060.] [NT:alternate gene name: yvbE] [LE:69373] [RE:70515] [DI:complement]

| ORF Name | NT ID | AA ID | NT LN | AA LN | Score | P-Value |
|---|---|---|---|---|---|---|
| AI7503000984_9970167_f3_393 | 782 | 4554 | 861 | 286 | 219 | 2.9e−25 |

Description
pir:[LN:E69796] [AC:E69796] [PN:two-component response regulator [YesM] homolog yesN] [GN:yesN] [CL:response regulator homology] [OR:*Bacillus subtilis*] [DB:pir2] >gp:[GI:e1182675:g2633009] [LN:BSUB0004] [AC:Z99107:AL009126] [GN:yesN] [FN:unknown] [OR:*Bacillus subtilis*] [DB:genpept-bct1] [DE:*Bacillus subtilis* complete genome (section 4 of 21): from 600701 to 813890.] [NT:similar to two-component response regulator [YesM]] [LE:159260] [RE:160366] [DI:direct]

| ORF Name | NT ID | AA ID | NT LN | AA LN | Score | P-Value |
|---|---|---|---|---|---|---|
| AI7503000984_9973515_c1_495 | 783 | 4555 | 261 | 86 | | |

Description
NO-HIT

| ORF Name | NT ID | AA ID | NT LN | AA LN | Score | P-Value |
|---|---|---|---|---|---|---|
| AI7503000985_10000183_c3_2061 | 784 | 4556 | 168 | 55 | | |

Description
NO-HIT

| ORF Name | NT ID | AA ID | NT LN | AA LN | Score | P-Value |
|---|---|---|---|---|---|---|
| AI7503000985_10034627_f3_956 | 785 | 4557 | 144 | 47 | | |

Description
NO-HIT

| ORF Name | NT ID | AA ID | NT LN | AA LN | Score | P-Value |
|---|---|---|---|---|---|---|
| AI7503000985_10195252_f2_807 | 786 | 4558 | 126 | 41 | | |

Description
NO-HIT

| ORF Name | NT ID | AA ID | NT LN | AA LN | Score | P-Value |
|---|---|---|---|---|---|---|
| AI7503000985_10203501_c2_1757 | 787 | 4559 | 156 | 51 | | |

Description
NO-HIT

| ORF Name | NT ID | AA ID | NT LN | AA LN | Score | P-Value |
|---|---|---|---|---|---|---|
| AI7503000985_10241433_c1_1640 | 788 | 4560 | 126 | 41 | 104 | 1.4e−05 |

Description
sp:[LN:YDGI_BACSU] [AC:P96707] [GN:YDGI] [OR:*BACILLUS SUBTILIS*] [EC:1.—.—.—] [DE:PUTATIVE NAD(P)H NITROREDUCTASE YDGI,] [SP:P96707] [DB:swissprot]

-continued

>pir:LN:C69783] [AC:C69783] [PN:NADH dehydrogenase homolog ydgI] [GN:ydgI]
[CL:nitroreductase] [OR:*Bacillus subtilis*] [DB:pir2]
>gp:[GI:d1020152:g1881372] [LN:AB001488] [AC:AB001488] [GN:ydgI]
[OR:*Bacillus subtilis*] [SR:*Bacillus subtilis* (strain:168) DNA]
[DB:genpept-bct1] [DE:*Bacillus subtilis* genome sequence, 148 kb sequence of
the region between 35 and 47 degree.] [NT:SIMILAR TO NITROREDUCTASE.]
[LE:145410] [RE:146039] [DI:complement] >gp:[GI:e1182545:g2632879]
[LN:BSUB0004] [AC:Z99107:AL009126] [GN:ydgI] [FN:unknown] [OR:*Bacillus
subtilis*] [DB:genpept-bct1] [DE:*Bacillus subtilis* complete genome (section 4
of 21):from 600701 to 813890.) [NT:similar to NADH dehydrogenase]
[SP:P96707] [LE:11206] [RE:11835] [DI:complement]

| ORF Name | NT ID | AA ID | NT LN | AA LN | Score | P-Value |
|---|---|---|---|---|---|---|
| AI7503000985__10332262__f1__254 | 789 | 4561 | 366 | 121 | | |

Description
NO-HIT

| ORF Name | NT ID | AA ID | NT LN | AA LN | Score | P-Value |
|---|---|---|---|---|---|---|
| AI7503000985__1046885__f1__82 | 790 | 4562 | 2217 | 738 | 1356 | 1.5e−138 |

Description
gp:[GI:e245927:g2462047] [LN:ACRBDOXN] [AC:Z46863] [PN:polyphosphate kinase]
[GN:ppk] [OR:*Acinetobacter* sp. ADP1] [DB:genpept-bct1] [DE:*Acinetobacter* sp.
cysD, cobQ, sodM, lysS, rubA, rubB, estB, oxyR, ppk, mtgA, ORF2 and ORF3
genes.] [NT:putative; transcription of ppk is induced by] [LE:9244]
[RE:11319] [DI:complement]

| ORF Name | NT ID | AA ID | NT LN | AA LN | Score | P-Value |
|---|---|---|---|---|---|---|
| AI7503000985__10585432__c1__1539 | 791 | 4563 | 591 | 196 | 171 | 2.3e−18 |

Description
sp:[LN:GGT_BACSU] [AC:P54422] [GN:GGT] [OR:*BACILLUS SUBTILIS*] [EC:2.3.2.2]
[DE:GAMMA-GLUTANYLTRANSPEPTIDASE PRECURSOR,] [SP:P54422] [DB:swissprot]
>pir:[LN:F69631] [AC:F69631:JC5867:PC4504] [PN:gamma-glutamyltransferase,
precursor:gamma glutamyl transpeptidase] [GN:ggt]
[CL:gamma-glutamyltransferase] [OR:*Bacillus subtilis*] [EC:2.3.2.2] [DB:pir2]
>gp:[GI:e1183499:g2634224] [LN:BSUB0010] [AC:Z99113:AL009126]
[PN:gamma-glutamyltranspeptidase] [GN:ggt] [FN:glutathione metabolism]
[OR:*Bacillus subtilis*] [DB:genpept-bct1] [EC:2.3.2.2] [DE:*Bacillus subtilis*
complete genome (section 10 of 21):from 1781201 to 2014980.] [NT:alternate
gene name:pac] [SP:P54422] [LE:222733] [RE:224496] [DI:direct]
>gp:[GI:e1185314:g2634235] [LN:BSUB0011] [AC:Z99114:AL009126]
PN:gamma-glutamyltranspeptidase] [GN:ggt] [FN:glutathione metabolism]
[OR:*Bacillus subtilis*] [DB:genpept-bct1] [EC:2.3.2.2] [DE:*Bacillus subtilis*
complete genome (section 11 of 21):from 2000171 to 2207900.] [NT:alternate
gene name:pac] [SP:P54422] [LE:3763] [RE:5526] [DI:direct]
>gp:[GI:g1491813] [LN:BSU49358] [AC:U49358]
[PN:gamma-glutamyltranspeptidase] [GN:ggt] [OR:*Bacillus subtilis*]
[SR:*Bacillus subtilis* strain = JH642] [DB:genpept-bct2] [DE:*Bacillus subtilis*
gamma-glutamyltranspeptidase (ggt) gene, complete cds.] [LE:250] [RE:2013]
[DI:direct]

| ORF Name | NT ID | AA ID | NT LN | AA LN | Score | P-Value |
|---|---|---|---|---|---|---|
| AI7503000985__10600010__c2__1931 | 792 | 4564 | 192 | 63 | | |

Description
NO-HIT

| ORF Name | NT ID | AA ID | NT LN | AA LN | Score | P-Value |
|---|---|---|---|---|---|---|
| AI7503000985__10601625__c3__2039 | 793 | 4565 | 231 | 76 | 55 | 0.0050 |

Description
gp:[GI:e1286089:g3036830] [LN:CJAJ0856] [AC:AJ000856] [PN:ABC transporter
protein] [GN:kpsM] [OR:*Campylobacter jejuni*] [DB:genpept-bct1]
[DE:*Campylobacter jejuni* kpsM, kpsT genes.] [LE:134] [RE:916] [DI:direct]

| ORF Name | NT ID | AA ID | NT LN | AA LN | Score | P-Value |
|---|---|---|---|---|---|---|
| AI7503000985__10605337__c2__1945 | 794 | 4566 | 747 | 248 | 706 | 1.1e−69 |

Description
gp:[GI:g666983] [LN:BSPAAT] [AC:X77636] [PN:putative ATP binding subunit]
[GN:ORF3] [OR:*Bacillus subtilis*] [DB:genpept-bct1] [DE:*B. subtilis* putative -continued amino acid transporter gene.] [NT:potential ABC-transport system] [SP:P39456] [LE:1627] [RE:2370] [DI:direct]

| ORF Name | NT ID | AA ID | NT LN | AA LN | Score | P-Value |
|---|---|---|---|---|---|---|
| AI7503000985__1063552__f3__982 | 795 | 4567 | 390 | 129 | | |

Description
NO-HIT

| ORF Name | NT ID | AA ID | NT LN | AA LN | Score | P-Value |
|---|---|---|---|---|---|---|
| AI7503000985__1064050__f2__826 | 796 | 4568 | 150 | 49 | | |

Description
NO-HIT

| ORF Name | NT ID | AA ID | NT LN | AA LN | Score | P-Value |
|---|---|---|---|---|---|---|
| AI7503000985__10657827__c1__1607 | 797 | 4569 | 1401 | 466 | 393 | 1.7e−36 |

Description
gp:[GI:e304997:g2294506] [LN:A37836] [AC:A37836] [OR:*Streptomyces pristinaespiralis*] [DB:genpept-pat] [DE:Sequence 6 from Patent WO9408014.] [NT:unnamed protein product] [LE:103] [RE:1689] [DI:direct]

| ORF Name | NT ID | AA ID | NT LN | AA LN | Score | P-Value |
|---|---|---|---|---|---|---|
| AI7503000985__10667002__c2__1653 | 798 | 4570 | 129 | 42 | | |

Description
NO-HIT

| ORF Name | NT ID | AA ID | NT LN | AA LN | Score | P-Value |
|---|---|---|---|---|---|---|
| AI7503000985__10667003__f1__29 | 799 | 4571 | 174 | 57 | | |

Description
NO-HIT

| ORF Name | NT ID | AA ID | NT LN | AA LN | Score | P-Value |
|---|---|---|---|---|---|---|
| AI7503000985__10718762__f1__204 | 800 | 4572 | 165 | 54 | | |

Description
NO-HIT

| ORF Name | NT ID | AA ID | NT LN | AA LN | Score | P-Value |
|---|---|---|---|---|---|---|
| AI7503000985__10736312__c1__1452 | 801 | 4573 | 132 | 43 | | |

Description
NO-HIT

| ORF Name | NT ID | AA ID | NT LN | AA LN | Score | P-Value |
|---|---|---|---|---|---|---|
| AI7503000985__1074177__c2__1838 | 802 | 4574 | 825 | 274 | 417 | 4.8e−39 |

Description
pir:[LN:F64819] [AC:F64819] [PN:hypothetical protein b0822] [OR:*Escherichia coli*] [DB:pir2] >gp:[GI:d1036489:g4062389] [LN:D90719] [AC:D90719:AB001340] [PN:Hypothetical protein 1] [OR:*Escherichia coli*] [SR:*Escherichia coli* (strain:K12) DNA, clone:Kohara clone #206] [DB:genpept-bct1] [DE:*Escherichia coli* genomic DNA. (18.2–18.6 min).] [NT:ORF__ID:o207#5; similar to PIR Accession Number] [LE:13745] [RE:14560] [DI:complement] >gp:[GI:d1036496:g4062396] [LN:D90720] [AC:D90720:AB001340] [PN:Hypothetical protein 1] [OR:*Escherichia coli*] [SR:*Escherichia coli* (strain:K12) DNA, clone:Kohara clone #207] [DB:genpept-bct1] [DE:*Escherichia coli* genomic DNA. (18.4–18.8 min).] [NT:ORF__ID:o207#5; similar to PIR Accession Number] [LE:5774] [RE:6589] [DI:complement] >gp:[GI:g1787043] [LN:AE000184] [AC:AE000184:U00096] [PN:orf, hypothetical protein] [GN:b0822] [FN:orf; Unknown] [OR:*Escherichia coli*] [DB:genpept-bct2] [DE:*Escherichia coli* K-12 MG1655 section 74 of 400 of the complete genome.] [NT:f271; This 271 aa ORF is 24 pct identical (16 gaps)] [LE:6609] [RE:7424] [DI:complement]

| ORF Name | NT ID | AA ID | NT LN | AA LN | Score | P-Value |
|---|---|---|---|---|---|---|
| AI7503000985__10756925__f1__228 | 803 | 4575 | 1566 | 521 | 793 | 6.9e−70 |

-continued

Description
gp:[GI:d1020925:g2116759] [LN:D86418] [AC:D86418] [PN:YfnA] [OR:*Bacillus subtilis*] [SR:*Bacillus subtilis* (strain:AC327) DNA] [DB:genpept-bct1]
[DE:*Bacillus subtilis* genomic DNA 69–70 degree region, partial sequence.]
[LE:7539] [RE:8927] [DI:direct]

| ORF Name | NT ID | AA ID | NT LN | AA LN | Score | P-Value |
|---|---|---|---|---|---|---|
| AI7503000985__10938903__f1__322 | 804 | 4576 | 144 | 47 | | |

Description
NO-HIT

| ORF Name | NT ID | AA ID | NT LN | AA LN | Score | P-Value |
|---|---|---|---|---|---|---|
| AI7503000985__10954127__f3__1025 | 805 | 4577 | 201 | 66 | | |

Description
NO-HIT

| ORF Name | NT ID | AA ID | NT LN | AA LN | Score | P-Value |
|---|---|---|---|---|---|---|
| AI7503000985__10973385__c3__2080 | 806 | 4578 | 312 | 103 | 80 | 0.010 |

Description
gp:[GI:g4731918] [LN:AF111944] [AC:AF111944] [PN:development protein DG1122]
[GN:DG1122] [OR:*Dictyostelium discoideum*] [DB:genpept-inv2]
[DE:*Dictyostelium discoideum* AX4 development protein DG1122 (DG1122) gene,
partial cds.] [LE:207:829] [RE:744:>1036] [DI:directJoin]

| ORF Name | NT ID | AA ID | NT LN | AA LN | Score | P-Value |
|---|---|---|---|---|---|---|
| AI750300985__11063801__f1__381 | 807 | 4579 | 225 | 74 | | |

Description
NO-HIT

| ORF Name | NT ID | AA ID | NT LN | AA LN | Score | P-Value |
|---|---|---|---|---|---|---|
| AI7503000985__11132010__c1__1519 | 808 | 4580 | 126 | 41 | | |

Description
NO-HIT

| ORF Name | NT ID | AA ID | NT LN | AA LN | Score | P-Value |
|---|---|---|---|---|---|---|
| AI7503000985__115761__c3__2118 | 809 | 4581 | 1458 | 485 | 799 | 1.6e−79 |

Description
pir:[LN:S77243] [AC:S77243] [PN:hypothetical protein slr1363]
[OR:*Synechocystis* sp.] [SR:PCC 6803, , PCC 6803] [SR:PCC 6803,] [DB:pir2]
>gp:[GI:d1018310:g1652657] [LN:D90907] [AC:D90907:AB001339] [PN:hypothetical
protein] [GN:glgP] [OR:*Synechocystis* sp.] [SR:*Synechocystis* sp.
(strain:PCC6803) DNA] [DB:genpept-bct1] [DE:*Synechocystis* sp. PCC6803
complete genome, 9/27, 1056467–1188885.] [NT:ORF_ID:slr1363] [LE:49200]
[RE:50702] [DI:direct]

| ORF Name | NT ID | AA ID | NT LN | AA LN | Score | P-Value |
|---|---|---|---|---|---|---|
| AI7503000985__117150__f1__173 | 810 | 4582 | 1311 | 436 | 1525 | 1.9e−156 |

Description
gp:[GI:g4096796] [LN:SCU40157] [AC:U40157] [OR:*Staphylococcus carnosus*]
[DB:genpept-bct2] [DE:*Staphylococcus carnosus* condensing-enzyme-like protein
(orf1) and SpoVE-like protein (orf2) genes, complete cds.] [NT:orf1; unknown
function; similar to] [LE:193] [RE:1362] [DI:direct]

| ORF Name | NT ID | AA ID | NT LN | AA LN | Score | P-Value |
|---|---|---|---|---|---|---|
| AI7503000985__1173130__c1__1530 | 811 | 4583 | 2091 | 696 | 2666 | 2.3e−277 |

Description
pir:[LN:S46952] [AC:S46952:S63605] [PN:phosphotransferase system enzyme
II,, glucose-specific, factor IIA:glucose
permease:phosphoenolpyruvate:glucose phosphotransferase system enzyme II,
glucose-specific:phosphotransferase system enzyme II, glucose-specific,
factor 1:protein-Npi-phosphohistidine--sugar phosphotransferase,
glucose-specific, factor II] [GN:glcA:ptsG] [CL:phosphotransferase system
N-acetylglucosamine-specific enzyme II:phosphotransferase system glucose-specific enzyme II, factor II homology:phosphotransferase system
glucose-specific enzyme II, factor III homology] [OR:*Staphylococcus
carnosus*] [EC:2.7.1.69] [DB:pir1] >gp:[GI:g1072418] [LN:SCGLCAB]
[AC:X93360:X80415] [GN:glcA] [OR:*Staphylococcus carnosus*] [DB:genpept-bct1]
[DE:*S. carnosus* glcA gene and glcB gene.] [LE:540] [RE:2567] [DI:direct]

| ORF Name | NT ID | AA ID | NT LN | AA LN | Score | P-Value |
|---|---|---|---|---|---|---|
| AI7503000985_11756543_f2_497 | 812 | 4584 | 231 | 76 | | |

Description
NO-HIT

| ORF Name | NT ID | AA ID | NT LN | AA LN | Score | P-Value |
|---|---|---|---|---|---|---|
| AI7503000985_1178593_f3_990 | 813 | 4585 | 1590 | 529 | 1527 | 1.1e−156 |

Description
pir:[LN:C69794] [AC:C69794] [PN:glutamate synthase (ferredoxin) homolog
yerD] [GN:yerD] [OR:*Bacillus subtilis*] [DB:pir2] >gp:[GI:e1182639:g2632973]
[LN:BSUB0004] [AC:Z99107:AL009126] [GN:yerD] [FN:unknown] [OR:*Bacillus
subtilis*] [DB:genpept-bct1] [DE:*Bacillus subtilis* complete genome (section 4
of 21):from 600701 to 813890.] [NT:similar to glutamate synthase
(ferredoxin)] [LE:115586] [RE:117163] [DI:complement]
>gp:[GI:e1167974:g2577963] [LN:BSYERABCD] [AC:Y15254] [PN:YerD protein]
[GN:yerD] [OR:*Bacillus subtilis*] [DB:genpept-bct1] [DE:*Bacillus subtilis*
13 kB DNA fragment, from yerA to sapB gene.] [NT:similar to plectonema
boryanum large subunit of] [LE:3231] [RE:4808] [DI:complement]

| ORF Name | NT ID | AA ID | NT LN | AA LN | Score | P-Value |
|---|---|---|---|---|---|---|
| AI7503000985_1180292_c1_1536 | 814 | 4586 | 1164 | 387 | 1050 | 4.0e−106 |

Description
pir:[LN:F70069] [AC:F70069] [PN:capsular polyglutamate biosynthesis homolog
ywsC] [GN:ywsC] [OR:*Bacillus subtilis*] [DB:pir2] >gp:[GI:e1184496:g2636115]
[LN:BSUB0019] [AC:Z99122:AL009126] [GN:ywsC] [FN:unknown] [OR:*Bacillus
subtilis*] [DB:genpept-bct1] [DE:*Bacillus subtilis* complete genome (section
19 of 21):from 3597091 to 3809700.] [NT:similar to capsular polyglutamate
biosynthesis] [LE:101413] [RE:102594] [DI:complement]
>gp:[GI:e1184496:g2636115] [LN:BSUB0019] [AC:Z99122:AL009126] [GN:ywsC]
[FN:unknown] [OR:*Bacillus subtilis*] [DB:genpept] [DE:*Bacillus subtilis*
complete genome (section 19 of 21):from 3597091 to 3809700.] [NT:similar to
capsular polyglutamate biosynthesis] [LE:101413] [RE:102594] [DI:complement]

| ORF Name | NT ID | AA ID | NT LN | AA LN | Score | P-Value |
|---|---|---|---|---|---|---|
| AI7503000985_11855463_c3_2075 | 815 | 4587 | 747 | 248 | 791 | 1.1e−78 |

Description
pir:[LN:H69611] [AC:H69611] [PN:3'-phosphoadenosine 5'-phosphosulfate
reductase, cysH:3'-phosphoadenylylsulfate reductase, thioredoxin dependent:
PAPS reductase:PAPS sulfotransferase] [GN:cysH] [OR:*Bacillus subtilis*]
[EC:1.8.99.4] [DB:pir2] >gp:[GI:e332183:g2462956] [LN:BSPYREYLO]
[AC:AJ000974] [PN:putative phospho-adenylylsulphate] [GN:cysH] [OR:*Bacillus
subtilis*] [DB:genpept-bct1] [DE:*Bacillus subtilis* pyrE to yloA gene region.]
[LE:548] [RE:1249] [DI:direct] >gp:[GI:e1185149:g2633930] [LN:BSUB0009]
[AC:Z99112:AL009126] [PN:phosphoadenosine phosphosulfate] [GN:cysH]
[FN:cysteine biosynthesis] [OR:*Bacillus subtilis*] [DB:genpept-bct1]
[EC:1.8.99.4] [DE:*Bacillus subtilis* complete genome (section 9 of 21):from
1598421 to 1807200.] [LE:31361] [RE:32062] [DI:direct]

| ORF Name | NT ID | AA ID | NT LN | AA LN | Score | P-Value |
|---|---|---|---|---|---|---|
| AI7503000985_11881630_f2_658 | 816 | 4588 | 132 | 43 | | |

Description
NO-HIT

| ORF Name | NT ID | AA ID | NT LN | AA LN | Score | P-Value |
|---|---|---|---|---|---|---|
| AI7503000985_11886592_c2_1671 | 817 | 4589 | 654 | 217 | 481 | 8.0e−46 |

Description
Sp:[LN:HIS2_HAEIN] [AC:P44434] [GN:HISI:HISIE:HI0475] [OR:*HAEMOPHILUS
INFLUENZAE*] [EC:3.5.4.19:3.6.1.31] [DE:PYROPHOSPHOHYDROLASE,] [SP:P44434]
[DB:swissprot] >pir:[LN:A64071] [AC:A64071] [PN:phosphoribosyl-AMP
cyclohydrolase, / phosphoribosyl-ATP pyrophosphatase,] [CL:hisI bifunctional
enzyme:hisI bifunctional enzyme homology:hisI protein homology]

-continued

[OR:*Haemophilus influenzae*] [EC:3.5.4.19:3.6.1.31] [DB:pir2]
>gp:[GI:g1573454] [LN:U32730] [AC:U32730:L42023] [PN:phosphoribosyl-AMP cyclohydrolase /] [GN:HI0475] [OR:*Haemophilus influenzae* Rd]
[DB:genpept-bct2] [DE:*Haemophilus influenzae* Rd section 45 of 163 of the complete genome.] [NT:similar to SP:P06989 GB:D43637 GB:U02072 GB:X03974]
[LE:4576] [RE:5241] [DI:direct]

| ORF Name | NT ID | AA ID | NT LN | AA LN | Score | P-Value |
|---|---|---|---|---|---|---|
| AI7503000985__11955127__f1__420 | 818 | 4590 | 144 | 47 | | |

Description
NO-HIT

| ORF Name | NT ID | AA ID | NT LN | AA LN | Score | P-Value |
|---|---|---|---|---|---|---|
| AI7503000985__119633__f1__70 | 819 | 4591 | 1389 | 462 | 494 | 3.3e−47 |

Description
pir:[LN:B69680] [AC:B69680:140510] [PN:para-nitrobenzyl esterase,] [GN:pnbA]
[CL:cholinesterase homology] [OR:*Bacillus subtilis*] [EC:3.1.1.—] [DB:pir2]
>gp:[GI:g1762126] [LN:BSU46134] [AC:U46134] [PN:intracellular esterase B]
[GN:estB] [OR:*Bacillus subtilis*] [DB:genpept-bct1] [EC:3.1.1.1] [DE:*Bacillus subtilis* putative orf1 unknown protein, putative transcriptional regulator
(slr), and intracellular esterase B (estB) genes, complete cds.] [NT:EstB;
esterase of the serine-hydrolase family] [LE:1035] [RE:2504] [DI:direct]
>gp:[GI:e1186127:g2635952] [LN:BSUB0018] [AC:Z99121:AL009126]
[PN:para-nitrobenzyl esterase (intracellular] [GN:pnbA] [OR:*Bacillus subtilis*] [DB:genpept-bct1] [EC:3.1.1.1] [DE:*Bacillus subtilis* complete
genome (section 18 of 21):from 3399551 to 3609060.] [NT:alternate gene name:
estB] [LE:130145] [RE:131614] [DI:direct] >gp:[GI:e238702:g1495277]
[LN:BSYVEFGNS] [AC:Z71928] [PN:para-nitrobenzyl esterase] [GN:pnbA]
[OR:*Bacillus subtilis*] [DB:genpept-bct1] [DE:*B. subtilis* pnbA, sigL,
yve[J, K, L, M, N, O, P, Q, R, S, T] and yvf[A, B, C, D, E, F, G, H] genes.] [LE:132]
[RE:1601] [DI:complement] >gp:[GI:e313129:g1945688] [LN:BSZ94043]
[AC:Z94043] [PN:para-nitrobenzyl esterase] [GN:pnbA] [OR:*Bacillus subtilis*]
[DB:genpept-bct1] [DE:*B. subtilis* genomic DNA fragment (88 kb).] [LE:50057]
[RE:51526] [DI:complement]

| ORF Name | NT ID | AA ID | NT LN | AA LN | Score | P-Value |
|---|---|---|---|---|---|---|
| AI7503000985__1207287__c2__1669 | 820 | 4592 | 621 | 206 | 365 | 1.6e−33 |

Description
sp:[LN:HIS1_LACLA] [AC:Q02129] [GN:HISG] [OR:*LACTOCOCCUS LACTIS*]
[SR:,SUBSPLACTIS:*STREPTOCOCCUS LACTIS*] [EC:2.4.2.17] [DE:ATP
PHOSPHORIBOSYLTRANSFERASE,] [SP:Q02129] [DB:swissprot] >pir:[LN:D45734]
[AC:D45734] [PN:HisG] [OR:*Lactococcus lactis* subsp. *lactis*] [DB:pir2]
>gp:[GI:g2565141] [LN:LLU92974] [AC:U92974:M90760:M90761] [PN:HisG]
[GN:hisG] [OR:*Lactococcus lactis*] [DB:genpept-bct1] [DE:*Lactococcus lactis*
unknown gene, partial cds, and HisC (hisC), unknown, HisG (hisG), unknown,
HisB (hisB), unknown, HisH (hish), HisA (hisA), HisF (hisF), HisIE (hisIE),
unknown, unknown, LeuA (leuA), LeuB (leuB), LeuC (leuC), LeuD (leuD),
unknown, IlvD (ilvD), IlvB (ilvB), IlvN, IlvC (ilvC), IlvA (ilvA), AldB
(aldB) and aldR (aldR) genes, complete cds.] [NT:phosphoribosyl-ATP
synthetase] [LE:3125] [RE:3751] [DI:direct]

| ORF Name | NT ID | AA ID | NT LN | AA LN | Score | P-Value |
|---|---|---|---|---|---|---|
| AI7503000985__1207938__c3__2244 | 821 | 4593 | 828 | 275 | 953 | 7.7e−96 |

Description
gp:[GI:g4433636] [LN:AF029224] [AC:AF029224:AF029225] [PN:NirC] [GN:nirC]
[FN:putative nitrite transporter] [OR:*Staphylococcus carnosus*]
[DB:genpept-bct2] [DE:*Staphylococcus carnosus* nir and nar operons, complete
sequences.] [LE:226] [RE:1056] [DI:direct]

| ORF Name | NT ID | AA ID | NT LN | AA LN | Score | P-Value |
|---|---|---|---|---|---|---|
| AI7503000985__1230437__c1__1528 | 822 | 4594 | 408 | 135 | 202 | 2.9e−16 |

Description
sp:[LN:YWBH_BACSU] [AC:P39591] [GN:YWBH:IPA-23R] [OR:*BACILLUS SUBTILIS*]
[DE:HYPOTHETICAL 14.3 KD PROTEIN IN EPR-GALK INTERGENIC REGION] [SP:P39591]
[DB:swissprot] >pir:[LN:S39678] [AC:S39678:F70051] [PN:ywbH
protein:hypothetical protein ipa-23r] [GN:ywbH] [CL:conserved hypothetical
protein HI1297] [OR:*Bacillus subtilis*] [DB:pir2] >gp:[GI:g413947]
[LN:BSGENR] [AC:X73124] [GN:ipa-23r] [OR:*Bacillus subtilis*]
[DB:genpept-bct1] [DE:*B. subtilis* genomic region (325 to 333).] [SP:P39591]

-continued

[LE:23968] [RE:24354] [DI:complement] >gp:[GI:e1186331:g2636367]
[LN:BSUB0020] [AC:Z99123:AL009126] [GN:ywbH] [FN:unknown] [OR:*Bacillus subtilis*] [DB:genpept-bct1] [DE:*Bacillus subtilis* complete genome (section 20 of 21):from 3798401 to 4010550.] [NT:alternate gene name:ipa-23r]
[SP:P39591] [LE:133605] [RE:133991] [DI:direct]

| ORF Name | NT ID | AA ID | NT LN | AA LN | Score | P-Value |
|---|---|---|---|---|---|---|
| AI7503000985_12600305_f1_260 | 823 | 4595 | 285 | 94 | | |

Description
NO-HIT

| ORF Name | NT ID | AA ID | NT LN | AA LN | Score | P-Value |
|---|---|---|---|---|---|---|
| AI7503000985_12690706_c3_2230 | 824 | 4596 | 231 | 76 | | |

Description
NO-HIT

| ORF Name | NT ID | AA ID | NT LN | AA LN | Score | P-Value |
|---|---|---|---|---|---|---|
| AI7503000985_12697136_f2_862 | 825 | 4597 | 873 | 290 | 1519 | 8.1e−156 |

Description
pir:[LN:S77609] [AC:S77609] [PN:probable intercellular adhesion protein B precursor:icaB protein] [GN:icaB] [OR:*Staphylococcus epidermidis*] [DB:pir2]
>gp:[GI:g1161381] [LN:SEU43366] [AC:U43366] [PN:IcaB] [GN:icaB]
[OR:*Staphylococcus epidermidis*] [DB:genpept-bct2] [DE:*Staphylococcus epidermidis* operon mediating intercellular adhesion:IcaR, IcaA, IcaD, IcaB, and IcaC genes, complete cds.] [LE:2265] [RE:3134] [DI:direct]

| ORF Name | NT ID | AA ID | NT LN | AA LN | Score | P-Value |
|---|---|---|---|---|---|---|
| AI7503000985_12698410_f3_1111 | 826 | 4598 | 150 | 49 | | |

Description
NO-HIT

| ORF Name | NT ID | AA ID | NT LN | AA LN | Score | P-Value |
|---|---|---|---|---|---|---|
| AI7503000985_127002_f1_259 | 827 | 4599 | 162 | 53 | | |

Description
NO-HIT

| ORF Name | NT ID | AA ID | NT LN | AA LN | Score | P-Value |
|---|---|---|---|---|---|---|
| AI7503000985_1281627_c3_2201 | 828 | 4600 | 1293 | 430 | 1106 | 4.7e−112 |

Description
pir:[LN:B69876] [AC:B69876] [PN:acetylornithine deacetylase homolog ylmB] [GN:ylmB] [OR:*Bacillus subtilis*] [DB:pir2] >gp:[GI:e1185127:g2633908]
[LN:BSUB0009] [AC:Z99112:AL009126] [GN:ylmB] [FN:unknown] [OR:*Bacillus subtilis*] [DB:genpept-bct1] [DE:*Bacillus subtilis* complete genome (section 9 of 21):from 1598421 to 1807200.] [NT:similar to acetylornithine deacetylase]
[LE:8531] [RE:9811] [DI:direct]

| ORF Name | NT ID | AA ID | NT LN | AA LN | Score | P-Value |
|---|---|---|---|---|---|---|
| AI7503000985_129678_f1_53 | 829 | 4601 | 1416 | 471 | 1269 | 2.5e−129 |

Description
sp:[LN:YDGF_BACSU] [AC:P96704] [GN:YDGF] [OR:*BACILLUS SUBTILIS*]
[DE:HYPOTHETICAL TRANSPORT PROTEIN IN EXPZ-DINB INTERGENIC REGION]
[SP:P96704] [DB:swissprot] >pir:[LN:H69782] [AC:H69782] [PN:amino acid ABC transporter (permease) homolog ydgF] [GN:ydgF] [CL:arginine permease]
[OR:*Bacillus subtilis*] [DB:pir2] >gp:[GI:d1020148:g1881368] [LN:AB001488]
[AC:AB001488] [GN:ydgF] [OR:*Bacillus subtilis*] [SR:*Bacillus subtilis* (strain:168) DNA] [DB:genpept-bct1] [DE:*Bacillus subtilis* genome sequence, 148 kb sequence of the region between 35 and 47 degree.] [NT:PROBABLE AMINO ACID TRANSPORT PERMIASE.] [LE:139917] [RE:141293] [DI:complement]
>gp:[GI:e1182528:g2632862] [LN:BSUB0003] [AC:Z99106:AL009126] [GN:ydgF]
[FN:unknown] [OR:*Bacillus subtilis*] [DB:genpept-bct1] [DE:*Bacillus subtilis* complete genome (section 3 of 21):from 402751 to 611850.] [NT:similar to amino acid ABC transporter (permease)] [SP:P96704] [LE:203663] [RE:205039]
[DI:complement] >gp:[GI:e1182541:g2632875] [LN:BSUB0004]
[AC:Z99107:AL009126] [GN:ydgF] [FN:unknown] [OR:*Bacillus subtilis*]
[DB:genpept-bct1] [DE:*Bacillus subtilis* complete genome (section 4 of 21):

from 600701 to 813890.] [NT:similar to amino acid ABC transporter (permease)]
[SP:P96704] [LE:5713] [RE:7089] [DI:complement]

| ORF Name | NT ID | AA ID | NT LN | AA LN | Score | P-Value |
|---|---|---|---|---|---|---|
| AI7503000985__1298202__f2__822 | 830 | 4602 | 1986 | 661 | 1779 | 2.3e−183 |

Description
pir:[LN:G69848] [AC:G69848] PN:fructose phosphotransferase system enzyme
homolog yjdD] [GN:yjdD] [OR:*Bacillus subtilis*] [DB:pir2]
>gp:[GI:e1183221:g2633555] [LN:BSUB0007] [AC:Z99110:AL009126] [GN:yjdD]
[FN:unknown] [OR:*Bacillus subtilis*] [DB:genpept-bct1] [DE:*Bacillus subtilis*
complete genome (section 7 of 21):from 1194391 to 1411140.] [NT:similar to
fructose phosphotransferase system] [LE:77806] [RE:79575] [DI:direct]

| ORF Name | NT ID | AA ID | NT LN | AA LN | Score | P-Value |
|---|---|---|---|---|---|---|
| AI7503000985__13089052__c3__2246 | 831 | 4603 | 126 | 41 | | |

Description
NO-HIT

| ORF Name | NT ID | AA ID | NT LN | AA LN | Score | P-Value |
|---|---|---|---|---|---|---|
| AI7503000985__1350051__c3__2086 | 832 | 4604 | 915 | 304 | 1245 | 8.7e−127 |

Description
gp:[GI:g4574118] [LN:AF009415] [AC:AF009415] [PN:choline transporter]
[GN:cudT] [OR:*Staphylococcus xylosus*] [DB:genpept-bct2] [DE:*Staphylococcus
xylosus* choline transporter (cudT), putative regulatory protein (cudC),
glycine betaine aldehyde dehydrogenase (cudA), and choline dehydrogenase
(cudB) genes, complete cds.] [NT:CudT] [LE:811] [RE:2433] [DI:direct]

| ORF Name | NT ID | AA ID | NT LN | AA LN | Score | P-Value |
|---|---|---|---|---|---|---|
| AI7503000985__1351687__c1__1515 | 833 | 4605 | 906 | 301 | 739 | 3.6e−73 |

Description
gp:[GI:g1644433] [LN:SAU31175] [AC:U31175] [PN:D-specific D-2-hydroxyacid
dehydrogenase] [GN:ddh] [OR:*Staphylococcus aureus*] [DB:genpept-bct1]
[DE:*Staphylococcus aureus* D-specific D-2-hydroxyacid dehydrogenase (ddh)
gene, complete cds.] [NT:36.7 kDa protein; similar to NAD+-linked D-LDH,]
[LE:259] [RE:1251] [DI:direct]

| ORF Name | NT ID | AA ID | NT LN | AA LN | Score | P-Value |
|---|---|---|---|---|---|---|
| AI7503000985__1359635__f3__1248 | 834 | 4606 | 471 | 156 | 297 | 2.5e−26 |

Description
pir:[LN:F69870] [AC:F69870] [PN:general stress protein homolog ykzA]
[GN:ykzA] [CL:hypothetical protein yklA] [OR:*Bacillus subtilis*] [DB:pir2]
>gp:[GI:e1181516:g2632036] [LN:BSAJ2571] [AC:AJ002571] [PN:YknA] [GN:yknA]
[FN:unknown] [OR:*Bacillus subtilis*] [DB:genpept-bct1] [DE:*Bacillus subtilis*
168 kb DNA fragment between xlyA and ykoR.] [NT:homologous to OsmC from
*Escherichia coli*] [LE:34145] [RE:34555] [DI:direct]
>gp:[GI:e1183336:g2633670] [LN:BSUB0007] [AC:Z99110:AL009126] [GN:ykzA]
[FN:unknown] [OR:*Bacillus subtilis*] [DB:genpept-bct1] [DE:*Bacillus subtilis*
complete genome (section 7 of 21):from 1194391 to 1411140.] [NT:alternate
gene name:yzzE; similar to general] [LE:187094] [RE:187504] [DI:direct]

| ORF Name | NT ID | AA ID | NT LN | AA LN | Score | P-Value |
|---|---|---|---|---|---|---|
| AI7503000985__1366012__f1__356 | 835 | 4607 | 213 | 70 | 81 | 0.014 |

Description
sp:[LN:PF2R_HUMAN] [AC:P43088] [GN:PTGFR] [OR:*HOMO SAPIENS*] [SR:,HUMAN]
[DE:RECEPTOR] (PGF2 ALPHA RECEPTOR)] [SP:P43088] [DB:swissprot]
>pir:[LN:A49973] [AC:A49973] [PN:prostanoid FP receptor] [GN:PTGFR:FP]
[CL:prostaglandin E receptor EP1] [OR:*Homo sapiens*] [SR:, man] [DB:pir2]
[MP:1p31.1-1p31.1]

| ORF Name | NT ID | AA ID | NT LN | AA LN | Score | P-Value |
|---|---|---|---|---|---|---|
| AI7503000985__13678300__f1__40 | 836 | 4608 | 165 | 54 | | |

Description
NO-HIT

-continued

| ORF Name | NT ID | AA ID | NT LN | AA LN | Score | P-Value |
|---|---|---|---|---|---|---|
| AI7503000985__13711588__f2__551 | 837 | 4609 | 285 | 94 | 81 | 0.0019 |

Description
pir:[LN:S53365] [AC:S53365] [PN:mucin 5AC (clone CEL2)] [GN:MUC5AC]
[OR:*Homo sapiens*] [SR:, man] [DB:pir2] [MP:11p15.5-11p15.5]

| ORF Name | NT ID | AA ID | NT LN | AA LN | Score | P-Value |
|---|---|---|---|---|---|---|
| AI7503000985__1376926__c3__2008 | 838 | 4610 | 849 | 282 | 438 | 2.9e−41 |

Description
gp:[GI:g3127079] [LN:AF061070] [AC:AF061070] [PN:PtxC] [GN:ptxC]
[OR:*Pseudomonas stutzeri*] [DB:genpept-bct2] [DE:*Pseudomonas stutzeri* Orf117
(orf117), Orf86 (orf86) genes, complete cds; and ptXABCDE operon, partial
sequence.] [NT:putative inner membrane component of] [LE:3217] [RE:4044]
[DI:direct]

| ORF Name | NT ID | AA ID | NT LN | AA LN | Score | P-Value |
|---|---|---|---|---|---|---|
| AI7503000985__13796876__f2__710 | 839 | 4611 | 180 | 59 | | |

Description
NO-HIT

| ORF Name | NT ID | AA ID | NT LN | AA LN | Score | P-Value |
|---|---|---|---|---|---|---|
| AI7503000985__13835462__c3__2043 | 840 | 4612 | 1449 | 482 | 1386 | 1.0e−141 |

Description
gp:[GI:e1299584:g3687418] [LN:BLY17554] [AC:Y17554] [PN:permease] [GN:arcD]
[OR:*Bacillus licheniformis*] [DB:genpept-bct1] [DE:*Bacillus licheniformis*
arcA, arcB, arcC and arcD genes.] [LE:2579] [RE:3985] [DI:direct]

| ORF Name | NT ID | AA ID | NT LN | AA LN | Score | P-Value |
|---|---|---|---|---|---|---|
| AI7503000985__13843910__c1__1637 | 841 | 4613 | 216 | 71 | 258 | 3.9e−22 |

Description
gp:[GI:e1429613:g4756156] [LN:A67169] [AC:A67169] [PN:NART GENE] [FN:NITRATE
TRANSPORT] [OR:*Staphylococcus carnosus*] [DB:genpept-pat] [DE:Sequence 9 from
Patent EP0805205.] [LE:538] [RE:1704] [DI:direct] >gp:[GI:g2529402]
[LN:SCU40014] [AC:U40014] [PN:nitrate transporter] [GN:narT]
[OR:*Staphylococcus carnosus*] [SR:*Staphylococcus carnosus* strain = TM300]
[DB:genpept-bct2] [DE:*Staphylococcus carnosus* nitrate transporter (narT)
gene, complete cds.] [NT:NarT] [LE:90] [RE:1256] [DI:direct]

| ORF Name | NT ID | AA ID | NT LN | AA LN | Score | P-Value |
|---|---|---|---|---|---|---|
| AI7503000985__13866433__f2__661 | 842 | 4614 | 138 | 45 | | |

Description
NO-HIT

| ORF Name | NT ID | AA ID | NT LN | AA LN | Score | P-Value |
|---|---|---|---|---|---|---|
| AI7503000985__13869827__f3__1087 | 843 | 4615 | 2385 | 794 | 2176 | 1.9e−225 |

Description
pir:[LN:E70041] [AC:E70041] [PN:probable copper-transporting ATPase, yvgX]
[GN:yvgX] [CL:*Bacillus* probable copper-transporting ATPase:yvgX:ATPase
nucleotide-binding domain homology:ATPase transduction domain
homology:heavy-metal-associated homology] [OR:*Bacillus subtilis*]
[EC:3.6.1.—] [DB:pir1] >gp:[GI:e1186038:g2635863] [LN:BSUB0018]
[AC:Z99121:AL009126] [GN:yvgX] [FN:unknown] [OR:*Bacillus subtilis*]
[DB:genpept-bct1] [DE:*Bacillus subtilis* complete genome (section 18 of 21):
from 3399551 to 3609060.] [NT:similar to heavy metal-transporting ATPase]
[LE:40633] [RE:43044] [DI:complement]

| ORF Name | NT ID | AA ID | NT LN | AA LN | Score | P-Value |
|---|---|---|---|---|---|---|
| AI7503000985__13955288__f1__5 | 844 | 4616 | 165 | 54 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000985__14113806_f2__559 | 845 | 4617 | 126 | 41 | | |

Description
NO-HIT

| ORF Name | NT ID | AA ID | NT LN | AA LN | Score | P-Value |
|---|---|---|---|---|---|---|
| AI7503000985__14222942_f2__747 | 846 | 4618 | 138 | 45 | | |

Description
NO-HIT

| ORF Name | NT ID | AA ID | NT LN | AA LN | Score | P-Value |
|---|---|---|---|---|---|---|
| AI7503000985__1440890_f1__362 | 847 | 4619 | 339 | 112 | | |

Description
NO-HIT

| ORF Name | NT ID | AA ID | NT LN | AA LN | Score | P-Value |
|---|---|---|---|---|---|---|
| AI7503000985__14454393_c3__2148 | 848 | 4620 | 144 | 47 | | |

Description
NO-HIT

| ORF Name | NT ID | AA ID | NT LN | AA LN | Score | P-Value |
|---|---|---|---|---|---|---|
| AI7503000985__14460882_c1__1400 | 849 | 4621 | 177 | 58 | 198 | 7.8e−16 |

Description
gp:[GI:g1022726] [LN:SHU35635] [AC:U35635] [PN:unknown] [OR:*Staphylococcus haemolyticus*] [SR:*Staphylococcus haemolyticus* strain = Y17G] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000985__14460882_c3__1975 | 850 | 4622 | 177 | 58 | 242 | 1.7e−20 |

Description
gp:[GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000985__14460882_c3__2098 | 851 | 4623 | 210 | 69 | 264 | 7.9e−23 |

Description
gp:[GI:g1022726] [LN:SHU35635] [AC:U35635] [PN:unknown] [OR:*Staphylococcus haemolyticus*] [SR:*Staphylococcus haemolyticus* strain = Y176] [DB genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000985__14460882_c3__2112 | 852 | 4624 | 177 | 58 | 226 | 8.4e−19 |

Description
gp:[GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000985__14460932_f1__34 | 853 | 4625 | 177 | 58 | 208 | 6.8e−17 |

Description
gp:[GI:g1022726] [LN:SHU35635] [AC:U356353 [PN:unknown] [OR:*Staphylococcus haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

-continued

| ORF Name | NT ID | AA ID | NT LN | AA LN | Score | P-Value |
|---|---|---|---|---|---|---|
| AI7503000985__14460932__f2__467 | 854 | 4626 | 177 | 58 | 196 | 1.3e−15 |

Description
gp:[GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000985__14460932__f3__1045 | 855 | 4627 | 177 | 58 | 218 | 5.9e−18 |

Description
gp:[GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000985__14480312__c1__1349 | 856 | 4628 | 1308 | 435 | 588 | 3.6e−57 |

Description
pir:[LN:F69581] [AC:F69581] [PN:acetoin dehydrogenase E2 component (dihydrolipoamide acetyltra) acoC] [GN:acoC] [CL:dihydrolipoamide acetyltransferase:lipoyl/biotin-binding homology] [OR:*Bacillus subtilis*] [DB:pir2] >gp:[GI:e1182798:g2633132] [LN:BSUB0005] [AC:Z99108:AL009126] [PN:acetoin dehydrogenase E2 component] [GN:acoC] [OR:*Bacillus subtilis*] [DB:genpept-bct1] [DE:*Bacillus subtilis* complete genome (section 5 of 21): from 802821 to 1011250.] [NT:alternate gene name:yfjI] [LE:77735] [RE:78931] [DI:direct] >gp:[GI:d1025206:g2780393] [LN:D78509] [AC:D78509] [PN:YfjI] [OR:*Bacillus subtilis*] [SR:*Bacillus subtilis* (strain:AC327) DNA] [DB:genpept-bct1] [DE:*Bacillus subtilis* YfjG-YfjR genes, complete cds.] [LE:7394] [RE:8590] [DI:complement]

| ORF Name | NT ID | AA ID | NT LN | AA LN | Score | P-Value |
|---|---|---|---|---|---|---|
| AI7503000985__14490756__f1__295 | 857 | 4629 | 177 | 58 | | |

Description
NO-HIT

| ORF Name | NT ID | AA ID | NT LN | AA LN | Score | P-Value |
|---|---|---|---|---|---|---|
| AI7503000985__14492125__f3__1310 | 858 | 4630 | 141 | 46 | | |

Description
NO-HIT

| ORF Name | NT ID | AA ID | NT LN | AA LN | Score | P-Value |
|---|---|---|---|---|---|---|
| AI7503000985__14495712__c1__1593 | 859 | 4631 | 297 | 98 | 109 | 5.0e−06 |

Description
gp:[GI:g4894301] [LN:AF065404] [AC:AF065404] [PN:pXO1-85] [OR:*Bacillus anthracis*] [DB:genpept-bct2] [DE:*Bacillus anthracis* virulence plasmid PX01, complete sequence.] [LE:99636] [RE:100319] [DI:direct]

| ORF Name | NT ID | AA ID | NT LN | AA LN | Score | P-Value |
|---|---|---|---|---|---|---|
| AI7503000985__14534387__f3__1231 | 860 | 4632 | 225 | 74 | 91 | 0.00017 |

Description
gp:[GI:g1778751] [LN:SLU73444] [AC:U73444] [PN:SLUSH A] [GN:slushA] [FN:mediates haemolytic activity] [OR:*Staphylococcus lugdunensis*] [DB:genpept-bct1] [DE:*Staphylococcus lugdunensis* SLUSH A (SlushA), SLUSH B (slushB), and hemolysin (slushC) genes, complete cds.] [LE:570] [RE:701] [DI:direct]

| ORF Name | NT ID | AA ID | NT LN | AA LN | Score | P-Value |
|---|---|---|---|---|---|---|
| AI7503000985__14552215__c3__2231 | 861 | 4633 | 192 | 63 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000985__14562760__f1__359 | 862 | 4634 | 141 | 46 | | |

| Description | | | | | | |
|---|---|---|---|---|---|---|
| NO-HIT | | | | | | |
| ORF Name | NT ID | AA ID | NT LN | AA LN | Score | P-Value |
| AI7503000985__14565637__f2__883 | 863 | 4635 | 132 | 43 | | |

| Description | | | | | | |
|---|---|---|---|---|---|---|
| NO-HIT | | | | | | |
| ORF Name | NT ID | AA ID | NT LN | AA LN | Score | P-Value |
| AI7503000985__14626432__c2__1687 | 864 | 4636 | 2421 | 806 | 1387 | 7.8e−142 |

Description
sp:[LN:SECA_STAAU] [AC:O06446] [GN:SECA] [OR:*STAPHYLOCOCCUS AUREUS*]
[DE:PREPROTEIN TRANSLOCASE SECA SUBUNIT] [SP:O06446] [DB:swissprot]
>gp:[GI:g2078390] [LN:SAU97062] [AC:U97062] [PN:SecA] [GN:secA]
[FN:secretion] [OR:*Staphylococcus aureus*] [DB:genpept-bct1]
[DE:*Staphylococcus aureus* NCTC 8325 SecA (secA) gene, complete cds.]
[LE:440] [RE:2971] [DI:direct]

| ORF Name | NT ID | AA ID | NT LN | AA LN | Score | P-Value |
|---|---|---|---|---|---|---|
| AI7503000985__14644037__c3__2056 | 865 | 4637 | 1575 | 524 | 401 | 2.8d−40 |

Description
sp:[LN:YBJT_ECOLI] [AC:P75822] [GN:YBJT] [OR:*ESCHERICHIA COLI*]
[DE:HYPOTHETICAL 53.7 KD PROTEIN IN ARTP-POXB INTERGENIC REGION] [SP:P75822]
[DB:swissprot]

| ORF Name | NT ID | AA ID | NT LN | AA LN | Score | P-Value |
|---|---|---|---|---|---|---|
| AI7503000985__14650312__c3__2045 | 866 | 4638 | 1170 | 389 | 319 | 1.2e−28 |

Description
gp:[GI:e1423961:g4584121] [LN:BCE7788] [AC:AJ007788] [GN:capA] [OR:*Bacillus
cereus*] [DB:genpept-bct1] [DE:*Bacillus cereus* ilvD, ilvA, capA genes, orf4,
orf5 and orf6, partial.] [NT:related sequence M24150] [LE:2729] [RE:3832]
[DI:complement]

| ORF Name | NT ID | AA ID | NT LN | AA LN | Score | P-Value |
|---|---|---|---|---|---|---|
| AI7503000985__14662577__c3__1984 | 867 | 4639 | 537 | 178 | | |

| Description | | | | | | |
|---|---|---|---|---|---|---|
| NO-HIT | | | | | | |
| ORF Name | NT ID | AA ID | NT LN | AA LN | Score | P-Value |
| AI7503000985__14720378__c3__2022 | 868 | 4640 | 726 | 241 | 292 | 8.5e−26 |

Description
pir:[LN:D70380] [AC:D70380] [PN:hypothetical protein aq_928] [GN:aq_928]
[OR:*Aquifex aeolicus*] [DB:pir2] >gp:[GI:g2983456] [LN:AE000714]
[AC:AE000714:AE000657] [PN:putative protein] [GN:aq_928] [OR:*Aquifex
aeolicus*] [DB:genpept-bct2] [DE:*Aquifex aeolicus* section 46 of 109 of the
complete genome.] [LE:6398] [RE:6988] [DI:direct]

| ORF Name | NT ID | AA ID | NT LN | AA LN | Score | P-Value |
|---|---|---|---|---|---|---|
| AI7503000985__14725887__f3__1312 | 869 | 4641 | 183 | 60 | | |

| Description | | | | | | |
|---|---|---|---|---|---|---|
| NO-HIT | | | | | | |
| ORF Name | NT ID | AA ID | NT LN | AA LN | Score | P-Value |
| AI7503000985__14729702__c2__1699 | 870 | 4642 | 2031 | 676 | 288 | 7.6e−22 |

Description
gp:[GI:g4322670] [LN:AF094508] [AC:AF094508] [PN:dentin phosphoryn] [OR:*Homo*

-continued

*sapiens*] [SR:human] [DB:genpept-pri4] [DE:*Homo sapiens* dentin phosphoryn mRNA, complete cds.] [LE:<1] [RE:2367] [DI:direct]

| ORF Name | NT ID | AA ID | NT LN | AA LN | Score | P-Value |
|---|---|---|---|---|---|---|
| AI7503000985_14742887_c2_1735 | 871 | 4643 | 606 | 201 | | |

Description
NO-HIT

| ORF Name | NT ID | AA ID | NT LN | AA LN | Score | P-Value |
|---|---|---|---|---|---|---|
| AI7503000985_14742937_c1_1449 | 872 | 4644 | 1203 | 400 | 94 | 0.0033 |

Description
gp:[GI:g2935567] [LN:AF049856] [AC:AF049856] [PN:M protein] [GN:emm] [OR:*Streptococcus pyogenes*] [DB:genpept-bct2] [DE:*Streptococcus pyogenes* strain SS1457 M protein (emm) gene, partial cds.] [LE:<1] [RE:>403] [DI:direct]

| ORF Name | NT ID | AA ID | NT LN | AA LN | Score | P-Value |
|---|---|---|---|---|---|---|
| AI7503000985_14843762_f3_1171 | 873 | 4645 | 141 | 46 | | |

Description
NO-HIT

| ORF Name | NT ID | AA ID | NT LN | AA LN | Score | P-Value |
|---|---|---|---|---|---|---|
| AI7503000985_14851551_f1_417 | 874 | 4646 | 993 | 330 | 1143 | 5.6e−116 |

Description
gp:[GI:g2565150] [LN:LLU92974] [AC:U92974:M90760:M90761] [PN:unknown] [OR:*Lactococcus lactis*] [DB:genpept-bct1] [DE:*Lactococcus lactis* unknown gene, partial cds, and HisC (hisC), unknown, HisG (hisG), unknown, HisB (hisB), unknown, HisH (hish), HisA (hisA), HisF (hisF), HisIE (hisIE), unknown, unknown, LeuA (leuA), LeuB (leuB), LeuC (leuC), LeuD (leuD), unknown, IlvD (ilvD), IlvB (ilvB), IlvN, IlvC (ilvC), IlvA (ilvA), AldB (aldB) and aldR (aldR) genes, complete cds.] [NT:ORF14] [LE:10850] [RE:11809] [DI:complement]

| ORF Name | NT ID | AA ID | NT LN | AA LN | Score | P-Value |
|---|---|---|---|---|---|---|
| AI7503000985_14851713_c2_1650 | 875 | 4647 | 966 | 321 | 941 | 1.4e−94 |

Description
pir:[LN:D69581] [AC:D69581] [PN:acetoin dehydrogenase E1 component (TPP-dependent alpha subunit) acoA] [GN:acoA] [CL:pyruvate dehydrogenase (lipoamide) alpha chain:thiamine pyrophosphate-binding domain homology] [OR:*Bacillus subtilis*] [DB:pir2] >gp:[GI:e1182796:g2633130] [LN:BSUB0005] [AC:Z99108:AL009126] [PN:acetoin dehydrogenase E1 component] [GN:acoA] [OR:*Bacillus subtilis*] [DB:genpept-bct1] [DE:*Bacillus subtilis* complete genome (section 5 of 21):from 802821 to 1011250.] [NT:alternate gene name: yfjK] [LE:75688] [RE:76689] [DI:direct] >gp:[GI:d1025208:g2780395] [LN:D78509] [AC:D78509] [PN:YfjK] [OR:*Bacillus subtilis*] [SR:*Bacillus subtilis* (strain:AC327) DNA] [DB:genpept-bct1] [DE:*Bacillus subtilis* YfjG-YfjR genes, complete cds.] [LE:9636] RE:10637] [DI:complement] >gp:[GI:g2957146] [LN:AF006075] [AC:AF006075] [PN:TPP-dependent acetoin dehydrogenase, E1] [GN:acoA] [OR:*Bacillus subtilis*] [DB:genpept-bct2] [DE:*Bacillus subtilis* acetoin dehydrogenase enzyme system gene cluster, ribosomal protein L6-like protein gene, partial cds, TPP-dependentacetoin dehydrogenase, E1 alpha-subunit (acoA), TPP-dependentacetoin dehydrogenase, E1 beta-subunit (acoB), dihydrolipoamideacetyltransferase (acoC) and dihydrolipoamide dehydrogenase (acoL) genes, complete cds, and regulatory protein (acoR) gene, partial cds.] [NT:alpha subunit of the E1 component of the acetoin] [LE:825] [RE:1826] [DI:direct] >gp:[GI:g2957146] [LN:AF006075] [AC:AF006075] [PN:TPP-dependent acetoin dehydrogenase, E1] [GN:acoA] [OR:*Bacillus subtilis*] [DB:genpept] [DE:*Bacillus subtilis* acetoin dehydrogenase enzyme system gene cluster, ribosomal protein L6-like protein gene, partial cds, TPP-dependentacetoin dehydrogenase, E1 alpha-subunit (acoA), TPP-dependentacetoin dehydrogenase, E1 beta-subunit (acoB), dihydrolipoamideacetyltransferase (acoC) and dihydrolipoamide dehydrogenase (acoL) genes, complete cds, and regulatory protein (acoR) gene, partial cds.] [NT:alpha subunit of the E1 component of the acetoin] [LE:825] [RE:1826] [DI:direct]

| ORF Name | NT ID | AA ID | NT LN | AA LN | Score | P-Value |
|---|---|---|---|---|---|---|

| | | | | | | |
|---|---|---|---|---|---|---|
| AI7503000985__14879667__c2__1781 | 876 | 4648 | 867 | 288 | 735 | 9.7e−73 |

Description
sp:[LN:PANC_BACSU] [AC:P52998] [GN:PANC] [OR:*BACILLUS SUBTILIS*] [EC:6.3.2.1]
[DE:(PANTOATE ACTIVATING ENZYME)] [SP:P52998] [DB:swissprot]
>pir:[LN:H69671] [AC:H69671] [PN:pantothenate synthetase panC] [GN:panC]
[CL:pantoate--beta-alanine ligase] [OR:*Bacillus subtilis*] [DB:pir2]
>gp:[GI:g1146241] [LN:BACYPIA] [AC:L47709] [PN:pantothenate synthetase]
[GN:panC] [FN:pantothenic acid biosynthesis] [OR:*Bacillus subtilis*]
[DB:genpept-bct1] [EC:6.3.2.1] [DE:*Bacillus subtilis* (clone YAC15-6B) ypiABF
genes, qcrABC genes, ypjABCDEFGHI genes, birA gene, panBCD genes, dinG gene,
ypmB gene, aspB gene, asnS gene, dnaD gene, nth gene and ypoC gene,
complete cds's.] [NT:40.8% of identity to the *Escherichia coli*] [LE:14128]
[RE:14988] [DI:direct] >gp:[GI:e1183687:g2634660] [LN:BSUB0012]
[AC:Z99115:AL009126] [PN:pantothenate synthetase] [GN:panC] [FN:pantothenate
biosynthesis] [OR:*Bacillus subtilis*] [DB:genpept-bct1] [EC:6.3.2.1]
[DE:*Bacillus subtilis* complete genome (section 12 of 21):from 2195541 to
2409220.] [SP:P52998] [LE:156679] [RE:157539] DI:complement]

| ORF Name | NT ID | AA ID | NT LN | AA LN | Score | P-Value |
|---|---|---|---|---|---|---|
| AI7503000985__14880051__f1__116 | 877 | 4649 | 1971 | 656 | 2450 | 1.8e−254 |

Description
pir:[LN:C69621] [AC:C69621] [PN:fructose-bisphophatase,] [GN:fbp:yydE]
[CL:*Bacillus subtilis* fructose-bisphosphatase:phosphoesterase core
homology] [OR:*Bacillus subtilis*] [EC:3.1.3.11] [DB:pir1]
>gp:[GI:d1011939:g1064791] [LN:BACGNTZA] [AC:D78193] [GN:yydE] [OR:*Bacillus
subtilis*] [SR:*Bacillus subtilis* (strain:168) DNA] [DB:genpept-bct1]
[DE:*Bacillus subtilis* 36 kb sequence between gntZ and trnY genes encoding 34
ORFs.] [LE:9575] [RE:11590] [DI:direct] >gp:[GI:e1184745:g2636566]
[LN:BSUB0021] [AC:Z99124:AL009126] [PN:fructose-1,6-bisphophatase] [GN:fbp]
[FN:gluconeogenesis] [OR:*Bacillus subtilis*] [DB:genpept-bct1] [EC:3.1.3.11]
[DE:*Bacillus subtilis* complete genome (section 21 of 21):from 3999281 to
4214814.] [NT:alternate gene name:yydE] [LE:127957] [RE:129972] [DI:direct]

| ORF Name | NT ID | AA ID | NT LN | AA LN | Score | P-Value |
|---|---|---|---|---|---|---|
| AI7503000985__14881250__f3__1040 | 878 | 4650 | 999 | 332 | 1407 | 5.9e−144 |

Description
gp:[GI:g1644433] [LN:SAU31175] [AC:U31175] [PN:D-specific D-2-hydroxyacid
dehydrogenase] [GN:ddh] [OR:*Staphylococcus aureus*] [DB:genpept-bct1]
[DE:*Staphylococcus aureus* D-specific D-2-hydroxyacid dehydrogenase (ddh)
gene, complete cds.] [NT:36.7 kDa protein; similar to NAD+-linked D-LDH,]
[LE:259] [RE:1251] [DI:direct]

| ORF Name | NT ID | AA ID | NT LN | AA LN | Score | P-Value |
|---|---|---|---|---|---|---|
| AI7503000985__14881908__c1__1494 | 879 | 4651 | 213 | 70 | 75 | 0.042 |

Description
gp:[GI:g4406247] [LN:AF105113] [AC:AF105113] [PN:putative oligosaccharide
repeat unit] [GN:cps19AJ] [OR:*Streptococcus pneumoniae*] [DB:genpept-bct2]
[DE:*Streptococcus pneumoniae* type 19A putative oligosaccharide repeat unit
transporter (cps19AJ) gene, partial cds; UDP-N-acetylglucosamine-2-epimerase
(cps19AK), glucose-1-phosphate thymidylyltransferase (cps19AL),
dTDP-4-keto-6-deoxyglucose-3,5-epimerase (cps19AM),
dTDP-glucose-4,6-dehydratase (cps19AN), and dTDP-L-rhamnose synthase
(cps19AO) genes, complete cds; and AliA (aliA) gene, partial cds.]
[NT:Cps19AJ] [LE:<1] [RE:818] [DI:direct]

| ORF Name | NT ID | AA ID | NT LN | AA LN | Score | P-Value |
|---|---|---|---|---|---|---|
| AI7503000985__14901578__c3__2235 | 880 | 4652 | 888 | 295 | 598 | 3.2e−58 |

Description
pir:[LN:B69772] [AC:B69772 ] [PN:conserved hypothetical protein ydbO]
[GN:ydbO] [CL:conserved hypothetical protein MJ0449] [OR:*Bacillus subtilis*]
[DB:pir2] >gp:[GI:d1020044:g1881264] [LN:AB001488] [AC:AB001488] [GN:ydbO]
[OR:*Bacillus subtilis*] [SR:*Bacillus subtilis* (strain:168) DNA]
[DB:genpept-bct1] [DE:*Bacillus subtilis* genome sequence, 148 kb sequence of
the region between 35 and 47 degree.] [NT:FUNCTION UNKNOWN, SIMILAR PRODUCT
IN *B. SUBTILIS*] [LE:39929] [RE:40801] [DI:direct] >gp:[GI:e1182420:g2632754]
[LN:BSUB0003] [AC:Z99106:AL009126] [GN:ydbO] [FN:unknown] [OR:*Bacillus
subtilis*] [DB:genpept-bct1] [DE:*Bacillus subtilis* complete genome (section 3
of 21):from 402751 to 611850.] [NT:similar to hypothetical proteins]
[LE:103673] [RE:104545] [DI:direct]

-continued

| ORF Name | NT ID | AA ID | NT LN | AA LN | Score | P-Value |
|---|---|---|---|---|---|---|
| AI7503000985__14931501__c2__1790 | 881 | 4653 | 1062 | 353 | 802 | 7.7e−80 |

Description
pir:[LN:E71373] [AC:E71373] [PN:probable regulatory protein (pfoS/R)]
[GN:TP0038] [OR:*Treponema pallidum* subsp. *pallidum*] [SR:, syphilis
spirochete] [DB:pir2] >gp:[GI:g3322295] [LN:AE001189] [AC:AE001189:AE000520]
[PN:regulatory protein (pfoS/R)] [GN:TP0038] [OR:*Treponema pallidum*]
(DB:genpept-bct2] [DE:*Treponema pallidum* section 5 of 87 of the complete
genome.] [NT:similar to GP:1354775 percent identity:100.00;] [LE:1177]
[RE:2229] [DI:complement]

| ORF Name | NT ID | AA ID | NT LN | AA LN | Score | P-Value |
|---|---|---|---|---|---|---|
| AI7503000985__14979713__c1__1590 | 882 | 4654 | 483 | 160 | 251 | 1.9e−21 |

Description
sp:[LN:YORZ__LISMO] AC:P33385] [OR:*LISTERIA MONOCYTOGENES*] [DE:REGION
(ORFZ)] [SP:P33385] [DB:swissprot] >pir:[LN:F43868] [AC:F43868] [PN:ORFZ]
[OR:*Listeria monocytogenes*] [DB:pir2] >gp:[GI:g149647] [LN:LISACTLDH]
[AC:M82881] [OR:*Listeria monocytogenes*] [SR:*Listeria monocytogenes* (strain
L028) DNA] [DB:genpept-bct1] [DE:*Listeria monocytogenes* lecithinase, lactate
dehydrogenase (actA) gene complete cds, (plcB) gene complete cds, (ldh) gene
complete cds.] [NT:ORFZ] [LE:3582] [RE:4043] [DI:direct]

| ORF Name | NT ID | AA ID | NT LN | AA LN | Score | P-Value |
|---|---|---|---|---|---|---|
| AI7503000985__15052187__f3__1188 | 883 | 4655 | 123 | 40 | | |

Description
NO-HIT

| ORF Name | NT ID | AA ID | NT LN | AA LN | Score | P-Value |
|---|---|---|---|---|---|---|
| AI7503000985__15052188__f2__697 | 884 | 4656 | 141 | 46 | | |

Description
NO-HIT

| ORF Name | NT ID | AA ID | NT LN | AA LN | Score | P-Value |
|---|---|---|---|---|---|---|
| AI7503000985__15126592__f3__1294 | 885 | 4657 | 1086 | 361 | 1831 | 7.0e−189 |

Description
pir:[LN:S77610] [AC:S77610] [PN:probable intercellular adhesion protein
C:icaC protein] [GN:icaC] [OR:*Staphylococcus epidermidis*] [DB:pir2]
>gp:[GI:g1161382] [LN:SEU43366] [AC:U43366] [PN:IcaC] [GN:icaC]
[OR:*Staphylococcus epidermidis*] [DB:genpept-bct2] [DE:*Staphylococcus
epidermidis* operon mediating intercellular adhesion:IcaR, IcaA, IcaD, IcaB,
and IcaC genes, complete cds.] [LE:3121] [RE:4188] [DI:direct]

| ORF Name | NT ID | AA ID | NT LN | AA LN | Score | P-Value |
|---|---|---|---|---|---|---|
| AI7503000985__1537__c1__1639 | 886 | 4658 | 153 | 50 | 89 | 0.00073 |

Description
sp:[LN:YDGI__BACSU] [AC:P96707] [GN:YDGI] [OR:*BACILLUS SUBTILIS*] [EC:1.—.—.—]
[DE:PUTATIVE NAD(P)H NITROREDUCTASE YDGI,] [SP:P96707] [DB:swissprot]
>pir:[LN:C69783] [AC:C69783] [PN:NADH dehydrogenase homolog ydgI] [GN:ydgI]
[CL:nitroreductase] [OR:*Bacillus subtilis*] [DB:pir2]
>gp:[GI:d1020152:g1881372] [LN:AB001488] [AC:AB001488] [GN:ydgI]
[OR:*Bacillus subtilis*] [SR:*Bacillus subtilis* (strain:168) DNA]
[DB:genpept-bct1] [DE:*Bacillus subtilis* genome sequence, 148 kb sequence of
the region between 35 and 47 degree.] [NT:SIMILAR TO NITROREDUCTASE.]
[LE:145410] [RE:146039] [DI:complement] >gp:[GI:e1182545:g2632879]
[LN:BSUB0004] [AC:Z99107:AL009126] [GN:ydgI] [FN:unknown] [OR:*Bacillus
subtilis*] [DB:genpept-bct1] [DE:*Bacillus subtilis* complete genome (section 4
of 21):from 600701 to 813890.] [NT:similar to NADH dehydrogenase]
[SP:P96707] [LE:11206] [RE:11835] [DI:complement]

| ORF Name | NT ID | AA ID | NT LN | AA LN | Score | P-Value |
|---|---|---|---|---|---|---|
| AI7503000985__156387__c1__1367 | 887 | 4659 | 138 | 45 | | |

Description
NO-HIT

-continued

| ORF Name | NT ID | AA ID | NT LN | AA LN | Score | P-Value |
|---|---|---|---|---|---|---|
| AI7503000985__15671925__c3__2051 | 888 | 4660 | 138 | 45 | | |

Description
NO-HIT

| ORF Name | NT ID | AA ID | NT LN | AA LN | Score | P-Value |
|---|---|---|---|---|---|---|
| AI7503000985__157093__c2__1947 | 889 | 4661 | 147 | 48 | | |

Description
NO-HIT

| ORF Name | NT ID | AA ID | NT LN | AA LN | Score | P-Value |
|---|---|---|---|---|---|---|
| AI7503000985__15711457__f3__919 | 890 | 4662 | 201 | 66 | | |

Description
NO-HIT

| ORF Name | NT ID | AA ID | NT LN | AA LN | Score | P-Value |
|---|---|---|---|---|---|---|
| AI7503000985__157513__c3__2168 | 891 | 4663 | 156 | 51 | | |

Description
NO-HIT

| ORF Name | NT ID | AA ID | NT LN | AA LN | Score | P-Value |
|---|---|---|---|---|---|---|
| AI7503000985__15752187__f2__664 | 892 | 4664 | 162 | 53 | | |

Description
NO-HIT

| ORF Name | NT ID | AA ID | NT LN | AA LN | Score | P-Value |
|---|---|---|---|---|---|---|
| AI7503000985__157807__c1__1613 | 893 | 4665 | 1584 | 527 | 1780 | 1.8e−183 |

Description
gp:[GI:e316580:g2791907] [LN:SSK11MECA] [AC:Y13094] [GN:CTORF585]
[OR:*Staphylococcus sciuri*] [DB:genpept-bct1] [DE:*S. sciuri* mecA gene, strain
K11 (792).] [LE:<1] [RE:1757] [DI:complement]

| ORF Name | NT ID | AA ID | NT LN | AA LN | Score | P-Value |
|---|---|---|---|---|---|---|
| AI7503000985__15814001__f1__269 | 894 | 4666 | 153 | 50 | | |

Description
NO-HIT

| ORF Name | NT ID | AA ID | NT LN | AA LN | Score | P-Value |
|---|---|---|---|---|---|---|
| AI7503000985__158411__c3__2104 | 895 | 4667 | 993 | 330 | 870 | 4.8e−87 |

Description
sp:[LN:LDH_BACSU] [AC:P13714] [GN:LDH:LCTE] [OR:*BACILLUS SUBTILIS*]
[EC:1.1.1.27] [DE:L-LACTATE DEHYDROGENASE,] [SP:P13714] [DB:swissprot]

| ORF Name | NT ID | AA ID | NT LN | AA LN | Score | P-Value |
|---|---|---|---|---|---|---|
| AI7503000985__15894527__f3__1275 | 896 | 4668 | 267 | 88 | | |

Description
NO-HIT

| ORF Name | NT ID | AA ID | NT LN | AA LN | Score | P-Value |
|---|---|---|---|---|---|---|
| AI7503000985__15914762__f1__251 | 897 | 4669 | 579 | 192 | 654 | 3.7e−64 |

Description
gp:[GI:g4574119] [LN:AF009415] [AC:AF009415] [PN:putative regulatory
protein] [GN:cudC] [OR:*Staphylococcus xylosus*] [DB:genpept-bct2]
[DE:*Staphylococcus xylosus* choline transporter (cudT), putative regulatory
protein (cudC), glycine betaine aldehyde dehydrogenase (cudA), and choline
dehydrogenase (cudB) genes, complete cds.] [NT:CudC] [LE:2604] [RE:3164]
[DI:complement]

| ORF Name | NT ID | AA ID | NT LN | AA LN | Score | P-Value |
|---|---|---|---|---|---|---|
| AI7503000985_16048828_c3_2224 | 898 | 4670 | 261 | 86 | | |

Description
NO-HIT

| ORF Name | NT ID | AA ID | NT LN | AA LN | Score | P-Value |
|---|---|---|---|---|---|---|
| AI7503000985_164715_c3_2251 | 899 | 4671 | 951 | 316 | 786 | 3.8e−78 |

Description
gp:[GI:g4433641] [LN:AF029224] [AC:AF029224:AF029225] [PN:SirB] [GN:sirB]
[OR:*Staphylococcus carnosus*] [DB:genpept-bct2] [DE:*Staphylococcus carnosus*
nir and nar operons, complete sequences.] [NT:similar to C-terminus of
*Esherichia coli* CysG.] [LE:5079] [RE:6032] [DI:direct]

| ORF Name | NT ID | AA ID | NT LN | AA LN | Score | P-Value |
|---|---|---|---|---|---|---|
| AI7503000985_16600062_f1_117 | 900 | 4672 | 132 | 43 | | |

Description
NO-HIT

| ORF Name | NT ID | AA ID | NT LN | AA LN | Score | P-Value |
|---|---|---|---|---|---|---|
| AI7503000985_16689067_c1_1368 | 901 | 4673 | 597 | 198 | 470 | 1.2e−44 |

Description
sp:[LN:HIS7_LACLA] [AC:Q02134] [GN:HISB] [OR:*LACTOCOCCUS LACTIS*]
[SR:,SUBSPLACTIS:*STREPTOCOCCUS LACTIS*] [EC:4.2.1.19]
[DE:IMIDAZOLEGLYCEROL-PHOSPHATE DEHYDRATASE, (IGPD)] [SP:Q02134]
[DB:swissprot] >pir:[LN:G45734] [AC:G45734:C36890] [PN:HisB]
[CL:imidazoleglycerol-phosphate dehydratase:imidazoleglycerol-phosphate
dehydratase homology] [OR:*Lactococcus lactis* subsp. *lactis*] [DB:pir2]
>gp:[GI:g2565143] [LN:LLU92974] [AC:U92974:M90760:M90761] [PN:HisB]
[GN:hisB] [OR:*Lactococcus lactis*] [DB:genpept-bct1] [DE:*Lactococcus lactis*
unknown gene, partial cds, and HisC (hisC), unknown, HisG (hisG), unknown,
HisB (hisB), unknown, HisH (hish), HisA (hisA), HisF (hisF), HisIE (hisIE),
unknown, unknown, LeuA (leuA), LeuB (leuB), LeuC (leuC), LeuD (leuD),
unknown, IlvD (ilvD), IlvB (ilvB), IlvN, IlvC (ilvC), IlvA (ilvA), AldB
(aldB) and aldR (aldR) genes, complete cds.] [NT:dehydratase] [LE:5869]
[RE:6471] [DI:direct]

| ORF Name | NT ID | AA ID | NT LN | AA LN | Score | P-Value |
|---|---|---|---|---|---|---|
| AI7503000985_16798125_c2_1862 | 902 | 4674 | 441 | 146 | 154 | 2.6e−10 |

Description
sp:[LN:GUDT_BACSU] [AC:P42237] [GN:YCBE] [OR:*BACILLUS SUBTILIS*] [DE:PROBABLE
GLUCARATE TRANSPORTER] [SP:P42237] [DB:swissprot] >pir:[LN:H69752]
[AC:H69752] [PN:probalble glucarate transporter] [GN:ycbE] [CL:hexuronate
transporter] [OR:*Bacillus subtilis*] [DB:pir2] >gp:[GI:d1007040:g709999]
[LN:BACYCB20] [AC:D30808] [PN:glucarate dehydratase] [GN:ycbE] [OR:*Bacillus
subtilis*] [SR:*Bacillus subtilis* (strain:168TrpC2) DNA] [DB:genpept-bct1]
[DE:*Bacillus subtilis* DNA around 20 degrees region of chromosome containing
yckA-T genes.] [LE:3924] [RE:5291] [DI:direct] >gp:[GI:e1182200:g2632534]
[LN:BSUB0002] [AC:Z99105:AL009126] [GN:ycbE] [FN:unknown] [OR:*Bacillus
subtilis*] [DB:genpept-bct1] [DE:*Bacillus subtilis* complete genome (section 2
of 21):from 194651 to 415810.] [NT:similar to glucarate transporter]
[SP:P42237] [LE:75738] [RE:77105] [DI:direct]

| ORF Name | NT ID | AA ID | NT LN | AA LN | Score | P-Value |
|---|---|---|---|---|---|---|
| AI7503000985_16802312_c3_2228 | 903 | 4675 | 138 | 45 | | |

Description
NO-HIT

| ORF Name | NT ID | AA ID | NT LN | AA LN | Score | P-Value |
|---|---|---|---|---|---|---|
| AI7503000985_16834377_c2_1861 | 904 | 4676 | 147 | 48 | | |

Description
NO-HIT

-continued

| ORF Name | NT ID | AA ID | NT LN | AA LN | Score | P-Value |
|---|---|---|---|---|---|---|
| AI7503000985__16838207__f1__122 | 905 | 4677 | 288 | 95 | 175 | 2.1e−13 |

Description
Sp:[LN:YJDJ_ECOLI] [AC:P39274] [GN:YJDJ] [OR:ESCHERICHIA COLI]
[DE:HYPOTHETICAL 10.5 KD PROTEIN IN DCUB-LYSU INTERGENIC REGION (O90A)]
[SP:P39274] [DB:swissprot] >pir:[LN:S56356] [AC:S56356:F65222]
[PN:hypothetical 10.5K protein (dcub-lysu intergenic region):hypothetical
protein o90a] [GN:yjd] [OR:Escherichia coli] [DB:pir2] >gp:[GI:g536972]
[LN:ECOUW93] [AC:U14003] [OR:Escherichia coli] [DB:genpept-bct1]
[DE:Escherichia coli K-12 chromosomal region from 92.8 to 00.1 minutes.]
[NT:ORF_o90a] [LE:42913] [RE:43185] [DI:direct] >gp:[GI:g1790569]
[LN:AE000485] [AC:AE000485:U00096] [PN:orf, hypothetical protein] [GN:yjdJ]
[FN:orf; Unknown] [OR:Escherichia coli] [DB:genpept-bct2] [DE:Escherichia
coli K-12 MG1655 section 375 of 400 of the complete genome.] [NT:o90a; 100
pct identical amino acid sequence and] [LE:6496] [RE:6768] [DI:direct]

| ORF Name | NT ID | AA ID | NT LN | AA LN | Score | P-Value |
|---|---|---|---|---|---|---|
| AI7503000985__17010952__c3__2147 | 906 | 4678 | 864 | 287 | 639 | 1.4e−62 |

Description
pir:[LN:G70080] [AC:G70080] [PN:conserved hypothetical protein yxkD]
[GN:yxkD] [CL:conserved hypothetical protein yitT] [OR:Bacillus subtilis]
[DB:pir2] >gp:[GI:e1186383:g2636419] [LN:BSUB0020] [AC:Z99123:AL009126]
[GN:yxkD] [FN:unknown] [OR:Bacillus subtilis] [DB:genpept-bct1] [DE:Bacillus
subtilis complete genome (section 20 of 21):from 3798401 to 4010550.]
[NT:similar to hypothetical proteins] [LE:188319] [RE:189155]
[DI:complement] >gp:[GI:d1012387:g1783243] [LN:D83026] [AC:D83026:D45911]
[GN:yxkD] [OR:Bacillus subtilis] [SR:Bacillus subtilis (strain:BGSC 1A1)
DNA] [DB:genpept-bct1] [DE:Bacillus subtilis genome sequence covering
lic-cel region.] [NT:homologous to jojC gene product (B. subtilis;)]
[LE:35310] [RE:36146] [DI:direct]

| ORF Name | NT ID | AA ID | NT LN | AA LN | Score | P-Value |
|---|---|---|---|---|---|---|
| AI7503000985__179010__c3__2136 | 907 | 4679 | 546 | 181 | 344 | 2.6e−31 |

Description
sp:[LN:OGT_HAEIN] [AC:P44687] [GN:OGT:DAT1:HI0402] [OR:HAEMOPHILUS
INFLUENZAE] [EC:2.1.1.63] [DE:ALKYLTRANSFERASE)] [SP:P44687] [DB:swissprot]
>pir:[LN:G64065] [AC:G64065] [PN:methylated-DNA--protein-cysteine
S-methyltransferase homolog] [CL:methylated-DNA--protein-cysteine
S-methyltransferase:methylated-DNA--protein-cysteine S-methyltransferase
homology] [OR:Haemophilus influenzae] [DB:pir2] >gp:[GI:g1573373]
[LN:U32723] [AC:U32723:L42023] [PN:methylated-DNA--protein-cysteine]
[GN:HI0402] [OR:Haemophilus influenzae Rd] [DB:genpept-bct2] [DE:Haemophilus
influenzae Rd section 38 of 163 of the complete genome.] [NT:similar to
SP:P11742 GB:X15659 PID:39876] [LE:9611] [RE:10183] [DI:direct]

| ORF Name | NT ID | AA ID | NT LN | AA LN | Score | P-Value |
|---|---|---|---|---|---|---|
| AI7503000985__181885__c3__2161 | 908 | 4680 | 132 | 43 | | |

Description
NO-HIT

| ORF Name | NT ID | AA ID | NT LN | AA LN | Score | P-Value |
|---|---|---|---|---|---|---|
| AI7503000985__194003__f1__134 | 909 | 4681 | 165 | 54 | 55 | 0.025 |

Description
sp:[LN:RK19_GUITH] [AC:O78409] [GN:RPL19] [OR:GUILLARDIA THETA]
[SR:,CRYPTOMONAS PHI] [DE:CHLOROPLAST 50S RIBOSOMAL PROTEIN L19] [SP:O78409]
[DB:swissprot] >gp:[GI:g3602933] [LN:AF041468]
[AC:AF041468:X14171:X62349:X51511:X14504:X52158:X52912:X56806:M76547]
[PN:ribosomal protein L19] [GN:rpl19] [OR:Chloroplast Guillardia theta]
[SR:Guillardia theta] [DB:genpept-pln2] [DE:Guillardia theta complete
plastid genome.] [LE:181] [RE:573] [DI:complement]

| ORF Name | NT ID | AA ID | NT LN | AA LN | Score | P-Value |
|---|---|---|---|---|---|---|
| AI7503000985__19531436__c3__2069 | 910 | 4682 | 1365 | 454 | 120 | 4.7e−05 |

Description
gp:[GI:g1813493] [LN:BFU64314] [AC:U64314] [PN:hydrophobic protein]
[OR:Bacillus firmus] [DB:genpept-bct1] [DE:Bacillus firmus putative
hydrophobic protein gene, partial cds.] [NT:similar to Bacillus subtilis -continued putative protein] [LE:193] [RE:>795] [DI:direct]

| ORF Name | NT ID | AA ID | NT LN | AA LN | Score | P-Value |
|---|---|---|---|---|---|---|
| AI7503000985_19562805_c3_2135 | 911 | 4683 | 213 | 70 | 69 | 0.036 |

Description
sp:[LN:VNB_INBMF] [AC:P16200] [GN:NB] [OR:INFLUENZA B VIRUS)
[SR:B/MEMPHIS/3/89,] [DE:NB GLYCOPROTEIN] [SP:P16200] [DB:swissprot]
>pir:[LN:A36825] [AC:A36825] [PN:NB glycoprotein] [CL:influenza B virus NB
glycoprotein] [OR:influenza B virus] [DB:pir1] [MP:segment 6]
>gp:[GI:g325221] [LN:FLBNAE] [AC:M30635] [OR:Influenza B virus]
[SR:Influenza B/Memphis/3/89, cDNA to viral RNA] [DB:genpept-vrl]
[DE:Influenza B/Memphis/3/89, neuraminidase and NB (seg 6) RNA, complete
cds.] [NT:NB protein] [LE:16] [RE:315] [DI:direct]

| ORF Name | NT ID | AA ID | NT LN | AA LN | Score | P-Value |
|---|---|---|---|---|---|---|
| AI7503000985_19564702_c3_2073 | 912 | 4684 | 477 | 158 | 397 | 6.3e−37 |

Description
sp:[LN:GSHZ_NICSY] [AC:P30708] [OR:*NICOTIANA SYLVESTRIS*] [SR:,WOOD TOBACCO]
[EC:1.11.1.9] [DE:GLUTATHIONE PEROXIDASE HOMOLOG 6P229,] [SP:P30708]
[DB:swissprot] >pir:[LN:S20501] [AC:S20501] [PN:glutathione peroxidase
homolog] [CL:glutathione peroxidase] [OR:*Nicotiana sylvestris*] [SR:, wood
tobacco] [DB:pir2] >gp:[GI:g19739] [LN:NS6P229] [AC:X60219] [OR:*Nicotiana
sylvestris*] [SR:wood tobacco] [DB:genpept-pln1] [DE:*N. sylvestris* mRNA for
6P229 polypeptide homologous to animal glutathione peroxidases.]
[NT:homologous to animal glutathione peroxidases] [SP:P30708] [LE:154]
[RE:663] [DI:direct]

| ORF Name | NT ID | AA ID | NT LN | AA LN | Score | P-Value |
|---|---|---|---|---|---|---|
| AI7503000985_19585877_c1_1478 | 913 | 4685 | 1212 | 403 | 834 | 3.1e−83 |

Description
pir:[LN:H69817] [AC:H69817] [PN:aminoacylase homolog yhaA] [GN:yhaA]
[CL:hippurate hydrolase] [OR:*Bacillus subtilis*] [DB:pir2]
>gp:[GI:e1183009:g2633343] [LN:BSUB0006] [AC:Z99109:AL009126] [GN:yhaA]
[FN:unknown] [OR:*Bacillus subtilis*] [DB:genpept-bct1] [DE:*Bacillus subtilis*
complete genome (section 6 of 21):from 999501 to 1209940.] [NT:similar to
aminoacylase] [LE:80123] [RE:81313] [DI:complement]

| ORF Name | NT ID | AA ID | NT LN | AA LN | Score | P-Value |
|---|---|---|---|---|---|---|
| AI7503000985_19694050_f3_1299 | 914 | 4686 | 147 | 48 | | |

Description
NO-HIT

| ORF Name | NT ID | AA ID | NT LN | AA LN | Score | P-Value |
|---|---|---|---|---|---|---|
| AI7503000985_197090_c2_1776 | 915 | 4687 | 183 | 60 | | |

Description
NO-HIT

| ORF Name | NT ID | AA ID | NT LN | AA LN | Score | P-Value |
|---|---|---|---|---|---|---|
| AI7503000985_19709637_c1_1576 | 916 | 4688 | 147 | 48 | | |

Description
NO-HIT

| ORF Name | NT ID | AA ID | NT LN | AA LN | Score | P-Value |
|---|---|---|---|---|---|---|
| AI7503000985_19720642_c2_1710 | 917 | 4689 | 1296 | 431 | 525 | 1.7e−50 |

Description
gp:[GI:e1358508:g3980137] [LN:LMO34616] [AC:AJ007319]
[PN:succinyl-diaminopimelate desuccinylase] [GN:dapE] [OR:*Listeria
monocytogenes*] [DB:genpept-bct1] [DE:*Listeria monocytogenes* ascB, inlG,
inlH, inlE, dapE genes.] [LE:5533] [RE:6672] [DI:direct]

| ORF Name | NT ID | AA ID | NT LN | AA LN | Score | P-Value |
|---|---|---|---|---|---|---|
| AI7503000985_197312_c2_1804 | 918 | 4690 | 873 | 290 | 813 | 5.2e−81 |

Description

-continued sp:[LN:YHDF_BACSU] [AC:O07575] [GN:YHDF] [OR:*BACILLUS SUBTILIS*] [EC:1.—.—.—]
[DE:(EC 1.—.—.—)] [SP:O07575] [DB:swissprot] >pir:[LN:D69825] [AC:D69825]
[PN:glucose 1-dehydrogenase homolog yhdF] [GN:yhdF] [CL:short-chain alcohol
dehydrogenase homology] [OR:*Bacillus subtilis*] [DB:pir2]
>gp:[GI:e1182946:g2633280] [LN:BSUB0006] [AC:Z99109:AL009126] [GN:yhdF]
[FN:unknown] [OR:*Bacillus subtilis*] [DB:genpept-bct1] [DE:*Bacillus subtilis*
complete genome (section 6 of 21):from 999501 to 1209940.] [NT:similar to
glucose 1-dehydrogenase] [SP:O07575] [LE:22211] [RE:23080] [DI:direct]
>gp:[GI:e1191878:g2226201] [LN:BSY14082] [AC:Y14082] [PN:hypothetical
protein] [GN:yhdF] [OR:*Bacillus subtilis*] [DB:genpept-bct1] [DE:*Bacillus
subtilis* chromosomal DNA, region 72 to 75 degrees:spoVRto sspB.]
[NT:Similarity to glucose and ribitol dehydrogenase] [SP:O07575] [LE:8859]
[RE:9728] [DI:direct]

| ORF Name | NT ID | AA ID | NT LN | AA LN | Score | P-Value |
|---|---|---|---|---|---|---|
| AI7503000985__19781305__f1__20 | 919 | 4691 | 123 | 40 | | |

Description
NO-HIT

| ORF Name | NT ID | AA ID | NT LN | AA LN | Score | P-Value |
|---|---|---|---|---|---|---|
| AI7503000985__19787788__f3__1311 | 920 | 4692 | 156 | 51 | | |

Description
NO-HIT

| ORF Name | NT ID | AA ID | NT LN | AA LN | Score | P-Value |
|---|---|---|---|---|---|---|
| AI7503000985__19929586__c3__2180 | 921 | 4693 | 198 | 65 | | |

Description
NO-HIT

| ORF Name | NT ID | AA ID | NT LN | AA LN | Score | P-Value |
|---|---|---|---|---|---|---|
| AI7503000985__20081538__f1__158 | 922 | 4694 | 123 | 40 | | |

Description
NO-HIT

| ORF Name | NT ID | AA ID | NT LN | AA LN | Score | P-Value |
|---|---|---|---|---|---|---|
| AI7503000985__20167186__c2__1958 | 923 | 4695 | 156 | 51 | 229 | 4.0e−19 |

Description
gp:[GI:g4096799] [LN:SCU40158] [AC:U40158] [OR:*Staphylococcus carnosus*]
[DB:genpept-bct2] [DE:*Staphylococcus carnosus* response regulator-like
protein (orfx) gene, partial cds.] [NT:orfx; function unknown; similar to
response] [LE:<1] [RE:560] [DI:direct]

| ORF Name | NT ID | AA ID | NT LN | AA LN | Score | P-Value |
|---|---|---|---|---|---|---|
| AI7503000985__20317__c2__1727 | 924 | 4696 | 2088 | 695 | 431 | 8.4e−38 |

Description
sp:[LN:TAGF_BACSU] [AC:P13485] [GN:TAGF:RODC:TAG3] [OR:*BACILLUS SUBTILIS*]
[DE:TEICHOIC ACID BIOSYNTHESIS PROTEIN F] [SP:P13485] [DB:swissprot]
>pir:[LN:S06049] [AC:S06049:G69720] [PN:probable CDPglycerol
glycerophosphotransferase, :CDP-glycerol:polyglycerol phosphate
glycero-phosphotransferase tagF:rodC protein:teichoic-acid synthase]
[GN:rodC:tag3:tagF] [OR:*Bacillus subtilis*] [EC:2.7.8.12] [DB:pir2] [MP:310
degrees] >gp:[GI:g40100] [LN:BSRODC] [AC:X15200] [OR:*Bacillus subtilis*]
[DB:genpept-bct1] [DE:*Bacillus subtilis* rodC operon.] [NT:rodC (tag3)
polypeptide (AA 1–746)] [SP:P13485] [LE:2178] [RE:4418] [DI:direct]
>gp:[GI:e1184478:g2636098] [LN:BSUB0019] [AC:Z99122:AL009126]
[PN:CDP-glycerol:polyglycerol phosphate] [GN:tagF] [FN:teichoic acid
biosynthesis] [OR:*Bacillus subtilis*] [DB:genpept-bct1] [DE:*Bacillus subtilis*
complete genome (section 19 of 21):from 3597091 to 3809700.] [NT:alternate
gene name:rodC] [SP:P13485] [LE:78129] [RE:80369] [DI:complement]
>gp:[GI:e1184478:g2636098] [LN:BSUB0019] [AC:Z99122:AL009126]
[PN:CDP-glycerol:polyglycerol phosphate] [GN:tagF] [FN:teichoic acid
biosynthesis] [OR:*Bacillus subtilis*] [DB:genpept] [DE:*Bacillus subtilis*
complete genome (section 19 of 21):from 3597091 to 3809700.] [NT:alternate
gene name:rodC] [SP:P13485] [LE:78129] [RE:80369] [DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000985__20323403_f3__1320 | 925 | 4697 | 141 | 46 | | |

Description
NO-HIT

| ORF Name | NT ID | AA ID | NT LN | AA LN | Score | P-Value |
|---|---|---|---|---|---|---|
| AI7503000985__20335260_c3__2081 | 926 | 4698 | 1881 | 626 | 2151 | 8.6e−223 |

Description
gp:[GI:g4098081] [LN:LLU73336] [AC:U73336] [PN:anaerobic ribonucleotide
reductase] [GN:nrdD] [OR:*Lactococcus lactis*] [DB:genpept-bct2]
[DE:*Lactococcus lactis* anaerobic ribonucleotide reductase (nrdD)
and anaerobic ribonucleotide reductase activator protein (nrdG)
genes, complete cds.] [NT:NrdD] [LE:167] [RE:2410] [DI:direct]

| ORF Name | NT ID | AA ID | NT LN | AA LN | Score | P-Value |
|---|---|---|---|---|---|---|
| AI7503000985__20360885_f3__1003 | 927 | 4699 | 1683 | 560 | 906 | 7.3e−91 |

Description
sp:[LN:YHXB_BACSU] [AC:P18159] [GN:YHXB] [OR:*BACILLUS SUBTILIS*] [EC:5.4.2.8]
[DE:PROBABLE PHOSPHOMANNOMUTASE, (PMM)] [SP:P18159] [DB:swissprot]
>pir:[LN:C69835] [AC:C69835:D45868:S18566] [PN:phosphomannomutase homolog
yhxB:hypothetical protein (glpD 3′ region)] [GN:yhxB] [OR:*Bacillus
subtilis*] [DB:pir2] >gp:[GI:e1182920:g2633254] [LN:BSUB0005]
[AC:Z99108:AL009126] [GN:yhxB] [FN:unknown] [OR:*Bacillus subtilis*]
[DB:genpept-bct1] [DE:*Bacillus subtilis* complete genome (section 5 of 21):
from 802821 to 1011250.] [NT:similar to phosphomannomutase] [SP:P18159]
[LE:203459] [RE:205156] [DI:direct] >gp:[GI:e1182932:g2633266] [LN:BSUB0006]
[AC:Z99109:AL009126] [GN:yhxB] [FN:unknown] [OR:*Bacillus subtilis*]
[DB:genpept-bct1] [DE:*Bacillus subtilis* complete genome (section 6 of 21):
from 999501 to 1209940.] [NT:similar to phosphomannomutase] [SP:P18159]
[LE:6779] [RE:8476] [DI:direct] >gp:[GI:e324943:g2226139] [LN:BSY14079]
[AC:Y14079] [PN:hypothetical protein] [GN:yhxB] [OR:*Bacillus subtilis*]
[DB:genpept-bct1] [DE:*Bacillus subtilis* chromosomal DNA, region 75 degrees:
glpPFKDoperon and downstream.] [NT:see EMBL M34393 and Swiss Prot P18159.;
This could] [SP:P18159] [LE:6427] [RE:8124] [DI:direct]

| ORF Name | NT ID | AA ID | NT LN | AA LN | Score | P-Value |
|---|---|---|---|---|---|---|
| AI7503000985__20410307_f2__684 | 928 | 4700 | 126 | 41 | | |

Description
NO-HIT

| ORF Name | NT ID | AA ID | NT LN | AA LN | Score | P-Value |
|---|---|---|---|---|---|---|
| AI7503000985__20413202_f1__47 | 929 | 4701 | 1152 | 383 | 961 | 1.1e−96 |

Description
sp:[LN:YHAD_ECOLI] [AC:P23524] [GN:YHAD] [OR:*ESCHERICHIA COLI*]
[DE:HYPOTHETICAL 39.1 KD PROTEIN IN RNPB-SOHA INTERGENIC REGION (ORF 3)]
[SP:P23524] [DB:swissprot]

| ORF Name | NT ID | AA ID | NT LN | AA LN | Score | P-Value |
|---|---|---|---|---|---|---|
| AI7503000985__20433135_c3__2142 | 930 | 4702 | 801 | 266 | 151 | 1.4e−10 |

Description
gp:[GI:d1011987:g1402529] [LN:D78257] [AC:D78257] [PN:ORF8] [GN:orf8]
[OR:*Enterococcus faecalis*] [SR:*Enterococcus faecalis* plasmid:pYI17 DNA]
[DB:genpept-bct1] [DE:*Enterococcus faecalis* plasmid pYI17 genes for BacA,
BacB, ORF3, ORF4, ORF5, ORF6, ORF7, ORF8, ORF9, ORF10, ORF11, partial cds.]
[LE:1899] [RE:2261] [DI:complement]

| ORF Name | NT ID | AA ID | NT LN | AA LN | Score | P-Value |
|---|---|---|---|---|---|---|
| AI7503000985__20484386_f2__470 | 931 | 4703 | 129 | 42 | | |

Description
NO-HIT

| ORF Name | NT ID | AA ID | NT LN | AA LN | Score | P-Value |
|---|---|---|---|---|---|---|
| AI7503000985__20507625_c3__2004 | 932 | 4704 | 1011 | 336 | 244 | 1.0e−20 |

Description
gp:[GI:g3127078] [LN:AF061070] [AC:AF061070] [PN:PtxB] [GN:ptxB]

-continued

[OR:*Pseudomonas stutzeri*] [DB:genpept-bct2] [DE:*Pseudomonas stutzeri* Orf117 (orf117), Orf86 (orf86) genes, complete cds; and ptxABCDE operon, partial sequence.] [NT:putative binding protein component of] [LE:2345] [RE:3208] [DI:direct]

| ORF Name | NT ID | AA ID | NT LN | AA LN | Score | P-Value |
|---|---|---|---|---|---|---|
| AI7503000985_20509637_c3_2110 | 933 | 4705 | 1335 | 444 | 311 | 8.2e−28 |

Description
gp:[GI:g3676414] [LN:AF051917] [AC:AF051917:L19570] [PN:unknown] [OR:*Staphylococcus aureus*] [DB genpept-bct2] [DE:*Staphylococcus aureus* plasmid pSK41, complete sequence.] [NT:Orf423] [LE:755] [RE:2026] [DI:direct]

| ORF Name | NT ID | AA ID | NT LN | AA LN | Score | P-Value |
|---|---|---|---|---|---|---|
| AI7503000985_20509637_c3_2186 | 934 | 4706 | 1545 | 514 | 1655 | 3.1e−170 |

Description
sp:[LN:GNTK_BACLI] [AC:P46834] [GN:GNTK] [OR:*BACILLUS LICHENIFORMIS*] [EC:2.7.1.12] [DE:GLUCONOKINASE, (GLUCONATE KINASE)] [SP:P46834] [DB:swissprot] >pir:[LN:JC2304] [AC:JC2304] [PN:gluconate kinase, :gntK protein] [GN:gntK] [CL:xylulokinase] [OR:*Bacillus licheniformis*] [EC:2.7.—.—] [DB:pir2] >gp:[GI:d1007073:g563951] [LN:BACGNTBL] [AC:D31631] [PN:gluconate kinase] [GN:gntK] [OR:*Bacillus licheniformis*] [SR:*Bacillus licheniformis* (strain:BGSC5A2) DNA] [DB:genpept-bct1] [DE:*Bacillus licheniformis* DNA for hypothetical protein and Gnt proteins.] [LE:I725] [RE:3266] [DI:direct]

| ORF Name | NT ID | AA ID | NT LN | AA LN | Score | P-Value |
|---|---|---|---|---|---|---|
| AI7503000985_20515643_f3_1130 | 935 | 4707 | 141 | 46 | | |

Description
NO-HIT

| ORF Name | NT ID | AA ID | NT LN | AA LN | Score | P-Value |
|---|---|---|---|---|---|---|
| AI7503000985_20524067_c1_1622 | 936 | 4708 | 639 | 212 | 231 | 2.5e−19 |

Description
pir:[LN:C70041] [AC:C70041] [PN:conserved hypothetical protein yvgV] [GN:yvgV] [OR:*Bacillus subtilis*] [DB:pir2] >gp:[GI:e1186036:g2635861] [LN:BSUB0018] [AC:Z99121:AL009126] [GN:yvgV] [FN:unknown] [OR:*Bacillus subtilis*] [DB:genpept-bct1] [DE:*Bacillus subtilis* complete genome (section 18 of 21):from 3399551 to 3609060.] [NT:similar to hypothetical proteins] [LE:37577] [RE:38245] [DI:complement]

| ORF Name | NT ID | AA ID | NT LN | AA LN | Score | P-Value |
|---|---|---|---|---|---|---|
| AI7503000985_20589568_c1_1392 | 937 | 4709 | 1557 | 518 | 282 | 1.1e−21 |

Description
sp:[LN:TAGE_BACSU] [AC:P13484] [GN:TAGE:RODD:GTAA] [OR:*BACILLUS SUBTILIS*] [EC:2.4.1.52] [DE:(EC 2.4.1.52) (TEICHOIC ACID BIOSYNTHESIS PROTEIN E)] [SP:P13484] [DB:swissprot] >pir:[LN:S06048] [AC:S06048:F69720] [PN:poly(glycerol-phosphate) alpha-glucosyltransferase, tagE:probable rodD protein:UDP-glucose--polyglycerol phosphate glucosyltransferase tagE] [GN:tagE:rodD] [OR:*Bacillus subtilis*] [EC:2.4.1.52] [DB:pir2] [MP:310 degrees] >gp:[GI:g580920] [LN:BSRODC] [AC:X15200] [OR:*Bacillus subtilis*] [DB:genpept-bct1] [DE:*Bacillus subtilis* rodC operon.] [NT:rodD (gtaA) polypeptide (AA 1–673)) [SP:P13484] [LE:157] [RE:2178] [DI:direct] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:*Bacillus subtilis*] [DB:genpept-bct1] [EC:2.4.1.52] [DE:*Bacillus subtilis* complete genome (section 19 of 21):from 3597091 to 3809700.] [NT:alternate gene name:rodD, gtaA, gtaD] [SP:P13484] [LE:80369] [RE:82390] [DI:complement] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:*Bacillus subtilis*] [DB:genpept] [EC:2.4.1.52] [DE:*Bacillus subtilis* complete genome (section 19 of 21):from 3597091 to 3809700.] [NT:alternate gene name:rodD, gtaA, gtaD] [SP:P13484] [LE:80369] [RE:82390] [DI:complement]

| ORF Name | NT ID | AA ID | NT LN | AA LN | Score | P-Value |
|---|---|---|---|---|---|---|
| AI7503000985_2068937_f3_1191 | 938 | 4710 | 1539 | 512 | 1041 | 3.6e−105 |

-continued

Description
pir:[LN:C69676] [AC:C69676:B39096:S16904:139952:S18269] [PN:alkaline
phosphatase, III precursor:alkaline phosphatase B (phoB)] [GN:phoB:phoAII]
[CL:alkaline phosphatase] [OR:*Bacillus subtilis*] [EC:3.1.3.1] [DB:pir2]
>gp:[GI:e1182553:g2632887] [LN:BSUB0004] [AC:Z99107:AL009126] [PN:alkaline
phosphatase III] [GN:phoB] [OR:*Bacillus subtilis*] [DB:genpept-bct1]
[EC:3.1.3.1] [DE:*Bacillus subtilis* complete genome (section 4 of 21):from
600701 to 813890.] [NT:alternate gene name:phoAIII] [SP:P19405] [LE:19113]
[RE:20501] [DI:complement] >gp:[GI:d1020477:g1945090] [LN:D88802]
[AC:D88802] [GN:phoB] [OR:*Bacillus subtilis*] [SR:*Bacillus subtilis*
(sub_species:Marburg, strain:168, isolate:JH642] [DB:genpept-bct1]
[DE:*Bacillus subtilis* DNA for phoB-rrnE-groESL region, complete cds.] [NT:*B.
subtilis* alkaline phosphatase IIIA; P19405] [LE:6115] [RE:7503]
[DI:complement]

| ORF Name | NT ID | AA ID | NT LN | AA LN | Score | P-Value |
|---|---|---|---|---|---|---|
| AI7503000985_20822287_c1_1574 | 939 | 4711 | 684 | 227 | 563 | 1.6e−54 |

Description
sp:[LN:GNTR_BACSU] [AC:P10585] [GN:GNTR] [OR:*BACILLUS SUBTILIS*]
[DE:GLUCONATE OPERON TRANSCRIPTIONAL REPRESSOR (P28 PROTEIN)] [SP:P10585]
[DB:swissprot] >pir:[LN:C26190] [AC:C26190:A23537:E69636:S10723]
[PN:transcription repressor of gluconate operon gntR:gnt operon regulatory
protein] [GN:gntR] [OR:*Bacillus subtilis*] [DB:pir2]
>gp:[GI:d1022429:g563933] [LN:AB005554] [AC:AB005554:D45242:D31629]
[PN:gluconate operon repressor] [GN:gntR] [OR:*Bacillus subtilis*]
[SR:*Bacillus subtilis* (strain:BGSC 1A1) DNA] [DB:genpept-bct1] [DE:*Bacillus
subtilis* genomic DNA, 36 kb region between gnt and ioloperons.] [NT:PROSITE;
PS00043; HTH_GNTR_FAMILY; see SWISS_PROT] [LE:4516] [RE:5247]
[DI:complement] >gp:[GI:g143014] [LN:BACGNT] [AC:J02584:M24505] [PN:gnt
repressor] [OR:*Bacillus subtilis*] [SR:*Bacillus subtilis* (strain Marburg 168)
DNA] [DB:genpept-bct1] [DE:*B. subtilis* (gluconate operon) gntR, gntK and gntP
genes encoding gnt repressor, gluconate kinase and permease, and gntZ gene.]
[LE:236] [RE:967] [DI:direct] >gp:[GI:e1184731:g2636552] [LN:BSUB0021]
[AC:Z99124:AL009126] [PN:transcriptional regulator (GntR family)] [GN:gntR]
[FN:negative regulation of the gluconate operon] [OR:*Bacillus subtilis*]
[DB:genpept-bct1] [DE:*Bacillus subtilis* complete genome (section 21 of 21):
from 3999281 to 4214814.] [SP:P10585] [LE:113345] [RE:114076] [DI:direct]

| ORF Name | NT ID | AA ID | NT LN | AA LN | Score | P-Value |
|---|---|---|---|---|---|---|
| AI7503000985_20892325_c1_1389 | 940 | 4712 | 156 | 51 | | |

Description
NO-HIT

| ORF Name | NT ID | AA ID | NT LN | AA LN | Score | P-Value |
|---|---|---|---|---|---|---|
| AI7503000985_210885_f2_690 | 941 | 4713 | 222 | 73 | | |

Description
NO-HIT

| ORF Name | NT ID | AA ID | NT LN | AA LN | Score | P-Value |
|---|---|---|---|---|---|---|
| AI7503000985_2125000_f1_305 | 942 | 4714 | 126 | 41 | | |

Description
NO-HIT

| ORF Name | NT ID | AA ID | NT LN | AA LN | Score | P-Value |
|---|---|---|---|---|---|---|
| AI75030000985_2136712_c3_2211 | 943 | 4715 | 1197 | 398 | 469 | 1.5e−44 |

Description
pir:[LN:H69784] [AC:H69784] [PN:chloramphenicol resistance protein homolog
ydhL] [GN:ydhL] [CL:*Streptomyces lividans* chloramphenicol resistance
protein] [OR:*Bacillus subtilis*] [DB:pir2] >gp:[GI:e1182559:g2632893]
[LN:BSUB0004] [AC:Z99107:AL009126] [GN:ydhL] [FN:unknown] [OR:*Bacillus
subtilis*] [DB:genpept-bct1] [DE:*Bacillus subtilis* complete genome (section 4
of 21):from 600701 to 813890.] [NT:similar to chloramphenicol resistance
protein] [LE:24142] [RE:25419] [DI:complement] >gp:[GI:d1020483:g1945096]
[LN:D88802] [AC:D88802] [GN:ydhL] [OR:*Bacillus subtilis*] [SR:*Bacillus
subtilis* (sub_species:Marburg, strain:168, isolate:JH642] [DB:genpept-bct1]
[DE:*Bacillus subtilis* DNA for phoB-rrnE-groESL region, complete cds.] [NT:*S.
lividans* chloramphenicol resistance protein;] [LE:11144] [RE:12421]
[DI:complement]

-continued

| ORF Name | NT ID | AA ID | NT LN | AA LN | Score | P-Value |
|---|---|---|---|---|---|---|
| AI7503000985__214026__c2__1767 | 944 | 4716 | 129 | 42 | | |

Description
NO-HIT

| ORF Name | NT ID | AA ID | NT LN | AA LN | Score | P-Value |
|---|---|---|---|---|---|---|
| AI7503000985__2148428__f2__892 | 945 | 4717 | 123 | 40 | | |

Description
NO-HIT

| ORF Name | NT ID | AA ID | NT LN | AA LN | Score | P-Value |
|---|---|---|---|---|---|---|
| AI7503000985__21493827__c2__1719 | 946 | 4718 | 129 | 42 | | |

Description
NO-HIT

| ORF Name | NT ID | AA ID | NT LN | AA LN | Score | P-Value |
|---|---|---|---|---|---|---|
| AI7503000985__21515707__f3__1084 | 947 | 4719 | 198 | 65 | | |

Description
NO-HIT

| ORF Name | NT ID | AA ID | NT LN | AA LN | Score | P-Value |
|---|---|---|---|---|---|---|
| AI7503000985__21517012__c2__1722 | 948 | 4720 | 411 | 136 | 289 | 1.8e−25 |

Description
gp:[GI:g2318065] [LN:AF012532] [AC:AF012532] [PN:YeeE] [GN:yeeE]
[OR:*Bacillus subtilis*] [DB:genpept-bct1] [DE:*Bacillus subtilis* strain 168
trpC2 YefA (yefA) gene, partial cds, and YefB (yefB), YefC (yefC), YeeA
(yeeA), YeeB (yeeB), YeeC (yeeC), YeeD (yeeD), YeeE (yeeE) and YeeF (yeeF)
genes, complete cds.] [LE:8308] [RE:9417] [DI:complement]

| ORF Name | NT ID | AA ID | NT LN | AA LN | Score | P-Value |
|---|---|---|---|---|---|---|
| AI7503000985__21523377__f3__1042 | 949 | 4721 | 171 | 56 | | |

Description
NO-HIT

| ORF Name | NT ID | AA ID | NT LN | AA LN | Score | P-Value |
|---|---|---|---|---|---|---|
| AI7503000985__21563751__f3__1315 | 950 | 4722 | 237 | 78 | | |

Description
NO-HIT

| ORF Name | NT ID | AA ID | NT LN | AA LN | Score | P-Value |
|---|---|---|---|---|---|---|
| AI7503000985__21579561__c2__1962 | 951 | 4723 | 123 | 40 | | |

Description
NO-HIT

| ORF Name | NT ID | AA ID | NT LN | AA LN | Score | P-Value |
|---|---|---|---|---|---|---|
| AI7503000985__21604040__c1__1522 | 952 | 4724 | 2028 | 675 | 1295 | 4.4e−132 |

Description
sp:[LN:FEOB__METJA] [AC:Q57986] [GN:MJ0566] [OR:*METHANOCOCCUS JANNASCHII*]
[DE:FERROUS IRON TRANSPORT PROTEIN B HOMOLOG] [SP:Q57986] [DB:swissprot]
>pir:[LN:F64370] [AC:F64370] [PN:ferrous iron transport protein B]
[CL:ferrous iron transport protein B:translation elongation factor Tu
homology] [OR:*Methanococcus jannaschii*] [DB:pir2] [MP:REV504509-502503]
>gp:[GI:g1591272] [LN:U67505] [AC:U67505:L77117] [PN:ferrous iron transport
protein B (feoB)] [GN:MJ0566] [OR:*Methanococcus jannaschii*]
[DB:genpept-bct2] [DE:*Methanococcus jannaschii* section 47 of 150 of the
complete genome.] [NT:similar to SP:P33650 PID:606344 PID:1199515]
[LE:10027] [RE:12033] [DI:complement]

-continued

| ORF Name | NT ID | AA ID | NT LN | AA LN | Score | P-Value |
|---|---|---|---|---|---|---|
| AI7503000985_21664126_c2_1712 | 953 | 4725 | 1083 | 360 | 1138 | 1.9e−115 |

Description
gp:[GI:e1299583:g3687417] [LN:BLY17554] [AC:Y17554] [PN:ornithine carbamoyltransferase] [GN:arcB] [OR:*Bacillus licheniformis*] [DB:genpept-bct1] [EC:2.1.3.3] [DE:*Bacillus licheniformis* arcA, arcB, arcC and arcD genes.] [LE:1518] [RE:2525] [DI:direct]

| ORF Name | NT ID | AA ID | NT LN | AA LN | Score | P-Value |
|---|---|---|---|---|---|---|
| AI7503000985_21674062_c1_1615 | 954 | 4726 | 135 | 44 | | |

Description
NO-HIT

| ORF Name | NT ID | AA ID | NT LN | AA LN | Score | P-Value |
|---|---|---|---|---|---|---|
| AI7503000985_21678217_c2_1764 | 955 | 4727 | 123 | 40 | | |

Description
NO-HIT

| ORF Name | NT ID | AA ID | NT LN | AA LN | Score | P-Value |
|---|---|---|---|---|---|---|
| AI7503000985_21687963_c1_1426 | 956 | 4728 | 477 | 158 | 192 | 3.4e−15 |

Description
gp:[GI:g4980875] [LN:AE001717] [AC:AE001717:AE000512] [PN:arginine repressor] [GN:TM0371] [OR:Thermotoga maritima] [DB:genpept-bct2] [DE:Thermotoga maritima section 29 of 136 of the complete genome.] [NT:similar to GB:M27869 SP:P17893 PID:142450] [LE:2550] [RE:3008] [DI:direct] >gp:[GI:e1489641:g5102818] [LN:TMA132286] [AC:AJ132286] [PN:arginine repressor] [GN:argR] [FN:regulation of arginine biosynthesis genes] [OR:Thermotoga maritima] [DB:genpept] [DE:Thermotoga maritima argR gene, strain MSB8.] [LE:1] [RE:459] [DI:direct]

| ORF Name | NT ID | AA ID | NT LN | AA LN | Score | P-Value |
|---|---|---|---|---|---|---|
| AI7503000985_21759718_f1_181 | 957 | 4729 | 297 | 98 | 76 | 0.044 |

Description
gp:[GI:g4049770] [LN:AF063866] [AC:AF063866] [PN:ORF MSV254 leucine rich repeat gene family] [GN:MSV254] [OR:Melanoplus sanguinipes entomopoxvirus] [DB genpept-vrl] [DE:Melanoplus sanguinipes entomopoxvirus, complete genome.] [LE:220798] [RE:221799] [DI:direct]

| ORF Name | NT ID | AA ID | NT LN | AA LN | Score | P-Value |
|---|---|---|---|---|---|---|
| AI7503000985_21774087_c3_2111 | 958 | 4730 | 732 | 243 | 336 | 1.8e−30 |

Description
sp:[LN:Y882_HAEIN] [AC:P44068] [GN:HI0882] [OR:*HAEMOPHILUS INFLUENZAE*] [DE:HYPOTHETICAL PROTEIN HI0882] [SP:P44068] [DB:swissprot] >pir:[LN:E64015] [AC:E64015] [PN:hypothetical protein HI0882] [OR:*Haemophilus influenzae*] [DB:pir2] >gp:[GI:g1573906] [LN:U32770] [AC:U32770:L42023] [PN:*H. influenzae* predicted coding region HI0882] [GN:HI0882] [OR:*Haemophilus influenzae* Rd] [DB:genpept-bct2] [DE:*Haemophilus influenzae* Rd section 85 of 163 of the complete genome.] [NT:hypothetical protein; identified by GeneMark;] [LE:1177] [RE:1914] [DI:direct]

| ORF Name | NT ID | AA ID | NT LN | AA LN | Score | P-Value |
|---|---|---|---|---|---|---|
| AI7503000985_22275052_f1_248 | 959 | 4731 | 135 | 44 | | |

Description
NO-HIT

| ORF Name | NT ID | AA ID | NT LN | AA LN | Score | P-Value |
|---|---|---|---|---|---|---|
| AI7503000985_22296927_f1_418 | 960 | 4732 | 168 | 55 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000985__22304578__c2__1792 | 961 | 4733 | 138 | 45 | | |

Description
NO-HIT

| ORF Name | NT ID | AA ID | NT LN | AA LN | Score | P-Value |
|---|---|---|---|---|---|---|
| AI7503000985__22345265__f1__27 | 962 | 4734 | 189 | 62 | | |

Description
NO-HIT

| ORF Name | NT ID | AA ID | NT LN | AA LN | Score | P-Value |
|---|---|---|---|---|---|---|
| AI7503000985__22380343__f2__827 | 963 | 4735 | 1983 | 660 | 363 | 2.3e−30 |

Description
sp:[LN:ALYS_ENTFA] [AC:P37710] [OR:*ENTEROCOCCUS FAECALIS*] [SR:,*STREPTOCOCCUS FAECALIS*] [EC:3.5.1.28] [DE:AUTOLYSIN, (N-ACETYLMURAMOYL-L-ALANINE AMIDASE)] [SP:P37710] [DB:swissprot] >pir:[LN:A38109] [AC:A38109] [PN:autolysin] [OR:*Enterococcus faecalis*] [DB:pir2] >gp:[GI:g829194] [LN:STRHYDROLA] [AC:M58002] [PN:bacterial cell wall hydrolase] [OR:*Enterococcus faecalis*] [SR:*Streptococcus faecalis* DNA] [DB:genpept-bct1] [DE:*Streptococcus faecalis* bacterial cell wall hydrolase gene, complete cds.] [LE:536] [RE:2551] [DI:direct]

| ORF Name | NT ID | AA ID | NT LN | AA LN | Score | P-Value |
|---|---|---|---|---|---|---|
| AI7503000985__2242136__c3__2048 | 964 | 4736 | 684 | 227 | 583 | 1.2e−56 |

Description
gp:[GI:e303881:g1850807] [LN:CPCPEAA] [AC:X71844] [PN:putative transposase] [OR:*Clostridium perfringens*] [DB:genpept-bct1] [DE:*C. perfringens* uapC, cpe, and nadC genes.] [LE:2477] [RE:2932] [DI:direct]

| ORF Name | NT ID | AA ID | NT LN | AA LN | Score | P-Value |
|---|---|---|---|---|---|---|
| AI7503000985__22453186__f3__989 | 965 | 4737 | 159 | 52 | | |

Description
NO-HIT

| ORF Name | NT ID | AA ID | NT LN | AA LN | Score | P-Value |
|---|---|---|---|---|---|---|
| AI7503000985__22460302__c1__1511 | 966 | 4738 | 756 | 251 | 334 | 3.0e−30 |

Description
gp:[GI:g2735514] [LN:SCU96108] [AC:U96108] [PN:SceA precursor] [GN:sceA] [OR:*Staphylococcus carnosus*] [DB genpept-bct2] [DE:*Staphylococcus carnosus* (3R)-hydroxymyristoyl acyl carrier proteindehydrase homolog (fabZ) gene, partial cds, YwpF homolog, single-strand binding protein homolog (ssb), SceD precursor (sceD), SceA precursor (sceA) and SceE precursor (sceE) genes, complete cds, and TenA homolog (tenA) gene, partial cds.] [NT:secreted protein] [LE:2736] [RE:3449] [DI:direct]

| ORF Name | NT ID | AA ID | NT LN | AA LN | Score | P-Value |
|---|---|---|---|---|---|---|
| AI7503000985__22656300__f2__881 | 967 | 4739 | 1542 | 513 | 1508 | 1.2e−154 |

Description
gp:[GI:d1039113:g4514332] [LN:AB013369] [AC:AB013369] [OR:*Bacillus halodurans*] [SR:*Bacillus halodurans* (strain:C-125) DNA] [DB:genpept-bct1] [DE:*Bacillus halodurans* C-125 yesT and comEC genes, partial and complete cds.] [NT:unknown] [LE:4328] [RE:5830] [DI:direct]

| ORF Name | NT ID | AA ID | NT LN | AA LN | Score | P-Value |
|---|---|---|---|---|---|---|
| AI7503000985__22735877__f3__1047 | 968 | 4740 | 141 | 46 | | |

Description
NO-HIT

| ORF Name | NT ID | AA ID | NT LN | AA LN | Score | P-Value |
|---|---|---|---|---|---|---|
| AI7503000985__23438751__f2__550 | 969 | 4741 | 228 | 75 | | |

Description
NO-HIT

-continued

| ORF Name | NT ID | AA ID | NT LN | AA LN | Score | P-Value |
|---|---|---|---|---|---|---|
| AI7503000985__234432__c1__1440 | 970 | 4742 | 150 | 49 | | |

Description
NO-HIT

| ORF Name | NT ID | AA ID | NT LN | AA LN | Score | P-Value |
|---|---|---|---|---|---|---|
| AI7503000985__23445387__c3__1998 | 971 | 4743 | 195 | 64 | | |

Description
NO-HIT

| ORF Name | NT ID | AA ID | NT LN | AA LN | Score | P-Value |
|---|---|---|---|---|---|---|
| AI7503000985__23468942__f1__79 | 972 | 4744 | 1101 | 366 | 928 | 3.4e−93 |

Description
pir:[LN:A69984] [AC:A69984] [PN:endo-1,4-beta-glucanase homolog ysdC]
[GN:ysdC] [CL:thermophilic aminopeptidase I alpha chain] [OR:*Bacillus subtilis*] [DB:pir2] >gp:[GI:e1184131:g2635347] [LN:BSUB0015]
[AC:Z99118:AL009126] [GN:ysdC] [FN:unknown] [OR:*Bacillus subtilis*]
[DB:genpept-bct1] [DE:*Bacillus subtilis* complete genome (section 15 of 21): from 2795131 to 3013540.] [NT:similar to endo-1,4-beta-glucanase] [LE:154199]
[RE:155284] [DI:complement] >gp:[GI:e1165304:g1770012] [LN:BSZ75208]
[AC:Z75208] [PN:hypothetical protein] [GN:ysdC] [OR:*Bacillus subtilis*]
[DB:genpept-bct1] [DE:*B. subtilis* genomic sequence 89009bp.] [NT:homology to celA of Clostridium thermocellum and] [LE:14623] [RE:15708] [DI:direct]

| ORF Name | NT ID | AA ID | NT LN | AA LN | Score | P-Value |
|---|---|---|---|---|---|---|
| AI7503000985__23475251__c2__1952 | 973 | 4745 | 141 | 46 | | |

Description
NO-HIT

| ORF Name | NT ID | AA ID | NT LN | AA LN | Score | P-Value |
|---|---|---|---|---|---|---|
| AI7503000985__23475325__c1__1479 | 974 | 4746 | 159 | 52 | | |

Description
NO-HIT

| ORF Name | NT ID | AA ID | NT LN | AA LN | Score | P-Value |
|---|---|---|---|---|---|---|
| AI7503000985__23476503__f3__1228 | 975 | 4747 | 189 | 62 | | |

Description
NO-HIT

| ORF Name | NT ID | AA ID | NT LN | AA LN | Score | P-Value |
|---|---|---|---|---|---|---|
| AI7503000985__23476702__c1__1496 | 976 | 4748 | 882 | 293 | 595 | 6.6e−58 |

Description
sp:[LN:YWBI_BACSU] [AC:P39592] [GN:YWBI:IPA-24D] [OR:*BACILLUS SUBTILIS*]
[DE:HYPOTHETICAL TRANSCRIPTIONAL REGULATOR IN THIK-EPR INTERGENIC REGION]
[SP:P39592] [DB:swissprot] >pir:[LN:S39679] [AC:S39679:G70051]
[PN:transcription regulator homolog ywbI:protein ipa-24d] [GN:ywbI]
[CL:probable transcription regulator lsyR] [OR:*Bacillus subtilis*] [DB:pir2]
>gp:[GI:g413948] [LN:BSGENR] [AC:X73124] [GN:ipa-24d] [OR:*Bacillus subtilis*]
[DB:genpept-bct1] [DE:*B. subtilis* genomic region (325 to 333).] [SP:P39592]
[LE:24460] [RE:25365] [DI:direct] >gp:[GI:e1186330:g2636366] [LN:BSUB0020]
[AC:Z99123:AL009126] [GN:ywbI] [FN:unknown] [OR:*Bacillus subtilis*]
[DB:genpept-bct1] [DE:*Bacillus subtilis* complete genome (section 20 of 21): from 3798401 to 4010550.] [NT:alternate gene name:ipa-24d; similar to]
[SP:P39592] [LE:132594] [RE:133499] [DI:complement]

| ORF Name | NT ID | AA ID | NT LN | AA LN | Score | P-Value |
|---|---|---|---|---|---|---|
| AI7503000985__23479702__c3__2053 | 977 | 4749 | 273 | 90 | | |

Description
NO-HIT

-continued

| ORF Name | NT ID | AA ID | NT LN | AA LN | Score | P-Value |
|---|---|---|---|---|---|---|
| AI7503000985_23480467_c1_1549 | 978 | 4750 | 912 | 303 | 862 | 3.4e−86 |

Description
pir:[LN:G69879] [AC:G69879] [PN:L-serine dehydratase homolog ylpA] [GN:ylpA]
[OR:*Bacillus subtilis*] [DB:pir2] >gp:[GI:e1185177:g2633958] [LN:BSUB0009]
[AC:Z99112:AL009126] [GN:ylpA] [FN:unknown] [OR:*Bacillus subtilis*]
[DB:genpept-bct1] [DE:*Bacillus subtilis* complete genome (section 9 of 21):
from 1598421 to 1807200.] [NT:similar to L-serine dehydratase] [LE:59909]
[RE:60811] [DI:direct] >gp:[GI:e323528:g2337815] [LN:BSY13937] [AC:Y13937]
[PN:putative YhaP protein] [GN:ylpA] [FN:unknown] [OR:*Bacillus subtilis*]
[DB:genpept-bct1] [DE:*Bacillus subtilis* genomic DNA from the spoVM region.]
[LE:21681] [RE:22583] [DI:direct]

| ORF Name | NT ID | AA ID | NT LN | AA LN | Score | P-Value |
|---|---|---|---|---|---|---|
| AI7503000985_235205_c2_1845 | 979 | 4751 | 138 | 45 | | |

Description
NO-HIT

| ORF Name | NT ID | AA ID | NT LN | AA LN | Score | P-Value |
|---|---|---|---|---|---|---|
| AI7503000985_23553275_f3_1064 | 980 | 4752 | 126 | 41 | | |

Description
NO-HIT

| ORF Name | NT ID | AA ID | NT LN | AA LN | Score | P-Value |
|---|---|---|---|---|---|---|
| AI7503000985_23556338_c1_1568 | 981 | 4753 | 303 | 100 | 170 | 7.2e−13 |

Description
Sp:[LN:YCNE_BACSU] [AC:P94425] [GN:YCNE] [OR:*BACILLUS SUBTILIS*]
[DE:HYPOTHETICAL 10.9 KD PROTEIN IN PHRC-GDH INTERGENIC REGION] [SP:P94425]
[DB:swissprot] >pir:[LN:A69764] [AC:A69764] [PN:conserved hypothetical
protein ycnE] [GN:ycnE] [OR:*Bacillus subtilis*] [DB:pir2]
>gp:[GI:e1182354:g2632688] [LN:BSUB0003] [AC:Z99106:AL009126] [GN:ycnE]
[FN:unknown] [OR:*Bacillus subtilis*] [DB:genpept-bct1] [DE:*Bacillus subtilis*
complete genome (section 3 of 21):from 402751 to 611850.] [NT:similar to
hypothetical proteins] [SP:P94425] [LE:36112] [RE:36399] [DI:complement]
>gp:[GI:d1009654:g1805457] [LN:D50453] [AC:D50453] [GN:ycnE] [OR:*Bacillus
subtilis*] [SR:*Bacillus subtilis* (strain:168 trpC2) DNA] [DB:genpept-bct1]
[DE:*Bacillus subtilis* DNA for 25–36 degree region containing theamyE-srfA
region, complete cds.] [LE:118515] [RE:118802] [DI:complement]

| ORF Name | NT ID | AA ID | NT LN | AA LN | Score | P-Value |
|---|---|---|---|---|---|---|
| AI7503000985_23593800_c1_1493 | 982 | 4754 | 942 | 313 | 141 | 8.3e−0.8 |

Description
pir:[LN:D69778] [AC:D69778] [PN:hypothetical protein ydeJ] [GN:ydeJ]
[OR:*Bacillus subtilis*] [DB:pir2] >gp:[GI:d1020110:g1881330] [LN:AB001488]
[AC:AB001488] [GN:ydeJ] [OR:*Bacillus subtilis*] [SR:*Bacillus subtilis*
(strain:168) DNA] [DB:genpept-bct1] [DE:*Bacillus subtilis* genome sequence,
148 kb sequence of the region between 35 and 47 degree.] [NT:FUNCTION
UNKNOWN.] [LE:102509] [RE:103168] [DI:complement] >gp:[GI:e1182488:g2632822]
[LN:BSUB0003] [AC:Z99106:AL009126] [GN:ydeJ] [FN:unknown] [OR:*Bacillus
subtilis*] [DB:genpept-bct1] [DE:*Bacillus subtilis* complete genome (section 3
of 21):from 402751 to 611850.] [LE:166254] [RE:166913] [DI:complement]

| ORF Name | NT ID | AA ID | NT LN | AA LN | Score | P-Value |
|---|---|---|---|---|---|---|
| AI7503000985_23595262_f2_695 | 983 | 4755 | 123 | 40 | | |

Description
NO-HIT

| ORF Name | NT ID | AA ID | NT LN | AA LN | Score | P-Value |
|---|---|---|---|---|---|---|
| AI7503000985_23595312_f3_948 | 984 | 4756 | 132 | 43 | | |

Description
NO-HIT

-continued

| ORF Name | NT ID | AA ID | NT LN | AA LN | Score | P-Value |
|---|---|---|---|---|---|---|
| AI7503000985_23600412_f3_960 | 985 | 4757 | 1242 | 413 | 546 | 1.0e−52 |

Description
pir:[LN:E69783] [AC:E69783] [PN:bicyclomycin resistance protein homolog ydgK] [GN:ydgK] [CL:bicyclomycin resistance protein] [OR:*Bacillus subtilis*] [DB:pir2] >gp:[GI:d1020154:g1881374] [LN:AB001488] [AC:AB001488] [GN:ydgK] [OR:*Bacillus subtilis*] [SR:*Bacillus subtilis* (strain:168) DNA] [DB:genpept-bct1] [DE:*Bacillus subtilis* genome sequence, 148 kb sequence of the region between 35 and 47 degree.] [NT:SIMILAR TO BICYCLOMYCIN RESISTANCE PROTEIN.] [LE:146860] [RE:148068] [DI:direct] >gp:[GI:e1182547:g2632881] [LN:BSUB0004] [AC:Z99107:AL009126] [GN:ydgK] [FN:unknown] [OR:*Bacillus subtilis*] [DB:genpept-bct1] [DE:*Bacillus subtilis* complete genome (section 4 of 21):from 600701 to 813890.] [NT:similar to bicyclomycin resistance protein] [LE:12656] [RE:13864] [DI:direct]

| ORF Name | NT ID | AA ID | NT LN | AA LN | Score | P-Value |
|---|---|---|---|---|---|---|
| AI7503000985_23600752_f1_215 | 986 | 4758 | 240 | 79 | 73 | 0.014 |

Description
pir:[LN:S69592] [AC:S69592] [PN:hypothetical protein YDR509w] [OR:*Saccharomyces cerevisiae*] [DB:pir2] [MP:4R]

| ORF Name | NT ID | AA ID | NT LN | AA LN | Score | P-Value |
|---|---|---|---|---|---|---|
| AI7503000985_23602015_c2_1892 | 987 | 4759 | 687 | 228 | 374 | 1.7e−34 |

Description
sp:[LN:YBBL_ECOLI] [AC:P77279] [GN:YBBL] [OR:*ESCHERICHIA COLI*] [DE:HYPOTHETICAL ABC TRANSPORTER ATP-BINDING PROTEIN YBBL] [SP:P77279] [DB:swissprot] >pir:[LN:A64780] [AC:A64780] [PN:probable ABC-type transport protein ybbL:probable ABC transporter, ATP-binding protein ybbL] [GN:ybbL] [CL:ATP-binding cassette homology] [OR:*Escherichia coli*] [DB:pir2] >gp:[GI:g1773172] [LN:ECU82664] [AC:U82664] [OR:*Escherichia coli*] [DB:genpept-bct1] [DE:*Escherichia coli* minutes 9 to 11 genomic sequence.] [NT:hypothetical protein] [LE:95367] [RE:96044] [DI:direct] >gp:[GI:g1786698] [LN:AE000155] [AC:AE000155:U00096] [PN:putative ATP-binding component of a transport] [GN:ybbL] [FN:putative transport; Not classified] [OR:*Escherichia coli*] [DB:genpept-bct2] [DE:*Escherichia coli* K-12 MG1655 section 45 of 400 of the complete genome.] [NT:o225; This 225 aa ORF is 32 pct identical (7 gaps)] [LE:4439] [RE:5116] [DI:direct]

| ORF Name | NT ID | AA ID | NT LN | AA LN | Score | P-Value |
|---|---|---|---|---|---|---|
| AI7503000985_23604052_f1_209 | 988 | 4760 | 318 | 105 | 81 | 0.0020 |

Description
sp:[LN:YE1A_METJA] [AC:P81328] [GN:MJ1417.1] [OR:*METHANOCOCCUS JANNASCHII*] [DE:HYPOTHETICAL PROTEIN MJ1417.1] [SP:P81328] [DB:swissprot] >gp:[GI:g2826408] [LN:U67582] [AC:U67582:L77117] [PN:*M. jannaschii* predicted coding region MJ1417.1] [GN:MJ1417.1] [OR:*Methanococcus jannaschii*] [DB:genpept-bct2] [DE:*Methanococcus jannaschii* section 124 of 150 of the complete genome.] [NT:Brute Force ORF; identified by GeneMark; putative] [LE:4562] [RE:4999] [DI:direct]

| ORF Name | NT ID | AA ID | NT LN | AA LN | Score | P-Value |
|---|---|---|---|---|---|---|
| AI7503000985_23620252_c1_1606 | 989 | 4761 | 138 | 45 | | |

Description
NO-HIT

| ORF Name | NT ID | AA ID | NT LN | AA LN | Score | P-Value |
|---|---|---|---|---|---|---|
| AI7503000985_23625005_c3_2103 | 990 | 4762 | 138 | 45 | | |

Description
NO-HIT

| ORF Name | NT ID | AA ID | NT LN | AA LN | Score | P-Value |
|---|---|---|---|---|---|---|
| AI7503000985_23631311_c2_1820 | 991 | 4763 | 297 | 98 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000985__23635926__f2__538 | 992 | 4764 | 144 | 47 | | |

Description
NO-HIT

| ORF Name | NT ID | AA ID | NT LN | AA LN | Score | P-Value |
|---|---|---|---|---|---|---|
| AI7503000985__23636343__c1__1383 | 993 | 4765 | 813 | 270 | 409 | 3.4e−38 |

Description
sp:[LN:PHNE_*ECOLI*] [AC:P16683:Q47479:P76792:Q47716] [GN:PHNE]
[OR:*ESCHERICHIA COLI*] [DE:PHOSPHONATES TRANSPORT SYSTEM PERMEASE PROTEIN
PHNE] [SP:P16683:Q47479:P76792:Q47716] [DB:swissprot] >pir:[LN:F35718]
[AC:F35718:A42732:S56332:S56331:G65219:F65219] [PN:phnE
protein:hypothetical protein b4103] [GN:phnE] [CL:phnE protein]
[OR:*Escherichia coli*] [DB:pir1] >gp:[GI:g247198] [LN:ECOPHNAQ] [AC:J05260]
[OR:*Escherichia coli*] [SR:*E. coli* (strain B) DNA] [DB:genpept-bct1]
[DE:*E. coli* psiD locus containing alkylphosphonate uptake (phn) genes
Athrough Q, complete cds.] [NT:phnE protein] [LE:6227] [RE:7057] [DI:direct]

| ORF Name | NT ID | AA ID | NT LN | AA LN | Score | P-Value |
|---|---|---|---|---|---|---|
| AI7503000985__23642942__c3__2087 | 994 | 4766 | 231 | 76 | | |

Description
NO-HIT

| ORF Name | NT ID | AA ID | NT LN | AA LN | Score | P-Value |
|---|---|---|---|---|---|---|
| AI7503000985__23649187__c3__2050 | 995 | 4767 | 2637 | 878 | 227 | 9.2e−15 |

Description
gp:[GI:g4049717] [LN:AF063866] [AC:AF063866] [PN:ORF MSV156 hypothetical
protein] [GN:MSV156] [OR:Melanoplus sanguinipes entomopoxvirus]
[DB:genpept-vrl] [DE:Melanoplus sanguinipes entomopoxvirus, complete
genome.] [LE:140126] [RE:143509] [DI:direct]

| ORF Name | NT ID | AA ID | NT LN | AA LN | Score | P-Value |
|---|---|---|---|---|---|---|
| AI7503000985__23672518__f3__1031 | 996 | 4768 | 1011 | 336 | 529 | 6.5e−51 |

Description
pir:[LN:F69659] [AC:F69659] [PN:molybdopterin biosynthesis protein moeB]
[GN:moeB] [OR:*Bacillus subtilis*] [DB:pir2] >gp:[GI:e1185017:g2633798]
[LN:BSUB0008] [AC:Z99111:AL009126] [PN:molybdopterin biosynthesis protein]
[GN:moeB] [OR:*Bacillus subtilis*] [DB:genpept-bct1] [DE:*Bacillus subtilis*
complete genome (section 8 of 21):from 1394791 to 1603020.] [LE:100770]
[RE:101789] [DI:direct] >gp:[GI:g3282111] [LN:AF012285]
[AC:AF012285:AF012284:U51911] [PN:molybdopterin biosynthesis protein MoeB]
[GN:moeB] [OR:*Bacillus subtilis*] [DB:genpept-bct2] [DE:*Bacillus subtilis*
mobA-nprE gene region.] [NT:member of the moeB/hesA/thiF family; similar to]
[LE:1258] [RE:2277] [DI:direct]

| ORF Name | NT ID | AA ID | NT LN | AA LN | Score | P-Value |
|---|---|---|---|---|---|---|
| AI7503000985__23680300__f1__300 | 997 | 4769 | 948 | 315 | | |

Description
NO-HIT

| ORF Name | NT ID | AA ID | NT LN | AA LN | Score | P-Value |
|---|---|---|---|---|---|---|
| AI7503000985__23710811__c1__1425 | 998 | 4770 | 159 | 52 | | |

Description
NO-HIT

| ORF Name | NT ID | AA ID | NT LN | AA LN | Score | P-Value |
|---|---|---|---|---|---|---|
| AI7503000985__23828253__f1__81 | 999 | 4771 | 156 | 51 | | |

Description
NO-HIT

-continued

| ORF Name | NT ID | AA ID | NT LN | AA LN | Score | P-Value |
|---|---|---|---|---|---|---|
| AI7503000985__23866552__f2__815 | 1000 | 4772 | 141 | 46 | | |

Description
NO-HIT

| ORF Name | NT ID | AA ID | NT LN | AA LN | Score | P-Value |
|---|---|---|---|---|---|---|
| AI7503000985__23868887__c2__1828 | 1001 | 4773 | 189 | 62 | | |

Description
NO-HIT

| ORF Name | NT ID | AA ID | NT LN | AA LN | Score | P-Value |
|---|---|---|---|---|---|---|
| AI7503000985__24015687__c1__1476 | 1002 | 4774 | 1521 | 506 | 2197 | 1.1e−227 |

Description
gp:[GI:g4574120] [LN:AF009415] [AC:AF009415] [PN:glycine betaine aldehyde dehydrogenase] [GN:cudA] [OR:*Staphylococcus xylosus*] [DB:genpept-bct2] [DE:*Staphylococcus xylosus* choline transporter (cudT), putative regulatory protein (cudC), glycine betaine aldehyde dehydrogenase (cudA), and choline dehydrogenase (cudB) genes, complete cds.] [NT:CudA] [LE:3363] [RE:4856] [DI:direct]

| ORF Name | NT ID | AA ID | NT LN | AA LN | Score | P-Value |
|---|---|---|---|---|---|---|
| AI7503000985__24019026__f1__390 | 1003 | 4775 | 156 | 51 | | |

Description
NO-HIT

| ORF Name | NT ID | AA ID | NT LN | AA LN | Score | P-Value |
|---|---|---|---|---|---|---|
| AI7503000985__24022177__c1__1575 | 1004 | 4776 | 1389 | 462 | 1499 | 1.1e−153 |

Description
sp:[LN:GNTP_BACSU] [AC:P12012] [GN:GNTP] [OR:*BACILLUS SUBTILIS*] [DE:GLUCONATE PERMEASE] [SP:P12012] [DB:swissprot] >pir:[LN:A26190] [AC:A26190:D69636] [PN:gluconate permease gntp] [GN:gntP] [CL:D-serine permease] [OR:*Bacillus subtilis*] [DB:pir2] >gp:[GI:d1022427:g563931] [LN:AB005554] [AC:AB005554:D45242:D31629] [PN:gluconate permease] [GN:gntP] [OR:*Bacillus subtilis*] [SR:*Bacillus subtilis* (strain:BGSC 1A1) DNA] [DB:genpept-bct1] [DE:*Bacillus subtilis* genomic DNA, 36 kb region between gnt and ioloperons.] [NT:homologs are found in *E. coli* and *H. influenzae*;] [LE:1607] [RE:2953] [DI:complement] >gp:[GI:g143016] [LN:BACGNT] [AC:J02584:M24505] [PN:permease] [OR:*Bacillus subtilis*] [SR:*Bacillus subtilis* (strain Marburg 168) DNA] [DB:genpept-bct1] [DE:*B. subtilis* (gluconate operon) gntR, gntK and gntP genes encoding gnt repressor, gluconate kinase and permease, and gntZ gene.] [LE:2530] [RE:3876] [DI:direct] >gp:[GI:e1184733:g2636554] [LN:BSUB0021] [AC:Z99124:AL009126] [PN:gluconate permease] [GN:gntP] [FN:gluconate utilization] [OR:*Bacillus subtilis*] [DB:genpept-bct1] [DE:*Bacillus subtilis* complete genome (section 21 of 21):from 3999281 to 4214814.] [SP:P12012] [LE:115639] [RE:116985] [DI:direct]

| ORF Name | NT ID | AA ID | NT LN | AA LN | Score | P-Value |
|---|---|---|---|---|---|---|
| AI7503000985__24070155__f2__878 | 1005 | 4777 | 495 | 164 | 280 | 1.6e-24 |

Description
pir:[LN:A69849] [AC:A69849] [PN:hypothetical protein yjdF] [GN:yjdF] [OR:*Bacillus subtilis*] [DB:pir2] >gp:[GI:e1183223:g2633557] [LN:BSUB0007] [AC:Z99110:AL009126] [GN:yjdF] [FN:unknown] [OR:*Bacillus subtilis*] [DB:genpept-bct1] [DE:*Bacillus subtilis* complete genome (section 7 of 21): from 1194391 to 1411140.] [LE:80891] [RE:81373] [DI:direct]

| ORF Name | NT ID | AA ID | NT LN | AA LN | Score | P-Value |
|---|---|---|---|---|---|---|
| AI7503000985__24087760__c2__1742 | 1006 | 4778 | 903 | 300 | 665 | 2.5e-65 |

Description
pir:[LN:F69997] [AC:F69997] [PN:hypothetical protein ytnM] [GN:ytnM]

-continued

[OR:*Bacillus subtilis*] [DB:pir2] >gp:[GI:e1184177:g2635393] [LN:BSUB0015]
[AC:Z99118:AL009126] [GN:ytnM] [FN:unknown] [OR:*Bacillus subtilis*]
[DB:genpept-bct1] [DE:*Bacillus subtilis* complete genome (section 15 of 21):
from 2795131 to 3013540.] [LE:202739] [RE:203641] [DI:complement]
>gp:[GI:e1185801:g2635412] [LN:BSUB0016] [AC:Z99119:AL009126] [GN:ytnM]
[FN:unknown] [OR:*Bacillus subtilis*] [DB:genpept-bct1] [DE:*Bacillus subtilis*
complete genome (section 16 of 21):from 2997771 to 3213410.] [LE:99]
[RE:1001] [DI:complement] >gp:[GI:g2293257] [LN:AF008220] [AC:AF008220]
[PN:YtnM] [GN:ytnM] OR:*Bacillus subtilis*] [DB:genpept-bct2] [DE:*Bacillus
subtilis* rrnB-dnaB genomic region.] [NT:similar to a hypothetical protein]
[LE:179426] [RE:180328] [DI:direct]

| ORF Name | NT ID | AA ID | NT LN | AA LN | Score | P-Value |
|---|---|---|---|---|---|---|
| AI7503000985__24095327__c2__1770 | 1007 | 4779 | 135 | 44 | | |

Description
NO-HIT

| ORF Name | NT ID | AA ID | NT LN | AA LN | Score | P-Value |
|---|---|---|---|---|---|---|
| AI7503000985__24101701__c1__1485 | 1008 | 4780 | 1542 | 513 | 1542 | 2.9e-158 |

Description
gp:[GI:d1039113:g4514332] [LN:AB013369] [AC:AB013369] [OR:*Bacillus
halodurans*] [SR:*Bacillus halodurans* (strain:C-125) DNA] [DB:genpept-bct1]
[DE:*Bacillus halodurans* C-125 yesT and comEC genes, partial and complete
cds.] [NT:unknown] [LE:4328] [RE:5830] [DI:direct]

| ORF Name | NT ID | AA ID | NT LN | AA LN | Score | P-Value |
|---|---|---|---|---|---|---|
| AI7503000985__24220260__c3__2109 | 1009 | 4781 | 1056 | 351 | 121 | 0.00034 |

Description
gp:[GI:e316518:g2230824] [LN:DDSTATFIR] [AC:Y13097] [PN:STAT protein]
[GN:dstA] [FN:regulates stalk cell differentiation] [OR:*Dictyostelium
discoideum*] [DB:genpept-inv1] [DE:*D. discoideum* mRNA for stat protein, first
finger stage.] [LE:507] [RE:2630] [DI:direct]

| ORF Name | NT ID | AA ID | NT LN | AA LN | Score | P-Value |
|---|---|---|---|---|---|---|
| AI7503000985__24220290__f2__582 | 1010 | 4782 | 1482 | 493 | 935 | 6.2e-94 |

Description
sp:[LN:ALDA__ECOLI] [AC:P25553] [GN:ALDA:ALD] [OR:*ESCHERICHIA COLI*]
[EC:1.2.1.22] [DE:ALDEHYDE DEHYDROGENASE A, (LACTALDEHYDE DEHYDROGENASE)]
[SP:P25553] [DB:swissprot]

| ORF Name | NT ID | AA ID | NT LN | AA LN | Score | P-Value |
|---|---|---|---|---|---|---|
| AI7503000985__24224037__c2__1825 | 1011 | 4783 | 144 | 47 | | |

Description
NO-HIT

| ORF Name | NT ID | AA ID | NT LN | AA LN | Score | P-Value |
|---|---|---|---|---|---|---|
| AI7503000985__24225015__f3__1098 | 1012 | 4784 | 168 | 55 | | |

Description
NO-HIT

| ORF Name | NT ID | AA ID | NT LN | AA LN | Score | P-Value |
|---|---|---|---|---|---|---|
| AI7503000985__24225015__f3__1127 | 1013 | 4785 | 141 | 46 | | |

Description
NO-HIT

| ORF Name | NT ID | AA ID | NT LN | AA LN | Score | P-Value |
|---|---|---|---|---|---|---|
| AI7503000985__24226577__c3__2184 | 1014 | 4786 | 834 | 277 | 153 | 9.4e-11 |

Description
sp:[LN:MERR__BACSR] [AC:P22853] [GN:MERR] [OR:*BACILLUS* SP] [SR:RC607,]
[DE:MERCURIC RESISTANCE OPERON REGULATORY PROTEIN] [SP:P22853]
[DB:swissprot] >pir:[LN:A32227] [AC:A32227] [PN:hypothetical protein 1 (mer
operon)] [CL:transcription repressor glnR] [OR:*Bacillus* sp.] [DB:pir2]
>gp:[GI:e301549:g2995399] [LN:BMMERAR2] [AC:Y09907] [PN:regulatory protein]

-continued

[GN:merR] [OR:*Bacillus megaterium*] [DB:genpept-bct1] [DE:*Bacillus megaterium*
ORF2, ORF3, ORF4, merR and merA genes.] [LE:574] [RE:972] [DI:direct]
>gp:[GI:g1129093] [LN:AF138877] [AC:AF138877:M22708:M22709:AH003258]
[PN:mercury resistance operon negative regulator] [GN:merR1] [OR:*Bacillus*
sp. RC607] [DB:genpept-bct2] [DE:*Bacillus* sp. RC607 mercury resistance
operon, complete sequence.] [LE:827] [RE:1225] [DI:direct]

| ORF Name | NT ID | AA ID | NT LN | AA LN | Score | P-Value |
|---|---|---|---|---|---|---|
| AI7503000985_24250177_c1_1630 | 1015 | 4787 | 714 | 237 | 653 | 4.7e-64 |

Description
gp:[GI:e1429599:g4756153] [LN:A67161] [AC:A67161] [FN:NARJ GENE]
[OR:*Staphylococcus carnosus*] [DB:genpept-pat] [DE:Sequence 1 from Patent
EP0805205.] [NT:unnamed protein product] [LE:9374] [RE:9949] [DI:direct]
>gp:[GI:g3929524] [LN:AF029224] [AC:AF029224:AF029225] [PN:NarJ] [GN:narJ]
[OR:*Staphylococcus carnosus*] [DB genpept-bct2] [DE:*Staphylococcus carnosus*
nir and nar operons, complete sequences.] [NT:similar to *Escherichia coli*
nitrate reductases NRA] [LE:11559] [RE:12134] [DI:direct]

| ORF Name | NT ID | AA ID | NT LN | AA LN | Score | P-Value |
|---|---|---|---|---|---|---|
| AI7503000985_24251251_c2_1868 | 1016 | 4788 | 129 | 42 | | |

Description
NO-HIT

| ORF Name | NT ID | AA ID | NT LN | AA LN | Score | P-Value |
|---|---|---|---|---|---|---|
| AI7503000985_24251400_f2_508 | 1017 | 4789 | 792 | 263 | 721 | 2.9e-71 |

Description
gp:[GI:g1854577] [LN:STALYTS] [AC:L42945] [GN:lytR] [OR:*Staphylococcus
aureus*] [DB:genpept-bct1] [DE:*Staphylococcus aureus* lytS and lytR genes,
complete cds.] [LE:1849] [RE:2589] [DI:direct]

| ORF Name | NT ID | AA ID | NT LN | AA LN | Score | P-Value |
|---|---|---|---|---|---|---|
| AI7503000985_24251635_f3_1143 | 1018 | 4790 | 123 | 40 | | |

Description
NO-HIT

| ORF Name | NT ID | AA ID | NT LN | AA LN | Score | P-Value |
|---|---|---|---|---|---|---|
| AI7503000985_24261062_c1_1458 | 1019 | 4791 | 1773 | 590 | 1994 | 3.7e-206 |

Description
pir:[LN:F70040] [AC:F70040] [PN:sulfite reductase homolog yvgQ] [GN:yvgQ]
[CL:sulfite reductase (ferredoxin)] [OR:*Bacillus subtilis*] [DB:pir2]
>gp:[GI:e1186031:g2635856] [LN:BSUB0018] [AC:Z99121:AL009126] [GN:yvgQ]
[FN:unknown] [OR:*Bacillus subtilis*] [DB:genpept-bct1] [DE:*Bacillus subtilis*
complete genome (section 18 of 21):from 3399551 to 3609060.] [NT:similar to
sulfite reductase] [LE:30110] [RE:31825] [DI:complement]

| ORF Name | NT ID | AA ID | NT LN | AA LN | Score | P-Value |
|---|---|---|---|---|---|---|
| AI7503000985_24269812_f1_414 | 1020 | 4792 | 627 | 208 | 285 | 4.7e-25 |

Description
gp:[GI:e1312907:g3355681] [LN:SC1C2] [AC:AL031124] [PN:hypothetical protein
SC1C2.14c] [GN:SC1C2.14c] [OR:*Streptomyces coelicolor*] [DB:genpept-bct1]
[DE:*Streptomyces coelicolor* cosmid 1C2.] [NT:SC1C2.14c, unknown, len:185
aa; similar to] [LE:14959] [RE:15516] [DI:complement]

| ORF Name | NT ID | AA ID | NT LN | AA LN | Score | P-Value |
|---|---|---|---|---|---|---|
| AI7503000985_24273375_c2_1749 | 1021 | 4793 | 600 | 199 | 789 | 1.8e-78 |

Description
gp:[GI:g4574118] [LN:AF009415] [AC:AF009415] [PN:choline transporter]
[GN:cudT] [OR:*Staphylococcus xylosus*] [DB:genpept-bct2] [DE:*Staphylococcus
xylosus* choline transporter (cudT), putative regulatory protein (cudC),
glycine betaine aldehyde dehydrogenase (cudA), and choline dehydrogenase
(cudB) genes, complete cds.] [NT:CudT] [LE:811] [RE:2433] [DI:direct]

| ORF Name | NT ID | AA ID | NT LN | AA LN | Score | P-Value |
|---|---|---|---|---|---|---|
| AI7503000985_24275187_f2_858 | 1022 | 4794 | 129 | 42 | | |

Description
NO-HIT

| ORF Name | NT ID | AA ID | NT LN | AA LN | Score | P-Value |
|---|---|---|---|---|---|---|
| AI7503000985_24303775_f2_444 | 1023 | 4795 | 165 | 54 | | |

Description
NO-HIT

| ORF Name | NT ID | AA ID | NT LN | AA LN | Score | P-Value |
|---|---|---|---|---|---|---|
| AI7503000985_24304187_c2_1728 | 1024 | 4796 | 153 | 50 | | |

Description
NO-HIT

| ORF Name | NT ID | AA ID | NT LN | AA LN | Score | P-Value |
|---|---|---|---|---|---|---|
| AI7503000985_24304712_f1_311 | 1025 | 4797 | 1674 | 557 | 1015 | 2.1e-102 |

Description
sp:[LN:DCIP_ENTCL] [AC:P23234] [GN:IPDC] [OR:ENTEROBACTER CLOACAE]
[EC:4.1.1.74] [DE:(DECARBOXYLASE)] [SP:P23234] [DB:swissprot]
>pir:[LN:S16013] [AC:S16013] [PN:indolepyruvate decarboxylase,]
[CL:acetolactate synthase large chain:thiamine pyrophosphate-binding domain
homology] [OR:Enterobacter cloacae] [EC:4.1.1.-] [DB:pir2]
>gp:[GI:d1014947:g216677] [LN:ENTIPDC] [AC:D90214] [OR:Enterobacter cloacae]
[SR:E. cloacae (strain FERM BP-1529) genomic DNA] [DB:genpept-bct1] [DE:E.
cloacae gene for indolepyruvate decarboxylase.] [NT:indolepyruvate
decarboxylase] [LE:31] [RE:1689] [DI:direct]

| ORF Name | NT ID | AA ID | NT LN | AA LN | Score | P-Value |
|---|---|---|---|---|---|---|
| AI7503000985_24333286_f2_802 | 1026 | 4798 | 126 | 41 | | |

Description
NO-HIT

| ORF Name | NT ID | AA ID | NT LN | AA LN | Score | P-Value |
|---|---|---|---|---|---|---|
| AI7503000985_24337791_c3_2068 | 1027 | 4799 | 1113 | 370 | | |

Description
NO-HIT

| ORF Name | NT ID | AA ID | NT LN | AA LN | Score | P-Value |
|---|---|---|---|---|---|---|
| AI7503000985_24337807_c3_2076 | 1028 | 4800 | 1890 | 629 | 1795 | 4.6e-185 |

Description
pir:[LN:G70040] [AC:G70040] [PN:sulfite reductase homolog yvgR] [GN:yvgR]
[CL:sulfite reductase (NADPH):flavodoxin homology:NADPH--ferrihemoprotein
reductase homology] [OR:Bacillus subtilis] [DB:pir2]
>gp:[GI:e1186032:g2635857] [LN:BSUB0018] [AC:Z99121:AL0091261] [GN:yvgR]
[FN:unknown] [OR:Bacillus subtilis] [DB:genpept-bct1] [DE:Bacillus subtilis
complete genome (section 18 of 21):from 3399551 to 3609060.] [NT:similar to
sulfite reductase] [LE:31851] [RE:33668] [DI:complement]

| ORF Name | NT ID | AA ID | NT LN | AA LN | Score | P-Value |
|---|---|---|---|---|---|---|
| AI7503000985_24338217_c2_1747 | 1029 | 4801 | 597 | 198 | 372 | 2.8e-34 |

Description
gp:[GI:g4098082] [LN:LLU73336] [AC:U73336] [PN:anaerobic ribonucleotide
reductase activator] [GN:nrdG] [OR:Lactococcus lactis] [DB:genpept-bct2]
[DE:Lactococcus lactis anaerobic ribonucleotide reductase (nrdD)
and anaerobic ribonucleotide reductase activator protein (nrdG)
genes, complete cds.] [NT:NrdG] [LE:2413] [RE:3012] [DI:direct]

| ORF Name | NT ID | AA ID | NT LN | AA LN | Score | P-Value |
|---|---|---|---|---|---|---|
| AI7503000985_24351562_f3_1230 | 1030 | 4802 | 255 | 84 | | |

Description

-continued

NO-HIT

| ORF Name | NT ID | AA ID | NT LN | AA LN | Score | P-Value |
|---|---|---|---|---|---|---|
| AI7503000985__24353390__c2__1882 | 1031 | 4803 | 696 | 231 | 421 | 1.8e-39 |

Description
pir:[LN:S76993] [AC:S76993] [PN:hypothetical protein] [CL:ribitol
dehydrogenase:short-chain alcohol dehydrogenase homology] [OR:*Synechocystis*
sp.] [SR:PCC 6803, , PCC 6803] [SR:PCC 6803, ] [DB:pir2]
>gp:[GI:d1011336:g1001805] [LN:SYCSLRG] [AC:D64005:AB001339]
[PN:hypothetical protein] [OR:*Synechocystis* sp.] [SR:*Synechocystis* sp.
(strain:PCC6803) DNA] [DB:genpept-bct1] [DE:*Synechocystis* sp. PCC6803
complete genome, 24/27, 3002966–3138603.] [NT:ORF__ID:slr0315] [LE:34344]
[RE:35078] [DI:direct]

| ORF Name | NT ID | AA ID | NT LN | AA LN | Score | P-Value |
|---|---|---|---|---|---|---|
| AI7503000985__24353392__c2__1954 | 1032 | 4804 | 2409 | 802 | 3358 | 0.0 |

Description
gp:[GI:e1429587:g4756149] [LN:A67161] [AC:A67161] [FN:NIRB GENE]
[OR:*Staphylococcus carnosus*] [DB:genpept-pat] [DE:Sequence 1 from Patent
EP0805205.] [NT:unnamed protein product] [LE:181] [RE:2586] [DI:direct]
>gp:[GI:g4433639] [LN:AF029224] [AC:AF029224:AF029225] [PN:NirB] [GN:nirB]
[OR:*Staphylococcus carnosus*] [DB:genpept-bct2] [DE:*Staphylococcus carnosus*
nir and nar operons, complete sequences.] [NT:similar to *Escherichia coli*
NADH-dependent nitrite] [LE:2366] [RE:4771] [DI:direct]

| ORF Name | NT ID | AA ID | NT LN | AA LN | Score | P-Value |
|---|---|---|---|---|---|---|
| AI7503000985__24406542__f3__1293 | 1033 | 4805 | 339 | 112 | 513 | 3.2e-49 |

Description
gp:[GI:g2914128] [LN:SEU43366] [AC:U43366] [PN:IcaD] [GN:icaD]
[OR:*Staphylococcus epidermidis*] [DB:genpept-bct2] [DE:*Staphylococcus
epidermidis* operon mediating intercellular adhesion:IcaR, IcaA, IcaD, IcaB,
and IcaC genes, complete cds.] [LE:1963] [RE:2268] [DI:direct]

| ORF Name | NT ID | AA ID | NT LN | AA LN | Score | P-Value |
|---|---|---|---|---|---|---|
| AI7503000985__24406952__c1__1434 | 1034 | 4806 | 447 | 148 | 188 | 8.9e-15 |

Description
sp:[LN:PETP__RHOCA] [AC:P31078] [GN:PETP] [OR:*RHODOBACTER CAPSULATUS*]
[SR:,*RHODOPSEUDOMONAS CAPSULATA*] [DE:PETP PROTEIN] [SP:P31078]
[DB:swissprot] >pir:[LN:S22631] [AC:S22631:S21001] [PN:petP protein]
[GN:petP] [OR:*Rhodobacter capsulatus*] [DB:pir2] >gp:[GI:e49248:g1333802]
[LN:RCPETPR] [AC:Z12113:S42067] [PN:protein of unknown function] [GN:petP]
[OR:*Rhodobacter capsulatus*] [DB:genpept-bct1] [DE:*R. capsulatus* petP, petR,
and fbcF genes.] [NT:part of the petPR operon in front of fbc operon]
[SP:P31078] [LE:199] [RE:699] [DI:direct]

| ORF Name | NT ID | AA ID | NT LN | AA LN | Score | P-Value |
|---|---|---|---|---|---|---|
| AI7503000985__24415887__c2__1761 | 1035 | 4807 | 927 | 308 | 123 | 2.7e-05 |

Description
gp:[GI:g3955198] [LN:AF022796] [AC:AF022796] [PN:ModA] [GN:modA]
[OR:*Staphylococcus carnosus*] [DB:genpept-bct2] [DE:*Staphylococcus carnosus*
molybdenum cofactor biosynthetic genecluster, complete sequence.]
[NT:molybdate-binding lipoprotein of the] [LE:109] [RE:894] [DI:direct]

| ORF Name | NT ID | AA ID | NT LN | AA LN | Score | P-Value |
|---|---|---|---|---|---|---|
| AI7503000985__24416068__c1__1624 | 1036 | 4808 | 549 | 182 | 528 | 8.3e-51 |

Description
pir:[LN:C69996] [AC:C69996] [PN:conserved hypothetical protein ytmI]
[GN:ytmI] [OR:*Bacillus subtilis*] [DB:pir2] >gp:[GI:e1184188:g2635404]
[LN:BSUB0015] [AC:Z99118:AL009126] [GN:ytmI] [FN:unknown] [OR:*Bacillus
subtilis*] [DB:genpept-bct1] [DE:*Bacillus subtilis* complete genome (section
15 of 21):from 2795131 to 3013540.] [NT:similar to hypothetical proteins
from *B. subtilis*] [LE:212192] [RE:212728] [DI:complement]
>gp:[GI:e1185812:g2635423] [LN:BSUB0016] [AC:Z99119:AL009126] [GN:ytmI]
[FN:unknown] [OR:*Bacillus subtilis*] [DB:genpept-bct1] [DE:*Bacillus subtilis*
complete genome (section 16 of 21):from 2997771 to 3213410.] [NT:similar to
hypothetical proteins from *B. subtilis*] [LE:9552] [RE:10088] [DI:complement]
>gp:[GI:g2293246] [LN:AF008220] [AC:AF008220] [PN:YtmI] [GN:ytmI]

-continued

[OR:*Bacillus subtilis*] [DB:genpept-bct2] [DE:*Bacillus subtilis* rrnB-dnaB
genomic region.] [NT:similar to a hypothetical 19 kD protein from B.]
[LE:170339] [RE:170875] [DI:direct]

| ORF Name | NT ID | AA ID | NT LN | AA LN | Score | P-Value |
|---|---|---|---|---|---|---|
| AI7503000985_24421937_c3_1999 | 1037 | 4809 | 1269 | 422 | 778 | 2.7e-77 |

Description
pir:[LN:B69801] [AC:B69801] [PN:chloramphenicol resistance protein homolog
yfhI] [GN:yfhI] [CL:*Streptomyces lividans* chloramphenicol resistance
protein] [OR:*Bacillus subtilis*] [DB:pir2] >gp:[GI:e1182844:g2633178]
[LN:BSUB0005] [AC:Z99108:AL009126] [GN:yfhI] [FN:unknown] [OR:*Bacillus
subtilis*] [DB:genpept-bct1] [DE:*Bacillus subtilis* complete genome (section 5
of 21):from 802821 to 1011250.] [NT:similar to antibiotic resistance
protein] [LE:123573] [RE:124766] [DI:direct]

| ORF Name | NT ID | AA ID | NT LN | AA LN | Score | P-Value |
|---|---|---|---|---|---|---|
| AI7503000985_24429663_c1_1444 | 1038 | 4810 | 933 | 310 | 326 | 2.1e-29 |

Description
sp:[LN:YXDK_BACSU] [AC:P42422] [GN:YXDK:B65E] [OR:*BACILLUS SUBTILIS*]
[EC:2.7.3.-] [DE:(EC 2.7.3.-)] [SP:P42422] [DB:swissprot] >pir:[LN:H70073]
[AC:H70073] [PN:two-component sensor histidine kinase homolog yxdK]
[GN:yxdK] [OR:*Bacillus subtilis*] [DB:pir2] >gp:[GI:d1003811:g709992]
[LN:BACIOLO] [AC:D14399] [PN:hypothetical protein] [GN:B65E] [OR:*Bacillus
subtilis*] [SR:*Bacillus subtilis* (strain:BGSC 1A1 (168 trpC2)) DNA]
[DB:genpept-bct1] [DE:*Bacillus subtilis* 15 kb chromosome segment contains
the iol operon.] [NT:homologous to sensor protein BVgC, His protein]
[LE:11893] [RE:12870] [DI:direct] >gp:[GI:e1184690:g2636511] [LN:BSUB0021]
[AC:Z99124:AL009126] [GN:yxdK] [FN:unknown] [OR:*Bacillus subtilis*]
[DB:genpept-bct1] [DE:*Bacillus subtilis* complete genome (section 21 of 21):
from 3999281 to 4214814.] [NT:similar to two-component sensor histidine
kinase] [SP:P42422] [LE:70819] [RE:71796] [DI:complement]

| ORF Name | NT ID | AA ID | NT LN | AA LN | Score | P-Value |
|---|---|---|---|---|---|---|
| AI7503000985_24432327_c2_1777 | 1039 | 4811 | 1665 | 554 | 1633 | 6.7e-168 |

Description
gp:[GI:g473902] [LN:LACALS] [AC:L16975] [PN:alpha-acetolactate synthase]
[GN:als] [OR:*Lactococcus lactis*] [SR:*Lactococcus lactis* (strain DSM 20384,
sub_species lactis) DNA] [DB:genpept-bct1] [DE:*Lactococcus lactis*
alpha-acetolactate synthase (als) gene, complete cds.] [LE:1232] [RE:2896]
[DI:direct] >gp:[GI:g809618] [LN:A23961] [AC:A23961] [PN:alpha-acetolactate
synthase] [OR:*Lactococcus lactis*] [DB:genpept-pat] [DE:*L. lactis*
alpha-acetolactate synthase gene.] [LE:550] [RE:2214] [DI:direct]

| ORF Name | NT ID | AA ID | NT LN | AA LN | Score | P-Value |
|---|---|---|---|---|---|---|
| AI7503000985_24500300_c1_1462 | 1040 | 4812 | 1206 | 401 | 1208 | 7.3e-123 |

Description
pir:[LN:B69877] [AC:B69877] [PN:sulfate adenylyltransferase homolog ylnB]
[GN:ylnB] [CL:*Synechocystis* sulfate adenylyltransferase:sulfate
adenylyltransferase homology] [OR:*Bacillus subtilis*] [DB:pir2]
>gp:[GI:e332185:g2462958] [LN:BSPYREYLO] [AC:AJ000974] [PN:putative sulfate
adenylyltransferase] [GN:ylnB] [OR:*Bacillus subtilis*] [DB:genpept-bct1]
[DE:*Bacillus subtilis* pyrE to yloA gene region.] [LE:2374] [RE:3522]
[DI:direct] >gp:[GI:e1185151:g2633932] [LN:BSUB0009] [AC:Z99112:AL009126]
[GN:ylnB] [FN:unknown] [OR:*Bacillus subtilis*] [DB:genpept-bct1] [DE:*Bacillus
subtilis* complete genome (section 9 of 21):from 1598421 to 1807200.]
[NT:similar to sulfate adenylyltransferase] [LE:33187] [RE:34335]
[DI:direct]

| ORF Name | NT ID | AA ID | NT LN | AA LN | Score | P-Value |
|---|---|---|---|---|---|---|
| AI7503000985_245443_c1_1548 | 1041 | 4813 | 696 | 231 | 375 | 1.4e-34 |

Description
pir:[LN:F69879] [AC:F69879] [PN:phosphoglycerate dehydrogenase homolog
yloW] [GN:yloW] [OR:*Bacillus subtilis*] [DB:pir2] >gp:[GI:e1185176:g2633957]
[LN:BSUB0009] [AC:Z99112:AL009126] [GN:yloW] [FN:unknown] [OR:*Bacillus
subtilis*] [DB:genpept-bct1] [DE:*Bacillus subtilis* complete genome (section 9
of 21):from 1598421 to 1807200.] [NT:similar to phosphoglycerate
dehydrogenase] [LE:59221] [RE:59883] [DI:direct] >gp:[GI:e323511:g2337814]
[LN:BSY13937] [AC:Y13937] [PN:putative YhaQ protein] [GN:yloW] [FN:unknown]
[OR:*Bacillus subtilis*] [DB:genpept-bct1] [DE:*Bacillus subtilis* genomic DNA -continued from the spoVM region.] [LE:20993] [RE:21655] [DI:direct]

| ORF Name | NT ID | AA ID | NT LN | AA LN | Score | P-Value |
|---|---|---|---|---|---|---|
| AI7503000985__24611567__c2__1831 | 1042 | 4814 | 1074 | 357 | 478 | 1.7e-45 |

Description
pir:[LN:S36209] [AC:S36209] [PN:dep protein precursor] [GN:dep]
[OR:*Bacillus anthracis*] [DB:pir2] >gp:[GI:d1003632:g436034] [LN:BACDEP]
[AC:D14037] [PN:ORF] [GN:dep] [OR:*Bacillus anthracis*] [SR:*Bacillus anthracis*
(strain:Davis) plasmid:pTE702 DNA] [DB:genpept-bct1] [DE:*Bacillus anthracis*
plasmid pTE702 dep gene for ORF, complete cds.] [LE:252] [RE:1652]

| ORF Name | NT ID | AA ID | NT LN | AA LN | Score | P-Value |
|---|---|---|---|---|---|---|
| AI7503000985__24617025__c1__1339 | 1043 | 4815 | 243 | 80 | | |

Description
NO-HIT

| ORF Name | NT ID | AA ID | NT LN | AA LN | Score | P-Value |
|---|---|---|---|---|---|---|
| AI7503000985__24617262__c1__1501 | 1044 | 4816 | 825 | 274 | 690 | 5.7e-68 |

Description
sp:[LN:PANB_BACSU] [AC:P52996] [GN:PANB] [OR:*BACILLUS SUBTILIS*]
[EC:2.1.2.11] [DE:(KETOPANTOATE HYDROXYMETHYLTRANSFERASE)] [SP:P52996]
[DB:swissprot] >pir:[LN:G69671] [AC:G69671] [PN:ketopantoate
hydroxymethyltransferase panB] [GN:panB] [CL:3-methyl-2-oxobutanoate
hydroxymethyltransferase] [OR:*Bacillus subtilis*] [DB:pir2] >gp:[GI:g1146240]
[LN:BACYPIA] [AC:L47709] [PN:ketopantoate hydroxymethyltransferase]
[GN:panB] [FN:pantothenic acid biosynthesis] [OR:*Bacillus subtilis*]
[DB:genpept-bct1] [EC:2.1.2.11] [DE:*Bacillus subtilis* (clone YAC15-6B)
ypiABF genes, qcrABC genes, ypjABCDEFGHI genes, birA gene, panBCD genes, dinG
gene, ypmB gene, aspB gene, asnS gene, dnaD gene, nth gene and ypoC gene,
complete cds's.] [NT:47.1% of identity to the 3-methyl-2-oxobutanoate]
[LE:13293] [RE:14126] [DI:direct] >gp:[GI:e1183688:g2634661] [LN:BSUB0012]
[AC:Z99115:AL009126] [PN:ketopantoate hydroxymethyltransferase] [GN:panB]
[FN:pantothenate biosynthesis] [OR:*Bacillus subtilis*] [DB:genpept-bct1]
[EC:2.1.2.11] [DE:*Bacillus subtilis* complete genome (section 12 of 21):from
2195541 to 2409220.] [SP:P52996] [LE:157541] [RE:158374] [DI:complement]

| ORF Name | NT ID | AA ID | NT LN | AA LN | Score | P-Value |
|---|---|---|---|---|---|---|
| AI7503000985__24640910__c2__1654 | 1045 | 4817 | 519 | 172 | | |

Description
NO-HIT

| ORF Name | NT ID | AA ID | NT LN | AA LN | Score | P-Value |
|---|---|---|---|---|---|---|
| AI7503000985__24641932__c2__1734 | 1046 | 4818 | 672 | 223 | 500 | 7.7e-48 |

Description
gp:[GI:g4104595] [LN:AF036964] [AC:AF036964] [PN:putative response
regulator] [GN:rrp1] [OR:*Lactobacillus sakei*] [DB:genpept-bct2]
[DE:*Lactobacillus sake* putative response regulator (rrp1) and
putative histidine kinase (hpk1) genes, complete cds.] [NT:Rrp1; member of a
two-component regulatory system] [LE:2112] [RE:2786] [DI:direct]

| ORF Name | NT ID | AA ID | NT LN | AA LN | Score | P-Value |
|---|---|---|---|---|---|---|
| AI7503000985__24643930__c3__2138 | 1047 | 4819 | 696 | 231 | 399 | 3.9e-37 |

Description
sp:[LN:YOHK_ECOLI] [AC:P33373] [GN:YOHK] [OR:*ESCHERICHIA COLI*]
[DE:HYPOTHETICAL 24.5 KD PROTEIN IN PBPG-CDD INTERGENIC REGION] [SP:P33373]
[DB:swissprot] >pir:[LN:E64982] [AC:E64982] [PN:yohK protein] [GN:yohK]
[CL:yohK protein] [OR:*Escherichia coli*] [DB:pir2] >gp:[GI:g1788464]
[LN:AE000303] [AC:AE000303:U00096] [PN:putative seritonin transporter]
[GN:yohK] [FN:putative transport; Not classified] [OR:*Escherichia coli*]
[DB:genpept-bct2] [DE:*Escherichia coli* K-12 MG1655 section 193 of 400 of the
complete genome.] [NT:o231; residues 10295 are 100 pct identical to]
[LE:6088] [RE:6783] [DI:direct]

| ORF Name | NT ID | AA ID | NT LN | AA LN | Score | P-Value |
|---|---|---|---|---|---|---|
| AI7503000985__24646963__c3__2072 | 1048 | 4820 | 1350 | 449 | 1703 | 2.6e-175 |

-continued

Description
gp:[GI:e315090:g2791905] [LN:SSK3MECA1] [AC:Y13052] [GN:ORF454]
[OR:*Staphylococcus sciuri*] [DB:genpept-bct1] [DE:*S. sciuri* mecA1 gene, strain
K3(MM2).] [LE:4208] [RE:5572] [DI:direct]

| ORF Name | NT ID | AA ID | NT LN | AA LN | Score | P-Value |
|---|---|---|---|---|---|---|
| AI7503000985_24648377_c3_2261 | 1049 | 4821 | 1146 | 381 | 1301 | 1.0e-132 |

Description
gp:[GI:e1429613:g4756156] [LN:A67169] [AC:A67169] [PN:NART GENE] [FN:NITRATE
TRANSPORT] [OR:*Staphylococcus carnosus*] [DB:genpept-pat] [DE:Sequence 9 from
Patent EP0805205.] [LE:538] [RE:1704] [DI:direct] >gp:[GI:g2529402]
[LN:SCU40014] [AC:U40014] [PN:nitrate transporter] [GN:narT]
[OR:*Staphylococcus carnosus*] [SR:*Staphylococcus carnosus* strain = TM300]
[DB:genpept-bct2] [DE:*Staphylococcus carnosus* nitrate transporter (narT)
gene, complete cds.] [NT:NarT] [LE:90] [RE:1256] [DI:direct]

| ORF Name | NT ID | AA ID | NT LN | AA LN | Score | P-Value |
|---|---|---|---|---|---|---|
| AI7503000985_24648502_c3_2088 | 1050 | 4822 | 468 | 155 | 228 | 5.1e-19 |

Description
sp:[LN:YHGC_BACSU] [AC:P380491] [GN:YHGC] [OR:*BACILLUS SUBTILIS*]
[DE:HYPOTHETICAL 18.8 KD PROTEIN IN ECSC-PBPF INTERGENIC REGION] [SP:P38049]
[DB:swissprot] > pir:[LN:B40614] [AC:B40614:F69832] [PN:conserved
hypothetical protein yhgC:hypothetical protein X (pbpF 5' region)] [GN:yhgC]
[OR:*Bacillus subtilis*] [DB:pir2] >gp:[GI:g304160] [LN:BACPBPF] [AC:L10630]
[OR:*Bacillus subtilis*] [SR:*Bacillus subtilis* (strain W168) DNA]
[DB:genpept-bct1] [DE:*Bacillus subtilis* penicillin-binding protein (pbpF)
gene, 5' end.] [NT:product unknown] [LE:247] [RE:747] [DI:complement]
>gp:[GI:e1183012:g2633346] [LN:BSUB0006] [AC:Z99109:AL009126] [GN:yhgC]
[FN:unknown] [OR:*Bacillus subtilis*] [DB:genpept-bct1] [DE:*Bacillus subtilis*
complete genome (section 6 of 21):from 999501 to 1209940.] [NT:alternate
gene name:yixC; similar to hypothetical] [SP:P38049] [LE:83202] [RE:83702]
[DI:complement] >gp:[GI:e325006:g2226228] [LN:BSY14083] [AC:Y14083]
[PN:Hypothetical protein] [GN:yixC] [OR:*Bacillus subtilis*] [DB:genpept-bct1]
[DE:*Bacillus subtilis* chromosomal DNA, region 76–78 degrees:
between glyB–aprE.] [NT:See Swiss Prot P38049; YIXC_BACSU] [SP:P38049]
[LE:3061] [RE:3561] [DI:complement]

| ORF Name | NT ID | AA ID | NT LN | AA LN | Score | P-Value |
|---|---|---|---|---|---|---|
| AI7503000985_24648551_f2_791 | 1051 | 4823 | 174 | 57 | 108 | 6.6e-06 |

Description
gp:[GI:g1022725] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF2] [LE:394] [RE:1083] [DI:complement] >gp:[GI:g295162] [LN:STAMECRA]
[AC:L14017] [OR:*Staphylococcus aureus*] [SR:*Staphylococcus aureus* (strain
COL) DNA] [DB:genpept-bct1] [DE:*Staphylococcus aureus* methicillin-resistance
protein (mecR) gene and unknown ORF, complete cds.] [NT:unknown ORF1;
putative] [LE:1492] [RE:2181] [DI:complement]

| ORF Name | NT ID | AA ID | NT LN | AA LN | Score | P-Value |
|---|---|---|---|---|---|---|
| AI7503000985_24652312_f1_419 | 1052 | 4824 | 1617 | 538 | 1137 | 2.4e-115 |

Description
gp:[GI:g4835822] [LN:AF102174] [AC:AF102174] [PN:glycine betaine transporter
BetL] [GN:betL] [OR:*Listeria monocytogenes*] [DB:genpept-bct2] [DE:*Listeria
monocytogenes* glycine betaine transporter BetL (betL) gene, complete cds.]
[LE:209] [RE:1732] [DI:direct]

| ORF Name | NT ID | AA ID | NT LN | AA LN | Score | P-Value |
|---|---|---|---|---|---|---|
| AI7503000985_24665957_c3_2149 | 1053 | 4825 | 1494 | 497 | 1335 | 2.5e-136 |

Description
sp:[LN:XYLB_BACSU] [AC:P39211] [GN:XYLB] [OR:*BACILLUS SUBTILIS*]
[EC:2.7.1.17] [DE:XYLULOSE KINASE, (XYLULOKINASE)] [SP:P39211]
[DB:swissprot] >pir:[LN:D69735] [AC:D69735] [PN:xylulose kinase xylB]
[GN:xylB] [CL:xylulokinase] [OR:*Bacillus subtilis*] [DB:pir2]
>gp:[GI:g1750125] [LN:BSU66480] [AC:U66480] [PN:xylulose kinase] [GN:xylB]
[OR:*Bacillus subtilis*] [DB:genpept-bct1] [DE:*Bacillus subtilis* SpoVK
(spoVK), YnbA (ynbA), YnbB (ynbB), GlnR (glnR), glutamine synthetase (glnA),
YnaA (ynaA), YnaB (ynaB), YnaC (ynaC), YnaD (ynaD), YnaE (ynaE), YnaF (ynaF),
YnaG (ynaG), YnaH (ynaH), YnaI (ynaI), YnaJ (ynaJ), xylan beta-1,4-xylosidase -continued (xynB), xylose repressor (xylR), xylose isomerase (xylA), xylulose kinase (xylB), YncB (yncB), YncC (yncC), YncD (yncD) and YncE (yncE) genes, complete cds.] [LE:19399] [RE:20898] [DI:direct] >gp:[GI:e1183420:g2634145] [LN:BSUB0010] [AC:Z99113:AL009126] [PN:xylulose kinase] [GN:xylB] [FN:xylose metabolism] [OR:*Bacillus subtilis*] [DB:genpept-bct1] [EC:2.7.1.17] [DE:*Bacillus subtilis* complete genome (section 10 of 21):from 1781201 to 2014980.] [NT:alternate gene name:yncA] [SP:P39211] [LE:111450] [RE:112949] [DI:direct]

| ORF Name | NT ID | AA ID | NT LN | AA LN | Score | P-Value |
|---|---|---|---|---|---|---|
| AI7503000985__24720257__f1__131 | 1054 | 4826 | 138 | 45 | | |

Description
NO-HIT

| ORF Name | NT ID | AA ID | NT LN | AA LN | Score | P-Value |
|---|---|---|---|---|---|---|
| AI7503000985__24722175__c1__1538 | 1055 | 4827 | 1101 | 366 | 353 | 2.9e-32 |

Description
pir:[LN:H70069] [AC:H70069] [PN:capsular polyglutamate biosynthesis homolog ywtB] [GN:ywtB] [OR:*Bacillus subtilis*] [DB:pir2] >gp:[GI:e1184494:g2636113] [LN:BSUB0019] [AC:Z99122:AL009126] [GN:ywtB] [FN:unknown] [OR:*Bacillus subtilis*] [DB:genpept-bct1] [DE:*Bacillus subtilis* complete genome (section 19 of 21):from 3597091 to 3809700.] [NT:similar to capsular polyglutamate biosynthesis] [LE:99788] [RE:100930] [DI:complement] >gp:[GI:e308090:g1894767] [LN:BSZ92954] [AC:Z92954] [GN:ywtB] [OR:*Bacillus subtilis*] [DB:genpept-bct1] [DE:*B. subtilis* yws [A, B, C, D, E, F, G] and gerBC genes.] [NT:product highly similar to *Bacillus anthracis* CapA] [LE:1552] [RE:2694] [DI:direct] >gp:[GI:e1184494:g2636113] [LN:BSUB0019] [AC:Z99122:AL009126] [GN:ywtB] [FN:unknown] [OR:*Bacilius subtilis*] [DB:genpept] [DE:*Bacillus subtilis* complete genome (section 19 of 21):from 3597091 to 3809700.] [NT:similar to capsular polyglutamate biosynthesis] [LE:99788] [RE:100930] [DI:complement]

| ORF Name | NT ID | AA ID | NT LN | AA LN | Score | P-Value |
|---|---|---|---|---|---|---|
| AI7503000985__24730438__c2__1833 | 1056 | 4828 | 420 | 139 | 374 | 1.7e-34 |

Description
gp:[GI:g4959403] [LN:AF115391] [AC:AF115391] [PN:ribose permease RbsD] [GN:rbsD] [OR:*Lactobacillus sakei*] [DB:genpept-bct2] [DE:*Lactobacillus sakei* LaaA (laaA) gene, partial cds; LaaB (laaB), putative acetate kinase AckA (ackA), LaaC (laaC) genes, complete cds; rbs operon, complete sequence; and LaaE (laaE) gene, partial cds.] [LE:4035] [RE:4430] [DI:direct]

| ORF Name | NT ID | AA ID | NT LN | AA LN | Score | P-Value |
|---|---|---|---|---|---|---|
| AI7503000985__24797140__c2__1871 | 1057 | 4829 | 900 | 299 | 145 | 7.3e-08 |

Description
sp:[LN:ESTE__PSEFL] [AC:P22862] [OR:*PSEUDOMONAS FLUORESCENS*] [EC:3.1.1.2] [DE:ARYLESTERASE, (ARYL-ESTER HYDROLASE)] [SP:P22862] [DB:swissprot]

| ORF Name | NT ID | AA ID | NT LN | AA LN | Score | P-Value |
|---|---|---|---|---|---|---|
| AI7503000985__24797900__c1__1361 | 1058 | 4830 | 213 | 70 | | |

Description
NO-HIT

| ORF Name | NT ID | AA ID | NT LN | AA LN | Score | P-Value |
|---|---|---|---|---|---|---|
| AI7503000985__24812502__c1__1521 | 1059 | 4831 | 126 | 41 | | |

Description
NO-HIT

| ORF Name | NT ID | AA ID | NT LN | AA LN | Score | P-Value |
|---|---|---|---|---|---|---|
| AI7503000985__24814838__c2__1789 | 1060 | 4832 | 870 | 289 | 350 | 6.1e-32 |

Description
pir:[LN:S76790] [AC:S76790] [PN:hypothetical protein] [CL:hypothetical protein b1725] [OR:*Synechocystis* sp.] [SR:PCC 6803, , PCC 6803] [SR:PCC 6803, ] [DB:pir2] >gp:[GI:d1019435:g1653791] [LN:D90916] [AC:D90916:AB001339] [PN:hypothetical protein] [OR:*Synechocystis* sp.] [SR:*Synechocystis* sp. (strain:PCC6803) DNA] [DB:genpept-bct1] [DE:*Synechocystis* sp. PCC6803 complete genome, 26/27, 3270710–3418851.]

-continued

[NT:ORF_ID:s1r1563] [LE:99350] [RE:100237] [DI:direct]

| ORF Name | NT ID | AA ID | NT LN | AA LN | Score | P-Value |
|---|---|---|---|---|---|---|
| AI7503000985_24817202_c1_1512 | 1061 | 4833 | 1809 | 602 | 799 | 2.3e-116 |

Description
pir:[LN:C69975] [AC:C69975] [PN:acyltransferase homolog yrhL] [GN:yrhL]
[OR:*Bacillus subtilis*] [DB:pir2] >gp:[GI:g1934616] [LN:BSU93874] [AC:U93874]
[PN:hypothetical protein YrhL] [GN:yrhL] [OR:*Bacillus subtilis*]
[DB:genpept-bct1] [DE:*Bacillus subtilis* cysteine synthase (yrhA),
cystathioninegamma-lyase (yrhB), YrhC (yrhC), YrhD (yrhD), formate
dehydrogenasechain A (yrhE), YrhF (yrhF), formate dehydrogenase (yrhG),
YrhH (yrhH), regulatory protein (yrhI), cytochrome P450 102 (yrhJ),
YrhK (yrhK), hypothetical protein YrhL (yrhL), putative anti-SigV
factor (yrhM), RNA polymerase sigma factor SigV (sigV) and YrhO (yrhO) genes,
complete cds, and YrhP (yrhP) gene, partial cds.] [NT:similar to *Haemophilus
influenzae* hypothetical] [LE:13904] [RE:15808] [DI:complement]
>gp:[GI:e1183944:g2635160] [LN:BSUB0014] [AC:Z99117:AL009126] [GN:yrhL]
[FN:unknown] [OR:*Bacillus subtilis*] [DB:genpept-bct1] [DE:*Bacillus subtilis*
complete genome (section 14 of 21):from 2599451 to 2812870.] [NT:similar to
acyltransferase] [LE:171138] [RE:173042] [DI:direct]

| ORF Name | NT ID | AA ID | NT LN | AA LN | Score | P-Value |
|---|---|---|---|---|---|---|
| AI7503000985_24855337_c2_1957 | 1062 | 4834 | 693 | 230 | 1003 | 3.8e-101 |

Description
gp:[GI:e1429602:g4756154] [LN:A67161] [AC:A67161] [FN:NARI GENE]
[OR:*Staphylococcus carnosus*] [DB:genpept-pat] [DE:Sequence 1 from Patent
EP0805205.] [NT:unnamed protein product] [LE:9942] [RE:10625] [DI:direct]
>gp:[GI:g3929525] [LN:AF029224] [AC:AF029224:AF029225] [PN:NarI] [GN:narI]
[OR:*Staphylococcus carnosus*] [DB:genpept-bct2] [DE:*Staphylococcus carnosus*
nir and nar operons, complete sequences.] [NT:similar to *Escherichia coli*
nitrate reductases NRA] [LE:12127] [RE:12810] [DI:direct]

| ORF Name | NT ID | AA ID | NT LN | AA LN | Score | P-Value |
|---|---|---|---|---|---|---|
| AI7503000985_250178_c3_2162 | 1063 | 4835 | 234 | 77 | 82 | 0.0015 |

Description
pir:[LN:E70557] [AC:E70557] [PN:hypothetical protein Rv1615] [GN:Rv1615]
[OR:*Mycobacterium tuberculosis*] [DB:pir2] >gp:[GI:e316881:g2113899]
[LN:MTCY01B2] [AC:Z95554:AL123456] [PN:hypothetical protein Rv1615]
[GN:Rv1615] [OR:*Mycobacterium tuberculosis*] [DB:genpept-bct1]
[DE:*Mycobacterium tuberculosis* H37Rv complete genome; segment 72/162.]
[NT:Rv1615, (MTCY01B2.07), len:146. Function:unknown] [LE:7451] [RE:7891]
[DI:direct]

| ORF Name | NT ID | AA ID | NT LN | AA LN | Score | P-Value |
|---|---|---|---|---|---|---|
| AI7503000985_2507950_f1_199 | 1064 | 4836 | 216 | 71 | | |

Description
NO-HIT

| ORF Name | NT ID | AA ID | NT LN | AA LN | Score | P-Value |
|---|---|---|---|---|---|---|
| AI7503000985_251_f1_433 | 1065 | 4837 | 153 | 50 | | |

Description
NO-HIT

| ORF Name | NT ID | AA ID | NT LN | AA LN | Score | P-Value |
|---|---|---|---|---|---|---|
| AI7503000985_25398426_f1_211 | 1066 | 4838 | 198 | 65 | | |

Description
NO-HIT

| ORF Name | NT ID | AA ID | NT LN | AA LN | Score | P-Value |
|---|---|---|---|---|---|---|
| AI7503000985_25413577_f3_1032 | 1067 | 4839 | 129 | 42 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000985__25429700_c2__1683 | 1068 | 4840 | 1356 | 451 | 158 | 1.8e-08 |

Description
gp:[GI:e332306:g2462111] [LN:BCY11138] [AC:Y11138] [GN:ORF1] [OR:*Bacillus cereus*] [DB:genpept-bct1] [DE:*B. cereus* DNA for ORF1, ORF2 and ORF3 (2402 bp).] [NT:shows weak homology to *C. elegans* cosmid C33A12 ORF] [LE:156] [RE:1373] [DI:direct]

| ORF Name | NT ID | AA ID | NT LN | AA LN | Score | P-Value |
|---|---|---|---|---|---|---|
| AI7503000985__25431558_f1__63 | 1069 | 4841 | 705 | 234 | 855 | 1.9e-85 |

Description
gp:[GI:g1575026] [LN:SAU52961] [AC:U52961] [PN:LrgB] [GN:lrgB] [OR:*Staphylococcus aureus*] [SR:*Staphylococcus aureus* strain = NCTC 8325-4] [DB:genpept-bct2] [DE:*Staphylococcus aureus* holin-like protein LrgA (lrgA) and LrgB (lrgB) genes, complete cds.] [NT:LytSR-regulated gene; similar to *E. coli* yohK] [LE:805] [RE:1506] [DI:direct]

| ORF Name | NT ID | AA ID | NT LN | AA LN | Score | P-Value |
|---|---|---|---|---|---|---|
| AI7503000985__25433452_f1__61 | 1070 | 4842 | 1791 | 596 | 1867 | 1.1e-192 |

Description
gp:[GI:g862312] [LN:STALYTS] [AC:L42945] [GN:lytS] [OR:*Staphylococcus aureus*] [DB:genpept-bct1] [DE:*Staphylococcus aureus* lytS and lytR genes, complete cds.] [LE:92] [RE:1846] [DI:direct]

| ORF Name | NT ID | AA ID | NT LN | AA LN | Score | P-Value |
|---|---|---|---|---|---|---|
| AI7503000985__25570262_f1__358 | 1071 | 4843 | 144 | 47 | | |

Description
NO-HIT

| ORF Name | NT ID | AA ID | NT LN | AA LN | Score | P-Value |
|---|---|---|---|---|---|---|
| AI7503000985__25578215_c2__1740 | 1072 | 4844 | 543 | 180 | 483 | 4.9e-46 |

Description
gp:[GI:e316582:g2791909] [LN:SSK11MECA] [AC:Y13094] [GN:ORF141] [OR:*Staphylococcus sciuri*] [DB:genpept-bct1] [DE:*S. sciuri* mecA gene, strain K11 (792).] [LE:4489] [RE:4914] [DI:direct]

| ORF Name | NT ID | AA ID | NT LN | AA LN | Score | P-Value |
|---|---|---|---|---|---|---|
| AI7503000985__2557962_f2__698 | 1073 | 4845 | 1377 | 458 | 953 | 7.7e-96 |

Description
sp:[LN:NAOX__ENTFA] [AC:P37061] [GN:NOX] [OR:*ENTEROCOCCUS FAECALIS*] [SR:,*STREPTOCOCCUS FAECALIS*] [EC:1.6.99.3] [DE:NADH OXIDASE, (NOXASE)] [SP:P37061] [DB:swissprot] >pir:[LN:S26965] [AC:S26965] [PN:NADH oxidase] [CL:NADH peroxidase] [OR:*Enterococcus faecalis*] [DB:pir2] >gp:[GI:g47045] [LN:SFNOXAA] [AC:X68847:S45681] [PN:NADH oxidase] [GN:nox] [OR:*Enterococcus faecalis*] [DB:genpept-bct1] [DE:*S. faecalis* nox gene for NADH oxidase.] [SP:P37061] [LE:88] [RE:1428] [DI:direct]

| ORF Name | NT ID | AA ID | NT LN | AA LN | Score | P-Value |
|---|---|---|---|---|---|---|
| AI7503000985__25580425_f1__74 | 1074 | 4846 | 135 | 44 | | |

Description
NO-HIT

| ORF Name | NT ID | AA ID | NT LN | AA LN | Score | P-Value |
|---|---|---|---|---|---|---|
| AI7503000985__25585932_c1__1598 | 1075 | 4847 | 276 | 91 | 254 | 9.0e-22 |

Description
gp:[GI:d1039105:g4514322] [LN:AB013367] [AC:AB013367] [PN:YdeI] [GN:ydeI] [OR:*Bacillus halodurans*] [SR:*Bacillus halodurans* (strain:C-125) DNA] [DB:genpept-bct1] [DE:*Bacillus halodurans* C-125 ydeI gene, complete cds.] [LE:276] [RE:869] [DI:direct]

| ORF Name | NT ID | AA ID | NT LN | AA LN | Score | P-Value |
|---|---|---|---|---|---|---|
| AI7503000985__25600015_c3__2090 | 1076 | 4848 | 1632 | 543 | 1561 | 2.9e-160 |

-continued

Description
pir:[LN:E69989] [AC:E69989] [PN:acetate--CoA ligase, ytcI] [GN:ytcI]
[CL:acetate--CoA ligase homology] [OR:*Bacillus subtilis*] [EC:6.2.1.1]
[DB:pir2] >gp:[GI:e1185829:g2635440] [LN:BSUB0016] [AC:Z99119:AL009126]
[GN:ytcI] [FN:unknown] [OR:*Bacillus subtilis*] [DB:genpept-bct1] [DE:*Bacillus
subtilis* complete genome (section 16 of 21):from 2997771 to 3213410.]
[NT:similar to acetate-CoA ligase] [LE:24979] [RE:26574] [DI:complement]
>gp:[GI:g2293232] [LN:AF008220] [AC:AF008220] [PN:YtcI] [GN:ytcI]
[OR:*Bacillus subtilis*] [DB:genpept-bct2] [DE:*Bacillus subtilis* rrnB-dnaB
genomic region.] [NT:putative acetate CoA-ligase] [LE:153853] [RE:155448]
[DI:direct]

| ORF Name | NT ID | AA ID | NT LN | AA LN | Score | P-Value |
|---|---|---|---|---|---|---|
| AI7503000985__25626875__f2__653 | 1077 | 4849 | 147 | 48 | | |

Description
NO-HIT

| ORF Name | NT ID | AA ID | NT LN | AA LN | Score | P-Value |
|---|---|---|---|---|---|---|
| AI7503000985__25666427__f3__1335 | 1078 | 4850 | 306 | 101 | 84 | 0.0061 |

Description
sp:[LN:SSUA_BACSU] [AC:P40400] [GN:SSUA] [OR:*BACILLUS SUBTILIS*] [DE:PUTATIVE
ALIPHATIC SULFONATES BINDING PROTEIN PRECURSOR] [SP:P40400] [DB:swissprot]
>pir:[LN:I39927] [AC:I39927:C69817] [PN:ABC transporter (binding
lipoprotein) homolog ygbA] [GN:ygbA] [OR:*Bacillus subtilis*] [DB:pir2]
>gp:[GI:g438472] [LN:BACORFKLM] [AC:L16808] [OR:*Bacillus subtilis*]
[SR:*Bacillus subtilis* (individual_isolate MS11) (library:Tn91)]
[DB:genpept-bct1] [DE:*Bacillus subtilis* orfK, orfL and orfM, complete
cds's.] [NT:Likely N-terminal signal sequence, followed by] [LE:69]
[RE:1067] [DI:direct] >gp:[GI:e1182873:g2633207] [LN:BSUB0005]
[AC:Z99108:AL009126] [GN:ygbA] [FN:unknown] [OR:*Bacillus subtilis*]
[DB:genpept-bct1] [DE:*Bacillus subtilis* complete genome (section 5 of 21):
from 802821 to 1011250.] [NT:alternate gene name:yzeA; similar to ABC]
[SP:P40400] [LE:158868] [RE:159866] [DI:direct] >gp:[GI:e308630:g1903039]
[LN:BSZ93102] [AC:Z931021] [PN:hypothetical 36.3 kd lipoprotein precursor]
[GN:yzeA] [OR:*Bacillus subtilis*] [DB:genpept-bct1] [DE:*B. subtilis*
yga [L, M, N, O, P, Q, R, S, T], yzdB and yze [A, C] genes.] [NT:homology to nitrate
transport protein precursor] [SP:P40400] [LE:1194] [RE:2192] [DI:direct]

| ORF Name | NT ID | AA ID | NT LN | AA LN | Score | P-Value |
|---|---|---|---|---|---|---|
| AI7503000985__25961087__f1__123 | 1079 | 4851 | 813 | 270 | 399 | 3.9e-37 |

Description
sp:[LN:YFIE_BACSU] [AC:P54721] [GN:YFIE] [OR:*BACILLUS SUBTILIS*]
[DE:HYPOTHETICAL 31.5 KD PROTEIN IN GLVBC 3' REGION] [SP:P54721]
[DB:swissprot] >pir:[LN:H69802] [AC:H69802] [PN:conserved hypothetical
protein yfiE] [GN:yfiE] [OR:*Bacillus subtilis*] [DB:pir2]
>gp:[GI:e1182814:g2633148] [LN:BSUB0005] [AC:Z99108:AL009126] [GN:yfiE]
[FN:unknown] [OR:*Bacillus subtilis*] [DB:genpept-bct1] [DE:*Bacillus subtilis*
complete genome (section 5 of 21):from 802821 to 1011250.] [NT:similar to
hypothetical proteins from *B. subtilis*] [SP:P54721] [LE:94696] [RE:95553]
[DI:direct] >gp:[GI:d1009744:g1486247] [LN:D50543] [AC:D50543] [PN:unknown]
[GN:yfiE] [FN:unknown] [OR:*Bacillus subtilis*] [SR:*Bacillus subtilis*
(strain:168, haplotype:haploid) DNA] [DB:genpept-bct1] [DE:*Bacillus subtilis*
DNA for 76-degree region, complete cds.] [LE:8372] [RE:9229] [DI:direct]

| ORF Name | NT ID | AA ID | NT LN | AA LN | Score | P-Value |
|---|---|---|---|---|---|---|
| AI7503000985__25970952__f1__316 | 1080 | 4852 | 141 | 46 | | |

Description
NO-HIT

| ORF Name | NT ID | AA ID | NT LN | AA LN | Score | P-Value |
|---|---|---|---|---|---|---|
| AI7503000985__26017278__c1__1441 | 1081 | 4853 | 132 | 43 | | |

Description
NO-HIT

| ORF Name | NT ID | AA ID | NT LN | AA LN | Score | P-Value |
|---|---|---|---|---|---|---|
| AI7503000985__26179777__c1__1558 | 1082 | 4854 | 1818 | 605 | 522 | 3.6e-50 |

-continued

Description
pir:[LN:S75742] [AC:S75742] [PN:hypothetical protein sll0556]
[OR:*Synechocystis* sp.] [SR:PCC 6803, , PCC 6803] [SR:PCC 6803,] [DB:pir2]
>gp:[GI:d1011128:g1001236] [LN:SYCSLLE] [AC:D64003:AB001339]
[PN:hypothetical protein] [OR:*Synechocystis* sp.] [SR:*Synechocystis* sp.
(strain:PCC6803) DNA] [DB:genpept-bct1] [DE:*Synechocystis* sp. PCC6803
complete genome, 22/27, 2755703–2868766.] [NT:ORF_ID:sll0556] [LE:45438]
[RE:47333] [DI:complement]

| ORF Name | NT ID | AA ID | NT LN | AA LN | Score | P-Value |
| --- | --- | --- | --- | --- | --- | --- |
| AI7503000985_26188837_c1_1601 | 1083 | 4855 | 975 | 324 | 838 | 1.2e-83 |

Description
pir:[LN:A69670] [AC:A69670] [PN:choline ABC transporter (choline-binding
protein) opuBC] [GN:opuBC] [OR:*Bacillus subtilis*] [DB:pir2]
>gp:[GI:e1186059:g2635884] [LN:BSUB0018] [AC:Z99121:AL009126] [PN:choline
ABC transporter (choline-binding] [GN:opuBC] [FN:high affinity transport of
choline] [OR:*Bacillus subtilis*] [DB:genpept-bct1] [DE:*Bacillus subtilis*
complete genome (section 18 of 21):from 3399551 to 3609060.] [NT:alternate
gene name:prox] [LE:60016] [RE:60936] [DI:complement] >gp:[GI:g2293449]
[LN:AF008930] [AC:AF008930] [PN:choline binding protein precursor]
[GN:opuBC] [OR:*Bacillus subtilis*] [DB:genpept-bct2] [DE:*Bacillus subtilis*
choline transport system including ATPase (opuBA), transmembrane protein
(opuBB), choline binding protein precursor (opuBC) and transmembrane protein
(opuBD) genes, complete cds; and unknown gene.] [NT:part of choline uptake
system; OpuBC; lipoprotein] [LE:2708] [RE:3628] [DI:direct]

| ORF Name | NT ID | AA ID | NT LN | AA LN | Score | P-Value |
| --- | --- | --- | --- | --- | --- | --- |
| AI7503000985_26207537_f3_1201 | 1084 | 4856 | 129 | 42 | | |

Description
NO-HIT

| ORF Name | NT ID | AA ID | NT LN | AA LN | Score | P-Value |
| --- | --- | --- | --- | --- | --- | --- |
| AI7503000985_26213885_c3_2215 | 1085 | 4857 | 132 | 43 | | |

Description
NO-HIT

| ORF Name | NT ID | AA ID | NT LN | AA LN | Score | P-Value |
| --- | --- | --- | --- | --- | --- | --- |
| AI7503000985_26220077_f3_445 | 1086 | 4858 | 447 | 148 | 259 | 2.7e-22 |

Description
pir:[LN:E69857] [AC:E69857] [PN:conserved hypothetical protein ykmA]
[GN:ykmA] [OR:*Bacillus subtilis*] [DB:pir2] >gp:[GI:e1181515:g2632035]
[LN:BSAJ2571] [AC:AJ002571] [PN:YkmA] [GN:ykmA] [FN:unknown] [OR:*Bacillus
subtilis*] [DB:genpept-bct1] [DE:*Bacillus subtilis* 168 56 kb DNA fragment
between xlyA and ykoR.] [LE:33559] [RE:34002] [DI:complement]
>gp:[GI:e1183335:g2633669] [LN:BSUB0007] [AC:Z99110:AL009126] [GN:ykmA]
[FN:unknown] [OR:*Bacillus subtilis*] [DB:genpept-bct1] [DE:*Bacillus subtilis*
complete genome (section 7 of 21):from 1194391 to 1411140.] [NT:similar to
hypothetical proteins] [LE:186508] [RE:186951] [DI:complement]

| ORF Name | NT ID | AA ID | NT LN | AA LN | Score | P-Value |
| --- | --- | --- | --- | --- | --- | --- |
| AI7503000985_26353411_c1_1391 | 1087 | 4859 | 576 | 191 | | |

Description
NO-HIT

| ORF Name | NT ID | AA ID | NT LN | AA LN | Score | P-Value |
| --- | --- | --- | --- | --- | --- | --- |
| AI7503000985_26380265_c3_2042 | 1088 | 4860 | 1263 | 420 | 1291 | 1.2e-131 |

Description
gp:[GI:e1299582:g3687416] [LN:BLY17554] [AC:Y17554] [PN:arginine deiminase]
[GN:arcA] [OR:*Bacillus licheniformis*] [DB:genpept-bct1] [EC:3.5.3.6]
[DE:*Bacillus licheniformis* arcA, arcB, arcC and arcD genes.] [LE:248]
[RE:1489] [DI:direct]

| ORF Name | NT ID | AA ID | NT LN | AA LN | Score | P-Value |
| --- | --- | --- | --- | --- | --- | --- |
| AI7503000985_26383512_c1_1506 | 1089 | 4861 | 1398 | 465 | 1195 | 1.7e-121 |

Description
sp:[LN:YDGF_BACSU] [AC:P96704] [GN:YDGF] [OR:*BACILLUS SUBTILIS*]
[DE:HYPOTHETICAL TRANSPORT PROTEIN IN EXPZ-DINB INTERGENIC REGION]
[SP:P96704] [DB:swissprot] >pir:[LN:H69782] [AC:H69782] [PN:amino acid ABC
transporter (permease) homolog ydgF] [GN:ydgF] [CL:arginine permease]
[OR:*Bacillus subtilis*] [DB:pir2] >gp:[GI:d1020148:g1881368] [LN:AB001488]
[AC:AB001488] [GN:ydgF] [OR:*Bacillus subtilis*] [SR:*Bacillus subtilis*
(strain:168) DNA] [DB:genpept-bct1] [DE:*Bacillus subtilis* genome sequence,
148 kb sequence of the region between 35 and 47 degree.] [NT:PROBABLE AMINO
ACID TRANSPORT PERMIASE.] [LE:139917] [RE:141293] [DI:complement]
>gp:[GI:e1182528:g2632862] [LN:BSUB0003] [AC:Z99106:AL009126] [GN:ydgF]
[FN:unknown] [OR:*Bacillus subtilis*] [DB:genpept-bct1] [DE:*Bacillus subtilis*
complete genome (section 3 of 21):from 402751 to 611850.] [NT:similar to
amino acid ABC transporter (permease)] [SP:P96704] [LE:203663] [RE:205039]
[DI:complement] >gp:[GI:e1182541:g2632875] [LN:BSUB0004]
[AC:Z99107:AL009126] [GN:ydgF] [FN:unknown] [OR:*Bacillus subtilis*]
[DB:genpept-bct1] [DE:*Bacillus subtilis* complete genome (section 4 of 21):
from 600701 to 813890.] [NT:similar to amino acid ABC transporter (permease)]
[SP:P96704] [LE:5713] [RE:7089] [DI:complement]

| ORF Name | NT ID | AA ID | NT LN | AA LN | Score | P-Value |
| --- | --- | --- | --- | --- | --- | --- |
| AI7503000985__26385928__f2__900 | 1090 | 4862 | 1437 | 478 | 1441 | 1.5e-147 |

Description
pir:[LN:F69811] [AC:F69811] [PN:2-oxoglutarate/malate translocator homolog
yflS] [GN:yflS] [CL:2-oxoglutarate/malate translocator] [OR:*Bacillus
subtilis*] [DB:pir2] >gp:[GI:e1182747:g2633081] [LN:BSUB0005]
[AC:Z99108:AL009126] [GN:yflS] [FN:unknown] [OR:*Bacillus subtilis*]
[DB:genpept-bct1] [DE:*Bacillus subtilis* complete genome (section 5 of 21):
from 802821 to 1011250.] [NT:similar to 2-oxoglutarate/malate translocator]
[LE:26070] [RE:27506] [DI:direct] >gp:[GI:d1023175:g2443241] [LN:D86417]
[AC:D86417] [PN:YflS] [OR:*Bacillus subtilis*] [SR:*Bacillus subtilis*
(strain:AC327) DNA] [DB:genpept-bct1] [DE:*Bacillus subtilis* 35.7 kb genomic
DNA, 70–73 degree region, complete cds.] [LE:21015] [RE:22451]
[DI:complement]

| ORF Name | NT ID | AA ID | NT LN | AA LN | Score | P-Value |
| --- | --- | --- | --- | --- | --- | --- |
| AI7503000985__26429800__f2__605 | 1091 | 4863 | 126 | 41 | | |

Description
NO-HIT

| ORF Name | NT ID | AA ID | NT LN | AA LN | Score | P-Value |
| --- | --- | --- | --- | --- | --- | --- |
| AI7503000985__26449187__c1__1436 | 1092 | 4864 | 129 | 42 | | |

Description
NO-HIT

| ORF Name | NT ID | AA ID | NT LN | AA LN | Score | P-Value |
| --- | --- | --- | --- | --- | --- | --- |
| AI7503000985__26571937__f2__570 | 1093 | 4865 | 789 | 262 | 838 | 1.2e-83 |

Description
pir:[LN:D69845] [AC:D69845] [PN:thiamin biosynthesis homolog yjbT] [GN:yjbT]
[CL:thiamin biosynthesis protein thiG] [OR:*Bacillus subtilis*] [DB:pir2]
>gp:[GI:e1183189:g2633523] [LN:BSUB0007] [AC:Z99110:AL009126] [GN:yjbT]
[FN:unknown] [OR:*Bacillus subtilis*] [DB:genpept-bct1] [DE:*Bacillus subtilis*
complete genome (section 7 of 21):from 1194391 to 1411140.] [NT:similar to
thiamin biosynthesis] [LE:50122] [RE:50892] [DI:direct]

| ORF Name | NT ID | AA ID | NT LN | AA LN | Score | P-Value |
| --- | --- | --- | --- | --- | --- | --- |
| AI7503000985__26595641__f2__572 | 1094 | 4866 | 621 | 206 | 416 | 6.1e-39 |

Description
sp:[LN:APL_LACLA] [AC:Q48630] [GN:APL] [OR:*LACTOCOCCUS LACTIS*]
[SR:,*SUBSPLACTIS:STREPTOCOCCUS LACTIS*] [DE:ALKALINE PHOSPHATASE LIKE
PROTEIN] [SP:Q48630] [DB:swissprot] >pir:[LN:S39339] [AC:S39339]
[PN:alkaline phosphatase-like protein] [CL:probable alkaline phosphatase
yngC] [OR:*Lactococcus lactis*] [DB:pir2] >gp:[GI:g435296] [LN:LLALPHLP]
[AC:Z29065] [PN:alkaline phosphatase like protein] [GN:apl] [OR:*Lactococcus
lactis*] [DB:genpept-bct1] [DE:*L. lactis* (MG1363) apl gene for alkaline
phosphatase like protein.] [SP:Q48630] [LE:339] [RE:1067] [DI:direct]

| ORF Name | NT ID | AA ID | NT LN | AA LN | Score | P-Value |
| --- | --- | --- | --- | --- | --- | --- |

| -continued | | | | | | |
|---|---|---|---|---|---|---|
| AI7503000985__26600425__f3__1300 | 1095 | 4867 | 792 | 263 | 220 | 3.6e-18 |

Description
sp:[LN:ARY1__MOUSE] [AC:P50294] [GN:AAC1:NAT1] [OR:*MUS MUSCULUS*] [SR:,MOUSE]
[EC:2.3.1.5] [DE:ARYLANINE N-ACETYLTRANSFERASE 1, (NAT-1)] [SP:P50294]
[DB:swissprot] >gp:[GI:g1045651] [LN:MMNAT1] [AC:U37119] [PN:arylamine
N-acetyltransferase] [GN:NAT1] [OR:*Mus musculus*] [SR:house mouse
strain = C3H/HeJ] [DB:genpept-rod] [DE:*Mus musculus* arylamine
N-acetyltransferase (NAT1) gene, complete cds.] [LE:1] [RE:873] [DI:direct]
>gp:[GI:g1008568] [LN:MMU35885] [AC:U35885] [PN:N-acetyltransferase NAT-1]
[OR:*Mus musculus*] [SR:house mouse strain = C57B16] [DB:genpept-rod] [DE:*Mus
musculus* N-acetyltransferase NAT-1 mRNA, complete cds.] [LE:217] [RE:1089]
[DI:direct]

| ORF Name | NT ID | AA ID | NT LN | AA LN | Score | P-Value |
|---|---|---|---|---|---|---|
| AI7503000985__26605001__c3__2206 | 1096 | 4868 | 825 | 274 | 686 | 1.5e-67 |

Description
sp:[LN:YXBG__BACSU] [AC:P46331] [GN:YXBG:E3BR] [OR:*BACILLUS SUBTILIS*]
[EC:1.-.-.-] [DE:(EC 1.-.-.-)] [SP:P46331] [DB:swissprot] >pir:[LN:B70073]
[AC:B70073] [PN:glucose 1-dehydrogenase homolog yxbG] [GN:yxbG]
[CL:short-chain alcohol dehydrogenase homology] [OR:*Bacillus subtilis*]
[DB:pir2] >gp:[GI:d1022451:g904199] [LN:AB005554]
[AC:AB005554:D45242:D31629] [PN:probable oxidoreductase] [GN:yxbG]
[OR:*Bacillus subtilis*] [SR:*Bacillus subtilis* (strain:BGSC 1A1) DNA]
[DB:genpept-bct1] [EC:1.1.1.47] [DE:*Bacillus subtilis* genomic DNA, 36 kb
region between gnt and iol operons.] [NT:conserved universally] [LE:26446]
[RE:27234] [DI:complement] >gp:[GI:e1184709:g2636530] [LN:BSUB0021]
[AC:Z99124:AL009126] [GN:yxbG] [FN:unknown] [OR:*Bacillus subtilis*]
[DB:genpept-bct1] [DE:*Bacillus subtilis* complete genome (section 21 of 21):
from 3999281 to 4214814.] [NT:alternate gene name:yxaU; similar to glucose]
[SP:P46331] [LE:91359] [RE:92147] [DI:direct]

| ORF Name | NT ID | AA ID | NT LN | AA LN | Score | P-Value |
|---|---|---|---|---|---|---|
| AI7503000985__26672512__c1__1554 | 1097 | 4869 | 192 | 63 | 48 | 0.048 |

Description
gp:[GI:g2444136] [LN:U88974] [AC:U88974] [PN:ORF56] [OR:*Streptococcus
thermophilus* temperate bacteriophage O1205] [DB:genpept-phg]
[DE:*Streptococcus thermophilus* temperate bacteriophage O1205,
complete genome.] [LE:42158] [RE:42484] [DI:direct]

| ORF Name | NT ID | AA ID | NT LN | AA LN | Score | P-Value |
|---|---|---|---|---|---|---|
| AI7503000985__266877__f2__877 | 1098 | 4870 | 450 | 149 | 285 | 4.7e-25 |

Description
pir:[LN:F69653] [AC:F69653] [PN:transcription regulator lrpC] [GN:lrpC]
[OR:*Bacillus subtilis*] [DB:pir2] >gp:[GI:e1182391:g2632725] [LN:BSUB0003]
[AC:Z99106:AL009126] [PN:transcriptional regulator (Lrp/AsnC family)]
[GN:lrpC] [OR:*Bacillus subtilis*] [DB:genpept-bct1] [DE:*Bacillus subtilis*
complete genome (section 3 of 21):from 402751 to 611850.] [NT:alternate gene
name:ydaI] [LE:72862] [RE:73296] [DI:direct]

| ORF Name | NT ID | AA ID | NT LN | AA LN | Score | P-Value |
|---|---|---|---|---|---|---|
| AI7503000985__26751431__c3__1973 | 1099 | 4871 | 1062 | 353 | 1037 | 9.6e-105 |

Description
pir:[LN:E69581] [AC:E69581] [PN:acetoin dehydrogenase E1 component
(TPP-dependent beta subunit) acoB] [GN:acoB] [CL:pyruvate dehydrogenase
(lipoamide) beta chain] [OR:*Bacillus subtilis*] [DB:pir2]
>gp:[GI:e1182797:g2633131] [LN:BSUB0005] [AC:Z99108:AL009126] [PN:acetoin
dehydrogenase E1 component] [GN:acoB] [OR:*Bacillus subtilis*]
[DB:genpept-bct1] [DE:*Bacillus subtilis* complete genome (section 5 of 21):
from 802821 to 1011250.] [NT:alternate gene name:yfjJ] [LE:76693] [RE:77721]
[DI:direct] >gp:[GI:d1025207:g2780394] [LN:D78509] [AC:D78509] [PN:YfjJ]
[OR:*Bacillus subtilis*] [SR:*Bacillus subtilis* (strain:AC327) DNA]
[DB:genpept-bct1] [DE:*Bacillus subtilis* YfjG-YfjR genes, complete cds.]
[LE:8604] [RE:9632] [DI:complement] >gp:[GI:g2245638] [LN:AF006075]
[AC:AF006075] [PN:TPP-dependent acetoin dehydrogenase, E1] [GN:acoB]
[OR:*Bacillus subtilis*] [DB:genpept-bct2] [DE:*Bacillus subtilis* acetoin
dehydrogenase enzyme system gene cluster, ribosomal protein L6-like protein
gene, partial cds, TPP-dependent acetoin dehydrogenase, E1 alpha-subunit
CacoA), TPP-dependent acetoin dehydrogenase, E1 beta-subunit (acoB),
dihydrolipoamideacetyltransferase (acoC) and dihydrolipoamide dehydrogenase
(acoL) genes, complete cds, and regulatory protein (acoR) gene, partial cds.]

-continued

[NT:beta subunit of the E1 component of the acetoin] [LE:1830] [RE:2858]
[DI:direct] >gp:[GI:g2245638] [LN:AF006075] [AC:AF006075] [PN:TPP-dependent
acetoin dehydrogenase, E1] [GN:acoB] [OR:*Bacillus subtilis*] [DB:genpept]
[DE:*Bacillus subtilis* acetoin dehydrogenase enzyme system gene
cluster, ribosomal protein L6-like protein gene, partial cds,
TPP-dependentacetoin dehydrogenase, E1 alpha-subunit (acoA),
TPP-dependentacetoin dehydrogenase, E1 beta-subunit (acoB),
dihydrolipoamideacetyltransferase (acoC) and dihydrolipoamide dehydrogenase
(acoL) genes, complete cds, and regulatory protein (acoR) gene, partial cds.]
[NT:beta subunit of the E1 component of the acetoin] [LE:1830] [RE:2858]
[DI:direct]

| ORF Name | NT ID | AA ID | NT LN | AA LN | Score | P-Value |
| --- | --- | --- | --- | --- | --- | --- |
| AI7503000985__26751887__c1__1608 | 1100 | 4872 | 954 | 317 | 297 | 2.5e-26 |

Description
sp:[LN:APBA_AQUAE] [AC:O67619] [GN:APBA:AQ_1727] [OR:*AQUIFEX AEOLICUS*]
[EC:1.1.1.169] [DE:(REDUCTASE) (KPA REDUCTASE)] [SP:O67619] [DB:swissprot]
>pir:[LN:A70449] [AC:A70449] [PN:hypothetical protein aq_1727] [GN:aq_1727]
[OR:*Aquifex aeolicus*] [DB:pir2] >gp:[GI:g2984043] [LN:AE000753]
[AC:AE000753:AE000657] [PN:putative protein] [GN:aq_1727] [OR:*Aquifex
aeolicus*] [DB:genpept-bct2] [DE:*Aquifex aeolicus* section 85 of 109 of the
complete genome.] [LE:5968] [RE:6900] [DI:complement]

| ORF Name | NT ID | AA ID | NT LN | AA LN | Score | P-Value |
| --- | --- | --- | --- | --- | --- | --- |
| AI7503000985__273452__c2__1815 | 1101 | 4873 | 1278 | 425 | 800 | 1.2e-79 |

Description
sp:[LN:HMDH_ARCFU] [AC:O28538] [GN:HMGA:AF1736] [OR:*ARCHAEOGLOBUS FULGIDUS*]
[EC:1.1.1.34] [DE:(REDUCTASE)] [SP:O28538] [DB:swissprot] >pir:[LN:G69466]
[AC:G69466] [PN:3-hydroxy-3-methylglutaryl-coenzyme A reductase (mvaA)
homolog] [OR:*Archaeoglobus fulgidus*] [DB:pir2] >gp:[GI:g2648815]
[LN:AE000983] [AC:AE000983:AE000782] [PN:3-hydroxy-3-methylglutaryl-coenzyme
A reductase] [GN:AF1736] [OR:*Archaeoglobus fulgidus*] [DB:genpept-bct2]
[DE:*Archaeoglobus fulgidus* section 124 of 172 of the complete genome.]
[NT:similar to SP:P13702 GB:M29727 GB:M31807 PID:151259] [LE:7093] [RE:8403]
[DI:complement]

| ORF Name | NT ID | AA ID | NT LN | AA LN | Score | P-Value |
| --- | --- | --- | --- | --- | --- | --- |
| AI7503000985__2735807__c3__1983 | 1102 | 4874 | 138 | 45 | | |

Description
NO-HIT

| ORF Name | NT ID | AA ID | NT LN | AA LN | Score | P-Value |
| --- | --- | --- | --- | --- | --- | --- |
| AI7503000985__2739050__c2__1816 | 1103 | 4875 | 927 | 308 | 583 | 1.2e-56 |

Description
sp:[LN:YWBI_BACSU] [AC:P39592] [GN:YWBI:IPA-24D] [OR:*BACILLUS SUBTILIS*]
[DE:HYPOTHETICAL TRANSCRIPTIONAL REGULATOR IN THIK-EPR INTERGENIC REGION]
[SP:P39592] [DB:swissprot] >pir:[LN:S39679] [AC:S39679:G70051]
[PN:transcription regulator homolog ywbI:protein ipa-24d] [GN:ywbI]
[CL:probable transcription regulator lsyR] [OR:*Bacillus subtilis*] [DB:pir2]
>gp:[GI:g413948] [LN:BSGENR] [AC:X73124] [GN:ipa-24d] [OR:*Bacillus subtilis*]
[DB:genpept-bct1] [DE:*B. subtilis* genomic region (325 to 333).] [SP:P39592]
[LE:24460] [RE:25365] [DI:direct] >gp:[GI:e1186330:g2636366] [LN:BSUB0020]
[AC:Z99123:AL009126] [GN:ywbI] [FN:unknown] [OR:*Bacillus subtilis*]
[DB:genpept-bct1] [DE:*Bacillus subtilis* complete genome (section 20 of 21):
from 3798401 to 4010550.] [NT:alternate gene name:ipa-24d; similar to]
[SP:P39592] [LE:132594] [RE:133499] [DI:complement]

| ORF Name | NT ID | AA ID | NT LN | AA LN | Score | P-Value |
| --- | --- | --- | --- | --- | --- | --- |
| AI7503000985__2739561__f1__99 | 1104 | 4876 | 1440 | 479 | 1505 | 2.5e-154 |

Description
sp:[LN:GLPT_BACSU] [AC:P37948] [GN:GLPT] [OR:*BACILLUS SUBTILIS*]
[DE:(PERMEASE)] [SP:P37948] [DB:swissprot] >pir:[LN:I40417]
[AC:I40417:F69634:S37250] [PN:glycerol-3-phosphate transport protein
glpT:glycerol-3-phosphate permease glpT] [GN:glpT] [CL:hexose phosphate
transport protein uhpT] [OR:*Bacillus subtilis*] [DB:pir2]
>gp:[GI:d1034077:g3599636] [LN:AB006424] [AC:AB006424] [GN:ybeE]
[OR:*Bacillus subtilis*] [SR:*Bacillus subtilis* (strain:168) DNA]
[DB:genpept-bct1] [DE:*Bacillus subtilis* genomic DNA, 70 kb region between 17
and 23 degree.] [LE:36984] [RE:38318] [DI:complement] >gp:[GI:g403372]

-continued

[LN:BSGLPTQ] [AC:Z26522] [PN:glycerol 3-phosphate permease] [GN:glpT]
[FN:uptake of glycerol 3-phosphate] [OR:*Bacillus subtilis*] [DB:genpept-bct1]
[DE:*B. subtilis* glpT and glpQ genes for glycerol 3-phosphate permease and
glycerophosphoryl diester phosphodiesterase.] [SP:P37948] [LE:315] [RE:1649]
[DI:direct] >gp:[GI:e1182166:g2632500] [LN:BSUB0002] [AC:Z99105:AL009126]
[PN:glycerol-3-phosphate permease] [GN:glpT] [FN:uptake of
glycerol-3-phosphate] [OR:*Bacillus subtilis*] [DB:genpept-bct1] [DE:*Bacillus
subtilis* complete genome (section 2 of 21):from 194651 to 415810.]
[NT:alternate gene name:ybeE] [SP:P37948] [LE:39333] [RE:40667]
[DI:complement]

| ORF Name | NT ID | AA ID | NT LN | AA LN | Score | P-Value |
|---|---|---|---|---|---|---|
| AI7503000985__2760930__f1__121 | 1105 | 4877 | 189 | 62 | | |

Description
NO-HIT

| ORF Name | NT ID | AA ID | NT LN | AA LN | Score | P-Value |
|---|---|---|---|---|---|---|
| AI7503000985__2767577__c3__2139 | 1106 | 4878 | 135 | 44 | | |

Description
NO-HIT

| ORF Name | NT ID | AA ID | NT LN | AA LN | Score | P-Value |
|---|---|---|---|---|---|---|
| AI7503000985__2790936__f2__823 | 1107 | 4879 | 954 | 317 | 834 | 3.1e-83 |

Description
sp:[LN:MANA__STRMU] [AC:Q59935] [GN:PMI] [OR:*STREPTOCOCCUS MUTANS*]
[EC:5.3.1.8] [DE:(PMI) (PHOSPHOHEXOMUTASE)] [SP:Q59935] [DB:swissprot]
>gp:[GI:d1004537:g451216] [LN:STRPMI] [AC:D16594] [PN:Mannosephosphate
Isomerase] [GN:pmi] [OR:*Streptococcus mutans*] [SR:*Streptococcus mutans*
(strain:GS-5) DNA] [DB:genpept-bct1] [EC:5.3.1.8] [DE:*S. mutans* pmi gene for
mannosephosphate isomerase (complete cds) and scrK gene for fructokinase
(partial cds).] [LE:241] [RE:1191] [DI:direct]

| ORF Name | NT ID | AA ID | NT LN | AA LN | Score | P-Value |
|---|---|---|---|---|---|---|
| AI7503000985__2814000__c3__2159 | 1108 | 4880 | 156 | 51 | | |

Description
NO-HIT

| ORF Name | NT ID | AA ID | NT LN | AA LN | Score | P-Value |
|---|---|---|---|---|---|---|
| AI7503000985__2819803__c3__1966 | 1109 | 4881 | 363 | 120 | 206 | 1.1e-16 |

Description
gp:[GI:e1312399:g3341642] [LN:VCH231123] [AC:AJ231123] [GN:z61r] [OR:*Vibrio
cholerae*] [DB:genpept-bct1] [DE:*Vibrio cholerae* z61r gene.] [LE:47] [RE:388]
[DI:direct]

| ORF Name | NT ID | AA ID | NT LN | AA LN | Score | P-Value |
|---|---|---|---|---|---|---|
| AI7503000985__2823562__c3__2100 | 1110 | 4882 | 1365 | 454 | 909 | 3.5e-91 |

Description
pir:[LN:A71026] [AC:A71026] [PN:probable aminotransferase] [GN:PH1501]
[OR:*Pyrococcus horikoshii*] [DB:pir2] >gp:[GI:d1031552:g3257926]
[LN:AP000006]
[AC:AP000006:AB005215:AB009510:AB009511:AB009512:AB009513:AB009514]
[PN:438aa long hypothetical aminotransferase] [GN:PH1501] [OR:*Pyrococcus
horikoshii*] [SR:*Pyrococcus horikoshii* (strain:OT3) DNA, clone:*Pyrococcus
horikoshi*] [DB:genpept-bct1] [DE:*Pyrococcus horikoshii* OT3 genomic DNA,
1166001–1485000 nt. position (6/7).] [NT:similar to owl:D5045389 percent
identity:38.287 in] [LE:170905] [RE:172221] [DI:direct]

| ORF Name | NT ID | AA ID | NT LN | AA LN | Score | P-Value |
|---|---|---|---|---|---|---|
| AI7503000985__2853431__f2__504 | 1111 | 4883 | 195 | 64 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000985__2854787__c1__1553 | 1112 | 4884 | 126 | 41 | | |

Description
NO-HIT

| ORF Name | NT ID | AA ID | NT LN | AA LN | Score | P-Value |
|---|---|---|---|---|---|---|
| AI7503000985__2867961__c2__1846 | 1113 | 4885 | 963 | 320 | 410 | 2.7e-38 |

Description
pir:[LN:A69756] [AC:A69756] [PN:adhesion protein homolog ycdH] [GN:ycdH]
[CL:adhesin B] [OR:*Bacillus subtilis*] [DB:pir2] >gp:[GI:d1023108:g2415736]
[LN:AB000617] [AC:AB000617] [PN:YcdH] [GN:ycdH] [OR:*Bacillus subtilis*]
[SR:*Bacillus subtilis* (strain:168 trpC2) DNA] [DB:genpept-bct1] [DE:*Bacillus subtilis* genomic DNA, 22 to 25 degree region, complete cds.] [NT:homologue of adhesion protein precursor of] [LE:21421] [RE:22380] [DI:direct]
>gp:[GI:e1182237:g2632571] [LN:BSUB0002] [AC:Z99105:AL009126] [GN:ycdH]
[FN:unknown] [OR:*Bacillus subtilis*] [DB:genpept-bct1] [DE:*Bacillus subtilis* complete genome (section 2 of 21):from 194651 to 415810.] [NT:similar to adhesion protein] [LE:113236] [RE:114195] [DI:direct]

| ORF Name | NT ID | AA ID | NT LN | AA LN | Score | P-Value |
|---|---|---|---|---|---|---|
| AI7503000985__29304552__c3__2150 | 1114 | 4886 | 138 | 45 | | |

Description
NO-HIT

| ORF Name | NT ID | AA ID | NT LN | AA LN | Score | P-Value |
|---|---|---|---|---|---|---|
| AI7503000985__29352312__c3__2063 | 1115 | 4887 | 765 | 254 | 617 | 3.1e-60 |

Description
sp:[LN:YXDL__BACSU] [AC:P42423] [GN:YXDL:B65F] [OR:*BACILLUS SUBTILIS*]
[DE:HYPOTHETICAL ABC TRANSPORTER ATP-BINDING PROTEIN IN IDH 3' REGION]
[SP:P42423] [DB:swissprot] >pir:[LN:A70074] [AC:A70074] [PN:ABC transporter
(ATP-binding protein) homolog yxdL] [GN:yxdL] [CL:ATP-binding cassette
homology] [OR:*Bacillus subtilis*] [DB:pir2] >gp:[GI:d1003812:g709993]
[LN:BACIOLO] [AC:D14399] [PN:hypothetical protein] [GN:B65F] [OR:*Bacillus subtilis*] [SR:*Bacillus subtilis* (strain:BGSC 1A1 (168 trpC2)) DNA]
[DB:genpept-bct1] [DE:*Bacillus subtilis* 15 kb chromosome segment contains
the iol operon.] [NT:homologous to cell division protein FtsE of E.]
[LE:13014] [RE:13787] [DI:direct] >gp:[GI:e1184689:g2636510] [LN:BSUB0021]
[AC:Z99124:AL009126] [GN:yxdL] [FN:unknown] [OR:*Bacillus subtilis*]
[DB:genpept-bct1] [DE:*Bacillus subtilis* complete genome (section 21 of 21):
from 3999281 to 4214814.] [NT:similar to ABC transporter (ATP-binding
protein)] [SP:P42423] [LE:69902] [RE:70675] [DI:complement]
>gp:[GI:d1008911:g1408484] [LN:D45912] [AC:D45912] [GN:yxdL] [OR:*Bacillus subtilis*] [SR:*Bacillus subtilis* (strain:BGSC 1A1 (Marburg 168; trpC2)) DNA]
[DB:genpept-bct1] [DE:*Bacillus subtilis* genome sequence between the iol and
hut operon, partial and complete cds.] [NT:homologous to FtsE protein of *E. coli*, belonging to] [LE:801] [RE:1574] [DI:direct]

| ORF Name | NT ID | AA ID | NT LN | AA LN | Score | P-Value |
|---|---|---|---|---|---|---|
| AI7503000985__29375307__f2__499 | 1116 | 4888 | 135 | 44 | | |

Description
NO-HIT

| ORF Name | NT ID | AA ID | NT LN | AA LN | Score | P-Value |
|---|---|---|---|---|---|---|
| AI7503000985__29400332__c1__1571 | 1117 | 4889 | 417 | 138 | 309 | 1.3e-27 |

Description
pir:[LN:C69770] [AC:C69770] [PN:hypothetical protein ydaT] [GN:ydaT]
[OR:*Bacillus subtilis*] [DB:pir2] >gp:[GI:d1020028:g1881248] [LN:AB001488]
[AC:AB001488] [GN:ydaT] [OR:*Bacillus subtilis*] [SR:*Bacillus subtilis*
(strain:168) DNA] [DB:genpept-bct1] [DE:*Bacillus subtilis* genome sequence,
148 kb sequence of the region between 35 and 47 degree.] [NT:FUNCTION
UNKNOWN.] [LE:26046] [RE:26498] [DI:complement] >gp:[GI:e1182404:g2632738]
[LN:BSUB0003] [AC:Z99106:AL009126] [GN:ydaT] [FN:unknown] [OR:*Bacillus subtilis*] [DB:genpept-bct1] [DE:*Bacillus subtilis* complete genome (section 3
of 21):from 402751 to 611850.] [LE:89790] [RE:90242] [DI:complement]

| ORF Name | NT ID | AA ID | NT LN | AA LN | Score | P-Value |
|---|---|---|---|---|---|---|
| AI7503000985__29493827__f2__872 | 1118 | 4890 | 165 | 54 | | |

-continued

| Description NO-HIT | | | | | | |
|---|---|---|---|---|---|---|
| ORF Name | NT ID | AA ID | NT LN | AA LN | Score | P-Value |
| AI7503000985__29503403__f2__788 | 1119 | 4891 | 126 | 41 | | |

| Description NO-HIT | | | | | | |
|---|---|---|---|---|---|---|
| ORF Name | NT ID | AA ID | NT LN | AA LN | Score | P-Value |
| AI7503000985__29532827__f2__477 | 1120 | 4892 | 243 | 80 | | |

| Description NO-HIT | | | | | | |
|---|---|---|---|---|---|---|
| ORF Name | NT ID | AA ID | NT LN | AA LN | Score | P-Value |
| AI7503000985__29695327__c2__1739 | 1121 | 4893 | 750 | 249 | | |

| Description NO-HIT | | | | | | |
|---|---|---|---|---|---|---|
| ORF Name | NT ID | AA ID | NT LN | AA LN | Score | P-Value |
| AI7503000985__29955003__c2__1894 | 1122 | 4894 | 129 | 42 | | |

| Description NO-HIT | | | | | | |
|---|---|---|---|---|---|---|
| ORF Name | NT ID | AA ID | NT LN | AA LN | Score | P-Value |
| AI7503000985__30007827__c2__1943 | 1123 | 4895 | 789 | 262 | 605 | 5.8e-59 |

Description
pir:[LN:E69761] [AC:E69761:I40450:S52381] [PN:probable glutamine ABC transporter] [GN:yckK] [CL:lysine-arginine-ornithine-binding protein] [OR:*Bacillus subtilis*] [DB:pir2] >gp:[GI:e1182313:g2632647] [LN:BSUB0002] [AC:Z99105:AL009126] [GN:yckK] [FN:unknown] [OR:*Bacillus subtilis*] [DB:genpept-bct1] [DE:*Bacillus subtilis* complete genome (section 2 of 21): from 194651 to 415810.] [NT:similar to glutamine ABC transporter] [LE:215587] [RE:216393] [DI:complement] >gp:[GI:e1182328:g2632662] [LN:BSUB0003] [AC:Z99106:AL009126] [GN:yckK] [FN:unknown] [OR:*Bacillus subtilis*] [DB:genpept-bct1] [DE:*Bacillus subtilis* complete genome (section 3 of 21): from 402751 to 611850.] [NT:similar to glutamine ABC transporter] [LE:7487] [RE:8293] [DI:complement] >gp:[GI:d1009629:g1805432] [LN:D50453] [AC:D50453] [PN:homologue of glutamine-binding periplasmic] [GN:yckK] [OR:*Bacillus subtilis*] [SR:*Bacillus subtilis* (strain:168 trpC2) DNA] [DB:genpept-bct1] [DE:*Bacillus subtilis* DNA for 25–36 degree region containing the amyE-srfA region, complete cds.] [LE:89890] [RE:90696] [DI:complement]

| ORF Name | NT ID | AA ID | NT LN | AA LN | Score | P-Value |
|---|---|---|---|---|---|---|
| AI7503000985__30078378__c1__1437 | 1124 | 4896 | 165 | 54 | | |

| Description NO-HIT | | | | | | |
|---|---|---|---|---|---|---|
| ORF Name | NT ID | AA ID | NT LN | AA LN | Score | P-Value |
| AI7503000985__3009382__c3__1965 | 1125 | 4897 | 531 | 176 | | |

| Description NO-HIT | | | | | | |
|---|---|---|---|---|---|---|
| ORF Name | NT ID | AA ID | NT LN | AA LN | Score | P-Value |
| AI7503000985__30095011__f1__179 | 1126 | 4898 | 135 | 44 | | |

| Description NO-HIT | | | | | | |
|---|---|---|---|---|---|---|
| ORF Name | NT ID | AA ID | NT LN | AA LN | Score | P-Value |
| AI7503000985__30133562__c1__1399 | 1127 | 4899 | 1191 | 396 | 306 | 2.8e-27 |

Description
sp:[LN:YYBF_BACSU] [AC:P37498] [GN:YYBF] [OR:*BACILLUS SUBTILIS*]

-continued

[DE:HYPOTHETICAL 44.2 KD PROTEIN IN COTF-TETB INTERGENIC REGION] [SP:P37498]
[DB:swissprot] >pir:[LN:S65991] [AC:S65991:A70087] [PN:membrane protein
yybF] [GN:yybF] [CL:probable antibiotic resistance protein yybF]
[OR:*Bacillus subtilis*] [DB:pir2] >gp:[GI:d1005739:g467351] [LN:BAC180K]
[AC:D26185] [PN:unknown] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:27159] [RE:28373]
[DI:complement] >gp:[GI:e1184792:g2636613] [LN:BSUB0021]
[AC:Z99124:AL009126] [GN:yybF] [FN:unknown] [OR:*Bacillus subtilis*]
[DB:genpept-bct1] [DE:*Bacillus subtilis* complete genome (section 21 of 21):
from 3999281 to 4214814.] [NT:similar to antibiotic resistance protein]
[SP:P37498] [LE:179091] [RE:180305] [DI:complement]

| ORF Name | NT ID | AA ID | NT LN | AA LN | Score | P-Value |
|---|---|---|---|---|---|---|
| AI7503000985_302_f2_645 | 1128 | 4900 | 162 | 53 | | |

Description
NO-HIT

| ORF Name | NT ID | AA ID | NT LN | AA LN | Score | P-Value |
|---|---|---|---|---|---|---|
| AI7503000985_30360925_f2_901 | 1129 | 4901 | 642 | 213 | 204 | 2.0e-16 |

Description
sp:[LN:Y357_HAEIN] [AC:P44658] [GN:HI0357] [OR:*HAEMOPHILUS INFLUENZAE*]
[DE:PUTATIVE THIAMINE BIOSYNTHESIS PROTEIN HI0357] [SP:P44658]
[DB:swissprot] >pir:[LN:C64063] [AC:C64063] [PN:hypothetical protein
HI0357] [OR:*Haemophilus influenzae*] [DB:pir2] >gp:[GI:g1573325] [LN:U32720]
[AC:U32720:L42023] [PN:thiamine biosynthesis protein, putative] [GN:HI0357]
[OR:*Haemophilus influenzae* Rd] [DB:genpept-bct2] [DE:*Haemophilus influenzae*
Rd section 35 of 163 of the complete genome.] [NT:similar to SP:P42883
SP:P43534 SP:P47183] [LE:3006] [RE:3950] [DI:direct]

| ORF Name | NT ID | AA ID | NT LN | AA LN | Score | P-Value |
|---|---|---|---|---|---|---|
| AI7503000985_30367767_f1_56 | 1130 | 4902 | 1533 | 510 | 342 | 5.9e-31 |

Description
pir:[LN:D71235] [AC:D71235] [PN:hypothetical protein PH0142] [GN:PH0142]
[OR:*Pyrococcus horikoshii*] [DB:pir2] >gp:[GI:d1030154:g3256528]
[LN:AP000001]
[AC:AP000001:AB009465:AB009464:AB009466:AB009467:AB009468:AB009469]
[PN:289aa long hypothetical protein] [GN:PH0142] [OR:*Pyrococcus horikoshii*]
[SR:Pyrococcus horikoshii (strain:OT3) DNA] [DB:genpept-bct1] [DE:*Pyrococcus
horikoshii* OT3 genomic DNA, 1–287000 nt. position (1/7).] [NT:motif = soybean
trypsin inhibitor (Kunitz) protease] [LE:124718] [RE:125587] [DI:direct]

| ORF Name | NT ID | AA ID | NT LN | AA LN | Score | P-Value |
|---|---|---|---|---|---|---|
| AI7503000985_30470325_c3_2181 | 1131 | 4903 | 1953 | 650 | 425 | 8.1e-38 |

Description
pir:[LN:A70027] [AC:A70027] [PN:conserved hypothetical protein yvaC]
[GN:yvaC] [OR:*Bacillus subtilis*] [DB:pir2] >gp:[GI:e1186043:g2635868]
[LN:BSUB0018] [AC:Z99121:AL009126] [GN:yvaC] [FN:unknown] [OR:*Bacillus
subtilis*] [DB:genpept-bct1] [DE:*Bacillus subtilis* complete genome (section
18 of 21):from 3399551 to 3609060.] [NT:similar to hypothetical proteins]
[LE:45749] [RE:47644] [DI:complement]

| ORF Name | NT ID | AA ID | NT LN | AA LN | Score | P-Value |
|---|---|---|---|---|---|---|
| AI7503000985_30651577_c3_2155 | 1132 | 4904 | 612 | 203 | 88 | 0.00087 |

Description
pir:[LN:G70065] [AC:G70065] [PN:hypothetical protein ywpE] [GN:ywpE]
[OR:*Bacillus subtilis*] [DB:pir2] >gp:[GI:e1184540:g2636159] [LN:BSUB0019]
[AC:Z99122:AL009126] [GN:ywpE] [FN:unknown] [OR:*Bacillus subtilis*]
[DB:genpept-bct1] [DE:*Bacillus subtilis* complete genome (section 19 of 21):
from 3597091 to 3809700.] [LE:143698] [RE:144006] [DI:complement]
>gp:[GI:e289144:g1763706] [LN:BSZ83337] [AC:Z83337] [GN:ywpE] [OR:*Bacillus
subtilis*] [DB:genpept-bct1] [DE:*B. subtilis* mbl, flh[O, P], rapD,
ywp [B, C, D, E, F, G, H, I, J] and ywqA genes.] [LE:5315] [RE:5623] [DI:direct]
>gp:[GI:e1184540:g2636159] [LN:BSUB0019] [AC:Z99122:AL009126] [GN:ywpE]
[FN:unknown] [OR:*Bacillus subtilis*] [DB:genpept] [DE:*Bacillus subtilis*
complete genome (section 19 of 21):from 3597091 to 3809700.] [LE:143698]
[RE:144006] [DI:complement]

-continued

| ORF Name | NT ID | AA ID | NT LN | AA LN | Score | P-Value |
|---|---|---|---|---|---|---|
| AI7503000985_31490687_f3_1096 | 1133 | 4905 | 141 | 46 | | |

Description
NO-HIT

| ORF Name | NT ID | AA ID | NT LN | AA LN | Score | P-Value |
|---|---|---|---|---|---|---|
| AI7503000985_31517587_c2_1663 | 1134 | 4906 | 129 | 42 | | |

Description
NO-HIT

| ORF Name | NT ID | AA ID | NT LN | AA LN | Score | P-Value |
|---|---|---|---|---|---|---|
| AI7503000985_3157062_c1_1475 | 1135 | 4907 | 174 | 57 | | |

Description
NO-HIT

| ORF Name | NT ID | AA ID | NT LN | AA LN | Score | P-Value |
|---|---|---|---|---|---|---|
| AI7503000985_31693_c2_1716 | 1136 | 4908 | 699 | 232 | 128 | 7.1e-08 |

Description
pir:[LN:JH0364] [AC:JH0364] [PN:hypothetical protein 176 (SAGP 5' region)]
[OR:*Streptococcus pyogenes*] [DB:pir2]

| ORF Name | NT ID | AA ID | NT LN | AA LN | Score | P-Value |
|---|---|---|---|---|---|---|
| AI7503000985_31720942_f2_813 | 1137 | 4909 | 576 | 191 | | |

Description
NO-HIT

| ORF Name | NT ID | AA ID | NT LN | AA LN | Score | P-Value |
|---|---|---|---|---|---|---|
| AI7503000985_31755012_c1_1340 | 1138 | 4910 | 978 | 325 | 886 | 9.6e-89 |

Description
pir:[LN:E70070] [AC:E70070] [PN:metabolite transport protein homolog ywtG]
[GN:ywtG] [CL:glucose transport protein] [OR:*Bacillus subtilis*] [DB:pir2]
>gp:[GI:e1184489:g2636109] [LN:BSUB0019] [AC:Z99122:AL009126] [GN:ywtG]
[FN:unknown] [OR:*Bacillus subtilis*] [DB:genpept-bct1] [DE:*Bacillus subtilis*
complete genome (section 19 of 21):from 3597091 to 3809700.] [NT:similar to
metabolite transport protein] [LE:94500] [RE:95873] [DI:complement]
>gp:[GI:e308095:g1894771] [LN:BSZ92954] [AC:Z92954] [GN:ywtG] [OR:*Bacillus
subtilis*] [DB:genpept-bct1] [DE:*B. subtilis* yws [A, B, C, D, E, F, G] and gerBC
genes.] [NT:product highly similar to metabolite transport] [LE:6609]
[RE:7982] [DI:direct] >gp:[GI:e1184489:g2636109] [LN:BSUB0019]
[AC:Z99122:AL009126] [GN:ywtG] [FN:unknown] [OR:*Bacillus subtilis*]
[DB:genpept] [DE:*Bacillus subtilis* complete genome (section 19 of 21):from
3597091 to 3809700.] [NT:similar to metabolite transport protein] [LE:94500]
[RE:95873] [DI:complement]

| ORF Name | NT ID | AA ID | NT LN | AA LN | Score | P-Value |
|---|---|---|---|---|---|---|
| AI7503000985_3182927_c2_1673 | 1139 | 4911 | 2082 | 693 | 3598 | 0.0 |

Description
gp:[GI:g2981225] [LN:AF053006] [AC:AF053006] [PN:lipase precursor] [GN:geh1]
[OR:*Staphylococcus epidermidis*] [DB:genpept-bct2] [DE:*Staphylococcus
epidermidis* lipase precursor (geh1) gene, complete cds.] [LE:148] [RE:2214]
[DI:direct]

| ORF Name | NT ID | AA ID | NT LN | AA LN | Score | P-Value |
|---|---|---|---|---|---|---|
| AI7503000985_32205143_c2_1642 | 1140 | 4912 | 168 | 55 | | |

Description
NO-HIT

| ORF Name | NT ID | AA ID | NT LN | AA LN | Score | P-Value |
|---|---|---|---|---|---|---|
| AI7503000985_32220202_f2_708 | 1141 | 4913 | 123 | 40 | | |

-continued

Description
NO-HIT

| ORF Name | NT ID | AA ID | NT LN | AA LN | Score | P-Value |
|---|---|---|---|---|---|---|
| AI7503000985__32221012__c1__1567 | 1142 | 4914 | 471 | 156 | 114 | 4.6e-06 |

Description
sp:[LN:NPT4__HUMAN] [AC:O00476] [GN:SLC17A4:NPT4] [OR:*HOMO SAPIENS*] [SR:,HUMAN] [DE:(COTRANSPORTER 4) (NA(+)/PI COTRANSPORTER 4)] [SP:O00476] [DB:swissprot] >gp:[GI:g2062692] [LN:HSU90545] [AC:U90545] [PN:sodium phosphate transporter] [GN:NPT4] [OR:*Homo sapiens*] [SR:human] [DB:genpept-pri2] [DE:Human sodium phosphate transporter (NPT4) mRNA, complete cds.] [LE:377] [RE:1582] [DI:direct]

| ORF Name | NT ID | AA ID | NT LN | AA LN | Score | P-Value |
|---|---|---|---|---|---|---|
| AI7503000985__32614078__f2__539 | 1143 | 4915 | 150 | 49 | | |

Description
NO-HIT

| ORF Name | NT ID | AA ID | NT LN | AA LN | Score | P-Value |
|---|---|---|---|---|---|---|
| AI7503000985__32664093__f2__568 | 1144 | 4916 | 627 | 208 | 142 | 6.7e-10 |

Description
pir:[LN:G70418] [AC:G70418] [PN:probable thiamine phosphate synthase 2] [GN:thiE1] [CL:probable thiamin-phosphate pyrophosphorylase: thiamin-phosphate pyrophosphorylase homology] [OR:*Aquifex aeolicus*] [DB:pir2] >gp:[GI:g2983767] [LN:AE000736] [AC:AE000736:AE000657] [PN:thiamine phosphate synthase] [GN:thiE1] [ER:*Aquifex aeolicus*] [DB:genpept-bct2] [DE:*Aquifex aeolicus* section 68 of 109 of the complete genome.] [LE:15292] [RE:15852] [DI:complement]

| ORF Name | NT ID | AA ID | NT LN | AA LN | Score | P-Value |
|---|---|---|---|---|---|---|
| AI7503000985__33203385__c3__1997 | 1145 | 4917 | 597 | 198 | 967 | 2.5e-97 |

Description
gp:[GI:g2978430] [LN:SEU43366] [AC:U43366] [PN:IcaR] [GN:icaR] [OR:*Staphylococcus epidermidis*] [DB:genpept-bct2] [DE:*Staphylococcus epidermidis* operon mediating intercellular adhesion:IcaR, IcaA, IcaD, IcaB, and IcaC genes, complete cds.] [LE:39] [RE:596] [DI:complement]

| ORF Name | NT ID | AA ID | NT LN | AA LN | Score | P-Value |
|---|---|---|---|---|---|---|
| AI7503000985__33209682__c2__1718 | 1146 | 4918 | 123 | 40 | | |

Description
NO-HIT

| ORF Name | NT ID | AA ID | NT LN | AA LN | Score | P-Value |
|---|---|---|---|---|---|---|
| AI7503000985__33211092__f3__1123 | 1147 | 4919 | 471 | 156 | 72 | 0.030 |

Description
sp:[LN:VL02__VARV] [AC:P33041] [GN:L2R:M2R] [OR:VARIOLA VIRUS] [DE:PROTEIN L2] [SP:P33041] [DB:swissprot] >pir:[LN:S33088] [AC:S33088:H36844] [PN:L2R protein:M2R protein] [CL:vaccinia virus F3 protein] [OR:variola virus] [DB:pir2] >gp:[GI:g262433] [LN:S55844] [AC:S55844] [GN:L2R] [OR:Variola major virus] [SR:Variola major virus India-1967] [DB:genpept-vrl] [DE:G9R . . . H7R Evariola major virus, India-1967, Genomic, 19 genes, 18029 nt].] [NT:This sequence comes from FIG. 2.] [LE:1860] [RE:2123] [DI:direct] >gp:[GI:g438992] [LN:VARCG] [AC:L22579] [OR:Variola major virus] [SR:Variola major virus (strain Bangladesh-1975) DNA] [DB:genpept-vrl] [DE:Variola major virus (strain Bangladesh-1975) complete genome.] [NT:homolog of vaccinia virus CDS L2R; putative] [LE:69256] [RE:69519] [DI:direct] >gp:[GI:g297254] [LN:VVCGAA] [AC:X69198] [GN:M2R] [OR:Variola virus] [DB:genpept-vrl] [DE:Variola virus DNA complete genome.] [SP:P33041] [LE:68623] [RE:68886] [DI:direct] >gp:[GI:g62350] [LN:VVHINDQKH] [AC:X67119] [GN:L2R COP] [OR:Variola virus] [DB:genpept-vrl] [DE:Variola virus (HindIII-Q, K, H, M, L, I, F genome fragment) genes.] [SP:P33041] [LE:18508] [RE:18771] [DI:direct] >gp:[GI:e92818:g1143683] [LN:VVL8R] [AC:X76267] [OR:Variola virus] [DB:genpept-vrl] [DE:Variola virus (Garcia-1966) L8R, I1L, I3R, I2L, I4L, I5R, I5.5R, I6R, I7L, I8R, I9R, N1R, N2R, N3L, N4R and N5R genes.] [NT:ORF13R] [SP:P33041] [LE:10592] [RE:10855] [DI:direct]

-continued

| ORF Name | NT ID | AA ID | NT LN | AA LN | Score | P-Value |
|---|---|---|---|---|---|---|
| AI7503000985_33219007_f3_1152 | 1148 | 4920 | 375 | 124 | | |

Description
NO-HIT

| ORF Name | NT ID | AA ID | NT LN | AA LN | Score | P-Value |
|---|---|---|---|---|---|---|
| AI7503000985_33241093_c2_1806 | 1149 | 4921 | 1557 | 518 | 1634 | 5.2e-168 |

Description
pir:[LN:A69759] [AC:A69759] [PN:1-pyrroline-5-carboxylate dehydrogenase homolog ycgN] [GN:ycgN] [CL:aldehyde dehydrogenase (NAD+):aldehyde dehydrogenase homology] [OR:*Bacillus subtilis*] [DB:pir2]
>gp:[GI:e1182273:g2632607] [LN:BSUB0002] [AC:Z99105:AL009126] [GN:ycgN] [FN:unknown] [OR:*Bacillus subtilis*] [DB:genpept-bct1] [DE:*Bacillus subtilis* complete genome (section 2 of 21):from 194651 to 415810.] [NT:similar to 1-pyrroline-5-carboxylate dehydrogenase] [LE:150401] [RE:151948] [DI:direct]
>gp:[GI:d1009590:g1805393] [LN:D50453] [AC:D50453] [PN:68% identity protein to] [GN:ycgN] [OR:*Bacillus subtilis*] [SR:*Bacillus subtilis* (strain:168 trpC2) DNA] [DB:genpept-bct1] [DE:*Bacillus subtilis* DNA for 25–36 degree region containing the amyE-srfA region, complete cds.] [LE:24702] [RE:26249] [DI:direct]

| ORF Name | NT ID | AA ID | NT LN | AA LN | Score | P-Value |
|---|---|---|---|---|---|---|
| AI7503000985_33242842_c1_1579 | 1150 | 4922 | 2871 | 956 | 315 | 2.0e-24 |

Description
pir:[LN:S59797] [AC:S59797] [PN:hypothetical protein YDR332w:hypothetical protein D9798.1] [CL:unassigned DEAD/H box helicases:DEAD/H box helicase homology] [OR:*Saccharomyces cerevisiae*] [DB:pir2] [MP:4R]

| ORF Name | NT ID | AA ID | NT LN | AA LN | Score | P-Value |
|---|---|---|---|---|---|---|
| AI7503000985_33250287_c1_1513 | 1151 | 4923 | 156 | 51 | | |

Description
NO-HIT

| ORF Name | NT ID | AA ID | NT LN | AA LN | Score | P-Value |
|---|---|---|---|---|---|---|
| AI7503000985_33304082_f1_387 | 1152 | 4924 | 129 | 42 | | |

Description
NO-HIT

| ORF Name | NT ID | AA ID | NT LN | AA LN | Score | P-Value |
|---|---|---|---|---|---|---|
| AI7503000985_33359381_c2_1697 | 1153 | 4925 | 210 | 69 | | |

Description
NO-HIT

| ORF Name | NT ID | AA ID | NT LN | AA LN | Score | P-Value |
|---|---|---|---|---|---|---|
| AI7503000985_33391337_c2_1891 | 1154 | 4926 | 864 | 287 | 168 | 2.1e-12 |

Description
gp:[GI:g4894301] [LN:AF065404] [AC:AF065404] [PN:pXO1–85] [OR:*Bacillus anthracis*] [DB:genpept-bct2] [DE:*Bacillus anthracis* virulence plasmid PX01, complete sequence.] [LE:99636] [RE:100319] [DI:direct]

| ORF Name | NT ID | AA ID | NT LN | AA LN | Score | P-Value |
|---|---|---|---|---|---|---|
| AI7503000985_33595087_c2_1645 | 1155 | 4927 | 141 | 46 | | |

Description
NO-HIT

| ORF Name | NT ID | AA ID | NT LN | AA LN | Score | P-Value |
|---|---|---|---|---|---|---|
| AI7503000985_33620176_c3_2091 | 1156 | 4928 | 858 | 285 | 494 | 3.3e-47 |

Description
gp:[GI:d1020251:g1943993] [LN:AB001896] [AC:AB001896] [GN:orf30] [OR:*Staphylococcus aureus*] [SR:*Staphylococcus aureus* (strain:912) DNA] [DB:genpept-bct1] [DE:*Staphylococcus aureus* DNA for sigma70 operon, complete -continued cds.] [LE:1501] [RE:2310] [DI:direct]

| ORF Name | NT ID | AA ID | NT LN | AA LN | Score | P-Value |
|---|---|---|---|---|---|---|
| AI7503000985__33837817__c1__1431 | 1157 | 4929 | 129 | 42 | | |

Description
NO-HIT

| ORF Name | NT ID | AA ID | NT LN | AA LN | Score | P-Value |
|---|---|---|---|---|---|---|
| AI7503000985__33985007__f3__1266 | 1158 | 4930 | 153 | 50 | | |

Description
NO-HIT

| ORF Name | NT ID | AA ID | NT LN | AA LN | Score | P-Value |
|---|---|---|---|---|---|---|
| AI7503000985__33988778__f2__888 | 1159 | 4931 | 660 | 219 | 636 | 3.0e-62 |

Description
pir:[LN:JC4511] [AC:JC4511] [PN:pyroglutamyl-peptidase I,:bacterial
pyrrolidone carboxyl peptidase (PYRase)] [GN:pcp] [OR:*Staphylococcus
aureus*] [EC:3.4.19.3] [DB:pir2] >gp:[GI:g790573] [LN:SAU19770] [AC:U19770]
[PN:pyrrolidone carboxyl peptidase] [GN:pcp] [OR:*Staphylococcus aureus*]
[DB:genpept-bct1] [DE:*Staphylococcus aureus* pyrrolidone carboxyl peptidase
(pcp) gene, complete cds.] [NT:pyrase] [LE:204] [RE:842] [DI:direct]

| ORF Name | NT ID | AA ID | NT LN | AA LN | Score | P-Value |
|---|---|---|---|---|---|---|
| AI7503000985__34016937__c1__1600 | 1160 | 4932 | 1383 | 460 | 1178 | 1.1e-119 |

Description
pir:[LN:C69670] [AC:C69670] [PN:glycine betaine/carnitine/choline ABC
transporter (ATP-bindin) opuCA] [GN:opuCA] [CL:glycine betaine/proline
transport protein proV:ATP-binding cassette homology:CBS homology]
[OR:*Bacillus subtilis*] [DB:pir2] >gp:[GI:g2271389] [LN:AF009352]
[AC:AF009352] [PN:ATPase] [GN:opuCA] [OR:*Bacillus subtilis*]
[DB:genpept-bct1] [DE:*Bacillus subtilis* osmoprotectant transport system OpuC
including ATPase (opuCA), transmembrane protein (opuCB),
osmoprotectant binding protein precursor (opuCC) and transmembrane protein
(opuCD) genes, complete cds.] [NT:OpuCA; part of the osmoprotectant transport
system] [LE:860] [RE:2002] [DI:direct] >gp:[GI:e1186071:g2635896]
[LN:BSUB0018] [AC:Z99121:AL009126] [PN:glycine betaine/carnitine/choline
ABC] [GN:opuCA] [FN:high affinity transport of glycine betaine,]
[OR:*Bacillus subtilis*] [DB:genpept-bct1] [DE:*Bacillus subtilis* complete
genome (section 18 of 21):from 3399551 to 3609060.] [NT:alternate gene name:
yvbE] [LE:69373] [RE:70515] [DI:complement]

| ORF Name | NT ID | AA ID | NT LN | AA LN | Score | P-Value |
|---|---|---|---|---|---|---|
| AI7503000985__34021912__c2__1736 | 1161 | 4933 | 123 | 40 | | |

Description
NO-HIT

| ORF Name | NT ID | AA ID | NT LN | AA LN | Score | P-Value |
|---|---|---|---|---|---|---|
| AI7503000985__3402312__c1__1529 | 1162 | 4934 | 1761 | 586 | 1316 | 2.6e-134 |

Description
pir:[LN:G69769] [AC:G69769] [PN:pyruvate oxidase homolog ydaP] [GN:ydaP]
[CL:acetolactate synthase large chain:thiamine pyrophosphate-binding domain
homology] [OR:*Bacillus subtilis*] [DB:pir2] >gp:[GI:d1020024:g1881244]
[LN:AB001488] [AC:AB001488] [GN:ydaP] [OR:*Bacillus subtilis*] [SR:*Bacillus
subtilis* (strain:168) DNA] [DB:genpept-bct1] [DE:*Bacillus subtilis* genome
sequence, 148 kb sequence of the region between 35 and 47 degree.]
[NT:SIMILAR TO PYRUVATE OXIDASE AND ACETOLACTATE] [LE:21889] [RE:23613]
[DI:direct] >gp:[GI:e1182400:g2632734] [LN:BSUB0003] [AC:Z99106:AL009126]
[GN:ydaP] [FN:unknown] [OR:*Bacillus subtilis*] [DB:genpept-bct1] [DE:*Bacillus
subtilis* complete genome (section 3 of 21):from 402751 to 611850.]
[NT:similar to pyruvate oxidase] [LE:85633] [RE:87357] [DI:direct]

| ORF Name | NT ID | AA ID | NT LN | AA LN | Score | P-Value |
|---|---|---|---|---|---|---|
| AI7503000985__34033563__c1__1627 | 1163 | 4935 | 327 | 108 | 388 | 5.7e-36 |

Description
gp:[GI:e1429590:g4756150] [LN:A67161] [AC:A67161] [FN:NIRD GENE]

-continued

[OR:*Staphylococcus carnosus*] [DB:genpept-pat] [DE:Sequence 1 from Patent EP0805205.] [NT:unnamed protein product] [LE:2589] [RE:2903] [DI:direct] >gp:[GI:g4433640] [LN:AF029224] [AC:AF029224:AF029225] [PN:NirD] [GN:nirD] [OR:*Staphylococcus carnosus*] [DB genpept-bct2] [DE:*Staphylococcus carnosus* nir and nar operons, complete sequences.] [NT:similar to *Escherichia coli* NADH-dependent nitrite] [LE:4774] [RE:5088] [DI:direct]

| ORF Name | NT ID | AA ID | NT LN | AA LN | Score | P-Value |
|---|---|---|---|---|---|---|
| AI7503000985__34094136__f1__408 | 1164 | 4936 | 156 | 51 | | |

Description
NO-HIT

| ORF Name | NT ID | AA ID | NT LN | AA LN | Score | P-Value |
|---|---|---|---|---|---|---|
| AI7503000985__34157807__f2__816 | 1165 | 4937 | 147 | 48 | | |

Description
NO-HIT

| ORF Name | NT ID | AA ID | NT LN | AA LN | Score | P-Value |
|---|---|---|---|---|---|---|
| AI7503000985__34194002__c2__1941 | 1166 | 4938 | 711 | 236 | 657 | 1.8e-64 |

Description
sp:[LN:PMGY_ZYMMO] [AC:P30798] [GN:PGM] [OR:*ZYMOMONAS MOBILIS*] [EC:5.4.2.1] [DE:(BPG-DEPEND[NT PGAD4)] [SP:P30798] [DB:swissprot] >pir:[LN:C40649] [AC:C40649] [PN:phosphoglycerate mutase,] [CL:phosphoglycerate mutase:phosphoglycerate mutase homology] [OR:*Zymomonas mobilis*] [EC:5.4.2.1] [DB:pir2] >gp:[GI:g155611] [LN:ZMOPGMA] [AC:L09651] [PN:phosphoglyceromutase] [GN:pgm] [OR:*Zymomonas mobilis*] [SR:*Zymomonas mobilis* (strain CP4) DNA] [DB:genpept-bct1] [DE:*Zymomonas mobilis* phosphoglyceromutase (pgm) gene, complete cds, and 2-hydroxyacid dehydrogenase homologue (ddh) gene, 5' end.] [LE:317] [RE:1003] [DI:direct]

| ORF Name | NT ID | AA ID | NT LN | AA LN | Score | P-Value |
|---|---|---|---|---|---|---|
| AI7503000985__34197318__f3__1128 | 1167 | 4939 | 903 | 300 | 1117 | 3.2e-113 |

Description
pir:[LN:A49943] [AC:A49943:S33358] [PN:fructose-bisphosphate aldolase,] [OR:*Staphylococcus carnosus*] [EC:4.1.2.13] [DB:pir2] >gp:[GI:g297874] [LN:SCFDA] [AC:X71729] [PN:fructose-bisphosphate aldolase] [GN:fda] [OR:*Staphylococcus carnosus*] [DB:genpept-bct1] [EC:4.1.2.13] [DE:*S. carnosus* fda gene.] [SP:Q07159] [LE:667] [RE:1557] [DI:direct]

| ORF Name | NT ID | AA ID | NT LN | AA LN | Score | P-Value |
|---|---|---|---|---|---|---|
| AI7503000985__34273436__f2__498 | 1168 | 4940 | 855 | 284 | 372 | 2.8e-34 |

Description
sp:[LN:YQJG_BACSU] [AC:P54544] [GN:YQJG] [OR:*BACILLUS SUBTILIS*] [DE:PRECURSOR] [SP:P54544] [DB:swissprot] >pir:[LN:G69963] [AC:G69963] [PN:lipoprotein SpoIIIJ-like homolog yqjG] [GN:yqjG] [CL:stage III sporulation protein:stage III sporulation protein homology] [OR:*Bacillus subtilis*] [DB:pir2] >gp:[GI:d1013293:g1303958] [LN:BACJHG42] [AC:D84432:D82370] [PN:YqjG] [OR:*Bacillus subtilis*] [SR:*Bacillus subtilis* (strain:JH642(trpC2 PheA1)) DNA] [DB:genpept-bct1] [DE:*Bacillus subtilis* DNA, 283 Kb region containing skin element.] [LE:234919] [RE:235746] [DI:complement] >gp:(GI:e1185657:g2634823] [LN:BSUB0013] [AC:Z99116:AL009126] [GN:yqjG] [FN:unknown] [OR:*Bacillus subtilis*] [DB:genpept-bct1] [DE:*Bacillus subtilis* complete genome (section 13 of 21): from 2395261 to 2613730.] [NT:similar to lipoprotein SpoIIIJ-like] [SP:P54544] [LE:87873] [RE:88700] [DI:direct]

| ORF Name | NT ID | AA ID | NT LN | AA LN | Score | P-Value |
|---|---|---|---|---|---|---|
| AI7503000985__34385012__f2__465 | 1169 | 4941 | 1362 | 453 | 364 | 6.0e-40 |

Description
pir:[LN:S62194] [AC:S62194] [PN:hypothetical protein 4] [CL:dipeptide transport protein] [OR:*Methanosarcina barkeri*] [DB:pir2] >gp:[GI:e212291:g1124957] [LN:MBFMDSUBS] [AC:X93084] [GN:orf4] [OR:*Methanosarcina barkeri*] [DB:genpept-bct1] [DE:*M. barkeri* fmdE, fmdF, fmdA, fmdC, fmdD, fmdB, orf4, orf3, orf2, and or f1 genes.] [LE:<1] [RE:1588] [DI:complement]

-continued

| ORF Name | NT ID | AA ID | NT LN | AA LN | Score | P-Value |
|---|---|---|---|---|---|---|
| AI7503000985_34410843_c2_1690 | 1170 | 4942 | 1431 | 476 | | |

Description
NO-HIT

| ORF Name | NT ID | AA ID | NT LN | AA LN | Score | P-Value |
|---|---|---|---|---|---|---|
| AI7503000895_34412952_c3_2210 | 1171 | 4943 | 783 | 260 | 580 | 2.6e-56 |

Description
sp:[LN:YBBM_ECOLI] [AC:P77307] [GN:YBBM] [OR:*ESCHERICHIA COLI*]
[DE:HYPOTHETICAL 28.2 KD PROTEIN IN USHA-TESA INTERGENIC REGION] [SP:P77307]
[DB:swissprot]

| ORF Name | NT ID | AA ID | NT LN | AA LN | Score | P-Value |
|---|---|---|---|---|---|---|
| AI75303000985_34414192_c3_2229 | 1172 | 4944 | 831 | 276 | 113 | 0.00012 |

Description
pir:[LN:F69104] [AC:F69104] [PN:3',5'-cyclic-nucleotide phosphodiesterase,
cpdA homolog MTH178:Icc related protein] [GN:MTH178]
[CL:3',5'-cyclic-nucleotide phosphodiesterase cpdA:3',5'-cyclic-nucleotide
phosphodiesterase cpdA homology:phosphoesterase core homology]
[OR:*Methanobacterium thermoautotrophicum*] [EC:3.1.4.17] [DB:pir1]
>gp:[GI:g2621221] [LN:AE000805] [AC:AE000805:AE000666] [PN:Icc related
protein] [GN:MTH178] [OR:*Methanobacterium thermoautotrophicum*]
[DB:genpept-bct1] [DE:*Methanobacterium thermoautotrophicum* from bases 114371
to 125512 (section 11 of 148) of the complete genome.] [NT:Function
Code:10.02 - Metabolism of Macromolecules,] [LE:10465] [RE:11055]
[DI:direct]

| ORF Name | NT ID | AA ID | NT LN | AA LN | Score | P-Value |
|---|---|---|---|---|---|---|
| AI7503000985_34430428_c2_1949 | 1173 | 4945 | 375 | 124 | 83 | 0.0051 |

Description
pir:[LN:C69776] [AC:C69776] [PN:hypothetical protein yddJ] [GN:yddJ]
[OR:*Bacillus subtilis*] [DB:pir2] >gp:[GI:d1020089:g1881309] [LN:AB001488]
[AC:AB001488] [GN:yddJ] [OR:*Bacillus subtilis*] [SR:*Bacillus subtilis*
(strain:168) DNA] [DB:genpept-bct1] [DE:*Bacillus subtilis* genome sequence,
148 kb sequence of the region between 35 and 47 degree.] [NT:FUNCTION
UNKNOWN.] [LE:78831] [RE:79211] [DI:direct] >gp:[GI:e1182465:g2632799]
[LN:BSUB0003] [AC:Z99106:AL009126] [GN:yddJ] [FN:unknown] [OR:*Bacillus
subtilis*] [DB:genpept-bct1] [DE:*Bacillus subtilis* complete genome (section 3
of 21):from 402751 to 611850.] [LE:142576] [RE:142956] [DI:direct]

| ORF Name | NT ID | AA ID | NT LN | AA LN | Score | P-Value |
|---|---|---|---|---|---|---|
| AI7503000985_34554692_f1_62 | 1174 | 4946 | 474 | 157 | 403 | 1.5e-37 |

Description
gp:[GI:g1575025] [LN:SAU52961] [AC:U52961] [PN:holin-like protein LrgA]
[GN:lrgA] [OR:*Staphylococcus aureus*] [SR:*Staphylococcus aureus* strain = NCTC
8325-4] [DB:genpept-bct2] [DE:*Staphylococcus aureus* holin-like protein LrgA
(lrgA) and LrgB (lrgB) genes, complete cds.] [NT:LytSR-regulated gene;
similar to *E. coli* yohJ] [LE:369] [RE:812] [DI:direct]

| ORF Name | NT ID | AA ID | NT LN | AA LN | Score | P-Value |
|---|---|---|---|---|---|---|
| AI7503000985_34585317_c2_1938 | 1175 | 4947 | 1491 | 496 | 130 | 2.6e-05 |

Description
gp:[GI:g454844] [LN:SCMP48EGG] [AC:M74170] [OR:*Schistosoma mansoni*]
[SR:*Schistosoma mansoni* (strain NMRI) female adult worm DNA]
[DB:genpept-inv1] [DE:*Schistosoma mansoni* p48 eggshell protein gene,
complete cds.] [NT:ORF 3] [LE:687] [RE:1868] [DI:complement]

| ORF Name | NT ID | AA ID | NT LN | AA LN | Score | P-Value |
|---|---|---|---|---|---|---|
| AI7503000985_34617937_f3_1227 | 1176 | 4948 | 525 | 174 | 223 | 1.3e-17 |

Description
gp:[GI:g2952545] [LN:AF051898] [AC:AF051898] [PN:coronin binding protein]
[GN:DB10] [OR:Dictyostelium discoideum] [DB:genpept-inv1] [DE:*Dictyostelium
discoideum* coronin binding protein (DB10) mRNA, complete cds.] [LE:108]
[RE:1790] [DI:direct]

-continued

| ORF Name | NT ID | AA ID | NT LN | AA LN | Score | P-Value |
|---|---|---|---|---|---|---|
| AI7503000985__34647150__c1__1439 | 1177 | 4949 | 1356 | 451 | 274 | 1.6e-23 |

Description
gp:[GI:g2570198] [LN:LSU54556] [AC:U54556] [PN:microfilarial sheath protein
SHP3] [GN:shp3] [OR:*Litomosoides sigmodontis*] [DB:genpept-inv1]
[DE:*Litomosoides sigmodontis* microfilarial sheath proteins SHP3a (shp3a) and
SHP3 (shp3) genes, complete cds.] [NT:structural protein; similar to shp3
genes from] [LE:7991:8260] [RE:8047:9219] [DI:directJoin]

| ORF Name | NT ID | AA ID | NT LN | AA LN | Score | P-Value |
|---|---|---|---|---|---|---|
| AI7503000985__35193950__c2__1811 | 1178 | 4950 | 489 | 162 | | |

Description
NO-HIT

| ORF Name | NT ID | AA ID | NT LN | AA LN | Score | P-Value |
|---|---|---|---|---|---|---|
| AI7503000985__35317188__c2__1684 | 1179 | 4951 | 6414 | 2137 | 2779 | 2.4e-289 |

Description
gp:[GI:g3929312] [LN:AF100426] [AC:AF100426] [PN:fimbriae-associated protein
Fap1] [GN:fap1] [OR:*Streptococcus parasanguinis*] [DB:genpept-bct2]
[DE:*Streptococcus parasanguis* fimbriae-associated protein Fap1 (fap1) gene,
complete cds.] [NT:invovled in fimbriae assembly and fimbriae-mediated]
[LE:284] [RE:7996] [DI:direct]

| ORF Name | NT ID | AA ID | NT LN | AA LN | Score | P-Value |
|---|---|---|---|---|---|---|
| AI7503000985__35433438__f3__1030 | 1180 | 4952 | 1137 | 378 | 420 | 2.3e-39 |

Description
sp:[LN:GLOX__BACSU] [AC:O31616] [GN:YJBR] [OR:*BACILLUS SUBTILIS*] [EC:1.5.3.-]
[DE:GLYCINE OXIDASE,] [SP:O31616] [DB:swissprot] >pir:[LN:B69845] [AC:B69845]
[PN:sarcosine oxidase homolog yjbR] [GN:yjbR] [OR:*Bacillus subtilis*]
[DB:pir2] >gp:[GI:e1183187:g2633521] [LN:BSUB0007] [AC:Z99110:AL009126]
[GN:yjbR] [FN:unknown] [OR:*Bacillus subtilis*] [DB:genpept-bct1] [DE:*Bacillus
subtilis* complete genome (section 7 of 21):from 1194391 to 1411140.]
[NT:similar to sarcosine oxidase] [SP:O31616] [LE:48816] [RE:49925]
[DI:direct]

| ORF Name | NT ID | AA ID | NT LN | AA LN | Score | P-Value |
|---|---|---|---|---|---|---|
| AI7503000985__35449093__c2__1668 | 1181 | 4953 | 831 | 276 | 103 | 0.0069 |

Description
sp:[LN:YHI3__LACLA] [AC:Q02147] [OR:*LACTOCOCCUS LACTIS*]
[SR:,*SUBSPLACTIS*:*STREPTOCOCCUS LACTIS*] [DE:HYPOTHETICAL 38.0 KD PROTEIN IN
HISC-HISG INTERGENIC REGION (ORF3)] [SP:Q02147] [DB:swissprot]
>pir:[LN:C45734] [AC:C45734] [PN:histidyl-tRNA synthetase homolog]
[OR:*Lactococcus lactis* subsp. *lactis*]LDB:pir2] >gp:[GI:g2565140]
[LN:LLU92974] [AC:U92974:M90760:M90761] [PN:unknown] [OR:*Lactococcus lactis*]
[DB:genpept-bct1] [DE:*Lactococcus lactis* unknown gene, partial cds, and HisC
(hisC), unknown, HisG (hisG), unknown, HisB (hisB), unknown, HisH (hish), HisA
(hisA), HisF (hisF), HisIE (hisIE), unknown, unknown, LeuA (leuA), LeuB
(leuB), LeuC (leuC), LeuD (leuD), unknown, IlvD (ilvD), IlvB (ilvB), IlvN,
IlvC (ilvC), IlvA (ilvA), AldB (aldB) and aldR (aldR) genes, complete cds.]
[NT:ORF2; potential regulator; similar to histidyl-tRNA] [LE:2146] [RE:3132]
[DI:direct]

| ORF Name | NT ID | AA ID | NT LN | AA LN | Score | P-Value |
|---|---|---|---|---|---|---|
| AI7503000985__35687__f2__812 | 1182 | 4954 | 162 | 53 | | |

Description
NO-HIT

| ORF Name | NT ID | AA ID | NT LN | AA LN | Score | P-Value |
|---|---|---|---|---|---|---|
| AI7503000985__35817137__f3__1254 | 1183 | 4955 | 156 | 51 | | |

Description
NO-HIT

| ORF Name | NT ID | AA ID | NT LN | AA LN | Score | P-Value |
|---|---|---|---|---|---|---|

-continued

| | | | | | | |
|---|---|---|---|---|---|---|
| AI7503000985__35993802__c2__1685 | 1184 | 4956 | 1584 | 527 | | |

Description
NO-HIT

| ORF Name | NT ID | AA ID | NT LN | AA LN | Score | P-Value |
|---|---|---|---|---|---|---|
| AI7503000985__35995316__f1__393 | 1185 | 4957 | 1257 | 418 | 2160 | 9.6e-224 |

Description
pir:[LN:S77608] [AC:S77608] [PN:probable intercellular adhesion protein
A:glycosyltransferase:icaA protein] [GN:icaA] [OR:*Staphylococcus
epidermidis*] [DB:pir2] >gp:[GI:g1161380] [LN:SEU43366] [AC:U43366] [PN:IcaA]
[GN:icaA] [OR:*Staphylococcus epidermidis*] [DB:genpept-bct2]
[DE:*Staphylococcus epidermidis* operon mediating intercellular adhesion:IcaR,
IcaA, IcaD, IcaB, and IcaC genes, complete cds.] [LE:761] [RE:1999]
[DI:direct]

| ORF Name | NT ID | AA ID | NT LN | AA LN | Score | P-Value |
|---|---|---|---|---|---|---|
| AI7503000985__36127302__c2__1875 | 1186 | 4958 | 888 | 295 | 1058 | 5.7e-107 |

Description
sp:[LN:GTAB_BACSU] [AC:Q05852] [GN:GTAB] [OR:*BACILLUS SUBTILIS*] [EC:2.7.7.9]
[DE:(GENERAL STRESS PROTEIN 33) (G5P33)] [SP:Q05852] [DB:swissprot]
>pir:[LN:A40650] [AC:A40650:B69638] [PN:UTP--glucose-1-phosphate
uridylyltransferase,:UDP-glucose pyrophosphorylase] [GN:gtaB]
[CL:*Escherichia coli* UTP--glucose-1-phosphate uridylyltransferase]
[OR:*Bacillus subtilis*] [EC:2.7.7.9] [DB:pirl] >gp:[GI:g289287] [LN:BACGTABX]
[AC:L12272] [PN:UDP-glucose pyrophosphorylase] [GN:gtaB] [OR:*Bacillus
subtilis*] [SR:*Bacillus subtilis* (strain 168, sub_species Marburg) DNA]
[DB:genpept-bct1] [EC:2.7.7.9] [DE:*Bacillus subtilis* UDP-glucose
pyrophosphorylase (gtaB) gene, complete cds.] [NT:similar to UDP-glucose
pyrophosphorylase of] [LE:120] [RE:9981 [DI:direct] >gp:[GI:g405623]
[LN:BSLYTGTA] [AC:Z22516] [PN:UDP-glucose pyrophosphorylase] [GN:gtaB]
[OR:*Bacillus subtilis*] [DB:genpept-bct1] [EC:2.7.7.9] [DE:*B. subtilis* lytR,
orfX, and gtaB genes.] [NT:similar to other procaryotic UDP-glucose]
[SP:Q05852] [LE:1581] [RE:2459] [DI:direct] >gp:[GI:e1184473:g2636093]
[LN:BSUB0019] [AC:Z99122:AL009126] [PN:UTP-glucose-1-phosphate
uridylyltransferase] [GN:gtaB] [FN:glucosylation of teichoic acid]
[OR:*Bacillus subtilis*] [DB:genpept-bct1] [EC:2.7.7.9] [DE:*Bacillus subtilis*
complete genome (section 19 of 21):from 3597091 to 3809700.] [SP:Q05852]
[LE:67599] [RE:68477] [DI:direct] >gp:[GI:e1184473:g2636093] [LN:BSUB0019]
[AC:Z99122:AL009126] [PN:UTP-glucose-1-phosphate uridylyltransferase]
[GN:gtaB] [FN:glucosylation of teichoic acid] [OR:*Bacillus subtilis*]
[DB:genpept] [EC:2.7.7.9] [DE:*Bacillus subtilis* complete genome (section 19
of 21):from 3597091 to 3809700.] [SP:Q05852] [LE:67599] [RE:68477]
[DI:direct]

| ORF Name | NT ID | AA ID | NT LN | AA LN | Score | P-Value |
|---|---|---|---|---|---|---|
| AI7503000985__36134678__c3__2220 | 1187 | 4959 | 699 | 232 | 674 | 2.8e-66 |

Description
pir:[LN:F69670] [AC:F69670] [PN:glycine betaine/carnitine/choline ABC
transporter (membrane p) opuCD] [GN:OpUCD] [CL:glycine
betaine/carnitine/choline ABC transporter] [OR:*Bacillus subtilis*] [DB:pir2]
>gp:[GI:g2271392] [LN:AF009352] [AC:AF009352] [PN:transmembrane protein]
[GN:opuCD] [OR:*Bacillus subtilis*] [DB:genpept-bct1] [DE:*Bacillus subtilis*
osmoprotectant transport system OpuC including ATPase (opuCA), transmembrane
protein (opuCB), osmoprotectant binding protein precursor (opuCC) and
transmembrane protein (opuCD) genes, complete cds.] [NT:OpuCD; part of the
osmoprotectant transport system] [LE:3627] [RE:4316] [DI:direct]
>gp:[GI:e1186068:g2635893] [LN:BSUB0018] [AC:Z99121:AL009126] [PN:glycine
betaine/carnitine/choline ABC] [GN:opuCD] [FN:high affinity transport of
glycine betaine,] [OR:*Bacillus subtilis*] [DB:genpept-bct1] [DE:*Bacillus
subtilis* complete genome (section 18 of 21):from 3399551 to 3609060.]
[NT:alternate gene name:yvbB] [LE:67059] [RE:67748] [DI:complement]

| ORF Name | NT ID | AA ID | NT LN | AA LN | Score | P-Value |
|---|---|---|---|---|---|---|
| AI7503000985__36142510__c1__1394 | 1188 | 4960 | 132 | 43 | | |

Description
NO-HIT

| ORF Name | NT ID | AA ID | NT LN | AA LN | Score | P-Value |
|---|---|---|---|---|---|---|

| | | | | | | |
|---|---|---|---|---|---|---|
| AI7503000985__36151692_c2__1840 | 1189 | 4961 | 681 | 226 | 671 | 5.8e-66 |

Description
sp:[LN:YFKO__BACSU] [AC:O34475] [GN:YFKO] [OR:*BACILLUS SUBTILIS*] [EC:1.-.-.-]
[DE:PUTATIVE NAD(P)H NITROREDUCTASE YFKO,] [SP:O34475] [DB:swissprot]
>pir:[LN:B69809] [AC:B69809] [EPN:NAD(P)H-flavin oxidoreductase homolog
yfkO] [GN:yfkO] [CL:nitroreductase] [OR:*Bacillus subtilis*] [DB:pir2]
>gp:[GI:e1182773:g2633107] [LN:BSUB0005] [AC:Z99108:AL009126] [GN:yfkO]
[FN:unknown] [OR:*Bacillus Subtilis*] [DB:genpept-bct1] [DE:*Bacillus subtilis*
complete genome (section 5 of 21):from 802821 to 1011250.] [NT:similar to
NAD(P)H-flavin oxidoreductase] [SP:O34475] [LE:51099] [RE:51764] [DI:direct]
>gp:[GI:d1024284:g2626827] [LN:D83967] [AC:D83967] [PN:YfkO] [OR:*Bacillus
subtilis*] [SR:*Bacillus subtilis* (strain:AC327) DNA] [DB:genpept-bct1]
[DE:*Bacillus subtilis* genomic DNA, 74 degree region.] [LE:16157] [RE:16822]
[DI:complement]

| ORF Name | NT ID | AA ID | NT LN | AA LN | Score | P-Value |
|---|---|---|---|---|---|---|
| AI7503000985__36205285_c2__1717 | 1190 | 4962 | 780 | 259 | 284 | 6.0e-25 |

Description
sp:[LN:XYNC__CALSA] [AC:P23553] [GN:XYNC] [OR:*CALDOCELLUM SACCHAROLYTICUM*]
[SR:, *CALDICELLULOSIRUPTOR SACCHAROLYTICUS*] [EC:3.1.-.-] [DE:ACETYL ESTERASE,
(ACETYLXYLOSIDASE)] [SP:P23553] [DB:swissprot] >pir:[LN:B37202] [AC:B37202]
[PN:acetylesterase, (XyriC)] [OR:*Caldocellum saccharolyticum*] [EC:3.1.1.6]
[DB:pir2] >gp:[GI:g144297] [LN:CDCXYNAB] [AC:M34459]
[OR:*Caldicellulosiruptor saccharolyticus*] [SR:*C. saccharolyticum* DNA, clone
pNZ1400] [DB:genpept-bct1] [DE:*C. saccharolyticum* xylanase A (XynA),
beta-xylosidase (XynB) and acetyl esterase (XynC) genes, complete cds.]
[NT:acetyl esterase (XynC)] [LE:1257] [RE:2057] [DI:direct]
>gp:[GI:g2645420] [LN:AF005383] [AC:AF005383] [PN:acetylxylosidase]
[GN:XynC] [OR:*Caldicellulosiruptor saccharolyticus*] [DB:genpept-bct2]
[DE:*Caldicellulosiruptor saccharolyticus* putative transport protein (XynG),
putative transport protein (XynH), xylanase (XynF), xylanase (XynE), xylanase
(XynD), xylanase (XynA), acetylxylosidase (XynC) and xylanase (XynB) genes,
complete cds.] [LE:13673] [RE:14473] [DI:direct]

| ORF Name | NT ID | AA ID | NT LN | AA LN | Score | P-Value |
|---|---|---|---|---|---|---|
| AI7503000985__36214052_c3__1981 | 1191 | 4963 | 999 | 332 | 169 | 1.3e-10 |

Description
sp:[LN:Y31K__SULAC] [AC:P46218] [OR:*SULFOLOBUS ACIDOCALDARIUS*]
[DE:HYPOTHETICAL 31.5 KD PROTEIN] [SP:P4G2l8] [DB:swissprot]
>gp:[GI:g458265] [LN:SAU05664] [AC:U05664] [OR:*Sulfolobus acidocaldarius*]
[DB:genpept-bct1] [DE:*Sulfolobus acidocaldarius* RNA polymerase subunit
homolog gene, complete cds.] [NT:homologous to Swiss-Prot Accession Number
P20435:] [LE:61] [RE:888] [DI:direct]

| ORF Name | NT ID | AA ID | NT LN | AA LN | Score | P-Value |
|---|---|---|---|---|---|---|
| AI7503000985__36225250_c2__1711 | 1192 | 4964 | 1542 | 513 | 2622 | 1.1e-272 |

Description
sp:[LN:SEPA__STAEP] [AC:P43148] [GN:SEPA] [OR:*STAPHYLOCOCCUS EPIDERMIDIS*]
[EC:3.4.24.-] [DE:EXTRACELLULAR ELASTASE PRECURSOR, (SEPP1)] [SP:P43148]
[DB:swissprot] >pir:[LN:A40659] [AC:A40659] [PN:elastase, SepP1]
[OR:*Staphylococcus epidermidis*] [EC:3.4.24.-] [DB:pir2] >gp:[GI:g396259]
[LN:SESEPP1A] [AC:X69957] [PN:protease] [GN:SepP1] [OR:*Staphylococcus
epidermidis*] [DB:genpept-bct1] [DE:*S. epidermis* gene for protease.]
[SP:P43148] [LE:164] [RE:1687] [DI:direct]

| ORF Name | NT ID | AA ID | NT LN | AA LN | Score | P-Value |
|---|---|---|---|---|---|---|
| AI7503000985__36228252_c3__1990 | 1193 | 4965 | 777 | 258 | 678 | 1.1e-66 |

Description
sp:[LN:HIS6__BACSU] [AC:O34727] [GN:HISF] [OR:*BACILLUS SUBTILIS*] [DE:HISF
PROTEIN (CYCLASE)] [SP:O34727] [DB:swissprot] >pir:[LN:B69641] [AC:B69641]
[PN:HisF cyclase-like protein hisF] [GN:hisF] [CL:cyclase hisF]
[OR:*Bacillus subtilis*] [DB:pir2] >gp:[GI:e1186175:g2636000] [LN:BSUB0018]
[AC:Z99121:AL009126] [PN:HisF cyclase-like protein] [GN:hisF] [FN:synthesis
of D-erythro-imidazole glycerol] [OR:*Bacillus subtilis*] [DB:genpept-bct1]
[DE:*Bacillus subtilis* complete genome (section 18 of 21):from 3399551 to
3609060.] [SP:O34727] [LE:183072] [RE:183830] [DI:complement]
>gp:[GI:g2618870] [LN:AF017113] [AC:AF017113] [PN:cyclase] [GN:hisF]

[OR:*Bacillus subtilis*] [DB:genpept-bct2] [DE:*Bacillus subtilis* 300–304 degree genomic sequence.] [NT:HisF protein] [LE:44003] [RE:44761] [DI:direct]

| ORF Name | NT ID | AA ID | NT LN | AA LN | Score | P-Value |
|---|---|---|---|---|---|---|
| AI7503000985__36366326__c2__1646 | 1194 | 4966 | 771 | 256 | 409 | 3.4e-38 |

Description
pir:[LN:B69906] [AC:B69906] [PN:rarD protein homolog yojE] [GN:yojE] [CL:*Escherichia coli* rarD protein] [OR:*Bacillus subtilis*] [DB:pir2] >gp:[GI:e1185420:g2634341] [LN:BSUB0011] [AC:Z99114:AL009126] [GN:yojE] [FN:unknown] [OR:*Bacillus subtilis*] [DB:genpept-bct1] [DE:*Bacillus subtilis* complete genome (section 11 of 21):from 2000171 to 2207900.] [NT:similar to hypothetical proteins] [LE:122204] [RE:122995] [DI:complement] >gp:[GI:g3169320] [LN:AF026147] [AC:AF026147] [PN:YojD] [GN:yojD] [FN:unknown] [OR:*Bacillus subtilis*] [DB:genpept-bct2] [DE:*Bacillus subtilis* YojA (yojA), YojB (yojB), YojC (yojC), YojD (yojD), YojE (yojE), YojF (yojF), YojG (yojG), YojH (yojH), YojI (yojI), YojJ (yojJ), YojK (yojK), YojL (yojL), YojM (yojM), YojN (yojN), and YojO (yojO) genes, complete cds; and OdhA (odhA) gene,partial cds.] [NT:similar to *Escherichia coli* RarD protein:] [LE:2270] [RE:3061] [DI:direct]

| ORF Name | NT ID | AA ID | NT LN | AA LN | Score | P-Value |
|---|---|---|---|---|---|---|
| AI7503000985__36617832__c1__1459 | 1195 | 4967 | 801 | 266 | 758 | 3.5e-75 |

Description
sp:[LN:SUMT_BACME] [AC:P29928] [GN:COBA] [OR:*BACILLUS MEGATERIUM*] [EC:2.1.1.107] [DE:(METHYLASE) (SUMT) (UROPORPHYRINOGEN III METHYLASE) (UROM)] [SP:P29928] [DB:swissprot] >pir:[LN:A42479] [AC:A42479] [PN:S-adenosyl-L-methionine uroporphyrinogen III methyltransferase] [CL:S-adenosyl-L-methionine uroporphyrinogen methyltransferase] [OR:*Bacillus megaterium*] [DB:pir2] >gp:[GI:g142695] [LN:BACCOBA] [AC:M62881] [PN:S-adenosyl-L-methionine:uroporphyrinogen III] [GN:COBA] [ER:*Bacillus megaterium*] [SR:*Bacillus megaterium* DNA] [DB:genpept-bct1] [DE:*Bacillus megaterium* S-adenosy-L-methionine:uroporphyrinogen III methyltransferase (COBA) gene, complete cds.] [NT:ATCC #1078] [LE:119] [RE:835] [DI:direct]

| ORF Name | NT ID | AA ID | NT LN | AA LN | Score | P-Value |
|---|---|---|---|---|---|---|
| AI7503000985__38876__f2__481 | 1196 | 4968 | 147 | 48 | | |

Description
NO-HIT

| ORF Name | NT ID | AA ID | NT LN | AA LN | Score | P-Value |
|---|---|---|---|---|---|---|
| AI7503000985__3906718__f1__67 | 1197 | 4969 | 1065 | 354 | 747 | 5.2e-74 |

Description
pir:[LN:H69789] [AC:H69789] [PN:L-iditol 2-dehydrogenase, homolog ydjL:sorbitol dehydrogenase homolog] [GN:ydjL] [CL:alcohol dehydrogenase:long-chain alcohol dehydrogenase homology] [OR:*Bacillus subtilis*] [EC:1.1.1.14] [DB:pir1] >gp:[GI:d1023636:g25220161] [LN:AB007638] [AC:AB007638] [PN:dehydrogenase] [GN:ydjL] [OR:*Bacillus subtilis*] [SR:*Bacillus subtilis* (strain:Marburg 168) DNA] [DB:genpept-bct1] [DE:*Bacillus subtilis* genomic DNA containing gutA to cotA region, 48 degree.] [NT:putative] [LE:9403] [RE:10443] [DI:complement] >gp:[GI:e1182603:g2632937] [LN:BSUB0004] [AC:Z99107:AL009126] [GN:ydjL] [FN:unknown] [OR:*Bacillus subtilis*] [DB:genpept-bct1] [DE:*Bacillus subtilis* complete genome (section 4 of 21):from 600701 to 813890.] [NT:similar to L-iditol 2-dehydrogenase] [LE:76928] [RE:779681] [DI:complement]

| ORF Name | NT ID | AA ID | NT LN | AA LN | Score | P-Value |
|---|---|---|---|---|---|---|
| AI7503000985__3909376__c2__1681 | 1198 | 4970 | 396 | 131 | 244 | 1.0e-20 |

Description
pir:[LN:H64716] [AC:H64716] [PN:ABC transporter, ATP-binding protein] [CL:ATP-binding cassette homology] [OR:*Helicobacter pylori*] [DB:pir2] >gp:[GI:g2314761] [LN:AE000655] [AC:AE000655:AE000511] [PN:ABC transporter, ATP-binding protein (abc)] [GN:HP1576] [OR:*Helicobacter pylori* 26695] [DB:genpept-bct2] [DE:*Helicobacter pylori* 26695 section 133 of 134 of the complete genome.] [NT:similar to GB:L42023 SP:P44785 PID:1005459] [LE:1828] [RE:2811] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000985__3910675__f3__1222 | 1199 | 4971 | 234 | 77 | 57 | 0.0048 |

Description
gp:[GI:g3293452] [LN:AF069160] [AC:AF069160] [PN:NADH dehydrogenase 1]
[FN:respiratory enzyme] [OR:*Mitochondrion Aphidius ervi*] [SR:*Aphidius ervi*]
[DB:genpept-inv1] [DE:*Aphidius ervi* NADH dehydrogenase 1 gene, mitochondrial
gene encoding mitochondrial protein, partial cds.] [LE:<1] [RE:>465]
[DI:direct] >gp:[GI:g3293458] [LN:AF069163] [AC:AF069163] [PN:NADH
dehydrogenase 1] [FN:respiratory enzyme] [OR:*Mitochondrion Aphidius picipes*]
[SR:*Aphidius picipes*] [DB:genpept-inv1] [DE:*Aphidius picipes* NADH
dehydrogenase 1 gene, mitochondrial gene encoding mitochondrial protein,
partial cds.] [LE:<1] [RE:>465] [DI:direct] >gp:[GI:g3293460] [LN:AF069164]
[AC:AF069164] [PN:NADH dehydrogenase 1] [FN:respiratory enzyme]
[OR:*Mitochondrion Aphidius pisivorus*] [SR:*Aphidius pisivorus*]
[DB:genpept-inv1] [DE:*Aphidius pisivorus* NADH dehydrogenase 1 gene,
mitochondrial gene encoding mitochondrial protein, partial cds.] [LE:<1]
[RE:>465] [DI:direct] >gp:[GI:g3293464] [LN:AF069166] [AC:AF069166] [PN:NADH
dehydrogenase 1] [FN:respiratory enzyme] [OR:*Mitochondrion Aphidius sonchi*]
[SR:*Aphidius sonchi*] [DB:genpept-inv1] [DE:*Aphidius sonchi* NADH
dehydrogenase 1 gene, mitochondrial gene encoding mitochondrial protein,
partial cds.] [LE:<1] [RE:>465] [DI:direct]

| ORF Name | NT ID | AA ID | NT LN | AA LN | Score | P-Value |
|---|---|---|---|---|---|---|
| AI7503000985__3923842__c2__1832 | 1200 | 4972 | 891 | 296 | 876 | 1.1e-87 |

Description
gp:[GI:g4959402] [LN:AF115391] [AC:AF115391] [PN:putative ribose transporter
RbsU] [GN:rbsU] [OR:*Lactobacillus sakei*] [DB:genpept-bct2] [DE:*Lactobacillus
sakei* LaaA (laaA) gene, partial cds; LaaB (laaB), putative acetate kinase
AckA (ackA), LaaC (laaC) genes, complete cds; rbs operon, complete sequence;
and LaaE (laaE) gene, partial cds.] [LE:3130] [RE:4014] [DI:direct]

| ORF Name | NT ID | AA ID | NT LN | AA LN | Score | P-Value |
|---|---|---|---|---|---|---|
| AI7503000985__3928162__f2__665 | 1201 | 4973 | 141 | 46 | | |

Description
NO-HIT

| ORF Name | NT ID | AA ID | NT LN | AA LN | Score | P-Value |
|---|---|---|---|---|---|---|
| AI7503000985__3928416__f1__170 | 1202 | 4974 | 123 | 40 | | |

Description
NO-HIT

| ORF Name | NT ID | AA ID | NT LN | AA LN | Score | P-Value |
|---|---|---|---|---|---|---|
| AI7503000985__3933177__f2__683 | 1203 | 4975 | 126 | 41 | | |

Description
NO-HIT

| ORF Name | NT ID | AA ID | NT LN | AA LN | Score | P-Value |
|---|---|---|---|---|---|---|
| AI7503000985__3941078__f1__114 | 1204 | 4976 | 324 | 107 | 110 | 1.6e-06 |

Description
pir:[LN:C69845] [AC:C69845] [PN:hypothetical protein yjbS] [GN:yjbS]
[OR:*Bacillus subtilis*] [DB:pir2] >gp:[GI:e1183188:g2633522] [LN:BSUB0007]
[AC:Z99110:AL009126] [GN:yjbS] [FN:unknown] [OR:*Bacillus subtilis*]
[DB:genpept-bct1] [DE:*Bacillus subtilis* complete genome (section 7 of 21):
from 1194391 to 1411140.] [LE:49925] [RE:50125] [DI:direct]

| ORF Name | NT ID | AA ID | NT LN | AA LN | Score | P-Value |
|---|---|---|---|---|---|---|
| AI7503000985__3941436__f1__6 | 1205 | 4977 | 150 | 49 | | |

Description
NO-HIT

| ORF Name | NT ID | AA ID | NT LN | AA LN | Score | P-Value |
|---|---|---|---|---|---|---|
| AI7503000985__3953400__f1__314 | 1206 | 4978 | 195 | 64 | 49 | 0.017 |

Description
sp:[LN:RFA1_KLEPN] [AC:Q484751 [GN:RFBA] [OR:*KLEBSIELLA PNEUMONIAE*]
[DE:O-ANTIGEN EXPORT SYSTEM PERMEASE PROTEIN RFBA] [SP:Q48475]

-continued

[DB:swissprot] >pir:[LN:560882] [AC:560882] [PN:integral membrane O-antigen
translocator protein rfbA] [GN:rfbA] [CL:integral membrane O-antigen
translocator protein rfbA] [OR:*Klebsiella pneumoniae*] [DB:pir2]
>gp:[GI:g567182] [LN:KPNRFBA] [AC:L31775] [PN:integral membrane O-antigen
translocator] [GN:wzm] [OR:*Klebsiella pneumoniae*] [DB:genpept-bct2]
[DE:*Klebsiella pneumoniae* integral membrane O-antigen translocator protein
(wzm) and ATP-binding protein (wzt) genes, complete cds; and WbbM (wbbM)
gene, partial cds.] [NT:similar to kpsM (*E. coli*), bexA (*H. influenzae*),]
[LE:324] [RE:1103] [DI:direct]

| ORF Name | NT ID | AA ID | NT LN | AA LN | Score | P-Value |
|---|---|---|---|---|---|---|
| AI7503000985__4004643__f3__1285 | 1207 | 4979 | 201 | 66 | | |

Description
NO-HIT

| ORF Name | NT ID | AA ID | NT LN | AA LN | Score | P-Value |
|---|---|---|---|---|---|---|
| AI7503000985__4069643__c3__2243 | 1208 | 4980 | 480 | 159 | 160 | 8.2e-12 |

Description
gp:[GI:e1310302:g3294247] [LN:SC7C7] [AC:AL031031] [PN:hypothetical protein
SC7C7.14] [GN:SC7C7.14] [OR:*Streptomyces coelicolor*] [DB:genpept-bct1]
[DE:*Streptomyces coelicolor* cosmid 7C7.] [NT:5C7C7.14, unknown, len:161 aa]
[LE:24125] [RE:24610] [DI:direct]

| ORF Name | NT ID | AA ID | NT LN | AA LN | Score | P-Value |
|---|---|---|---|---|---|---|
| AI7503000985__4079552__f2__696 | 1209 | 4981 | 630 | 209 | 87 | 0.0012 |

Description
gp:[GI:g252560] [LN:54406852] [AC:S44069] [GN:VP4/VP2] [OR:Hepatitis A
virus] [SR:Hepatitis A virus LSH/S] [DB:genpept-vrl] [DE:VPl . . . 3C/3D
[hepatitis A virus HAy, LSH/S, Genomic, 6 genes, 2GGnt, segment 2 of 7].]
[NT:This sequence comes from FIG. 3.] [LE:1] [RE:266] [DI:direct]

| ORF Name | NT ID | AA ID | NT LN | AA LN | Score | P-Value |
|---|---|---|---|---|---|---|
| AI7503000985__4079626__f1__336 | 1210 | 4982 | 192 | 63 | 70 | 0.018 |

Description
sp:[LN:UTMP_BOVIN] [AC:P46201] [OR:*BOS TAURUS*] [SR:,BOVINE] [DE:UTERINE MILK
PROTEIN PRECURSOR (UTMP)] [SP:P46201] [DB:swissprot] >gp:[GI:g438481]
[LN:BOVSPIS] [AC:L22095] [PN:serine proteinase inhibitor precursor] [OR:*Bos
taurus*] [DB:genpept-mam] [DE:*Bos taurus* uterine milk protein precursor,
mRNA, complete cds.] [NT:uterine milk protein] [LE:19] [RE:1398] [DI:direct]

| ORF Name | NT ID | AA ID | NT LN | AA LN | Score | P-Value |
|---|---|---|---|---|---|---|
| AI7503000985__4084635__f2__483 | 1211 | 4983 | 141 | 46 | | |

Description
NO-HIT

| ORF Name | NT ID | AA ID | NT LN | AA LN | Score | P-Value |
|---|---|---|---|---|---|---|
| AI7503000985__4084717__f3__961 | 1212 | 4984 | 621 | 206 | 110 | 0.00027 |

Description
pir:[LN:B70045] [AC:B70045] [PN:hypothetical protein yvpB] [GN:yvpB]
[OR:*Bacillus subtilis*] [DB:pir2] >gp:[GI:e1186182:g2636007] [LN:BSUB0018]
[AC:Z99121:AL009126] [GN:yvpB] [FN:unknown] [OR:*Bacillus subtilis*]
[DB:genpept-bct1] [DE:*Bacillus subtilis* complete genome (section 18 of 21):
from 3399551 to 3609060.] [LE:189121] [RE:189873] [DI:direct]
>gp:[GI:g2618863] [LN:AF017113] [AC:AF017113] [PN:YvpB] [GN:yvpB]
[OR:*Bacillus subtilis*] [DB:genpept-bct2] [DE:*Bacillus subtilis* 300–304
degree genomic sequence.] [LE:37960] [RE:38712] [DI:complement]

| ORF Name | NT ID | AA ID | NT LN | AA LN | Score | P-Value |
|---|---|---|---|---|---|---|
| AI7503000985__4093932__f1__69 | 1213 | 4985 | 135 | 44 | | |

Description
NO-HIT

-continued

| ORF Name | NT ID | AA ID | NT LN | AA LN | Score | P-Value |
|---|---|---|---|---|---|---|
| AI7503000985_4094703_c1_1446 | 1214 | 4986 | 2022 | 673 | 224 | 3.7e-21 |

Description
pir:[LN:B70001] [AC:B70001] [PN:ABC transporter (permease) homolog ytsD]
[GN:ytsD] [OR:*Bacillus subtilis*] [DB:pir2] >gp:[GI:e1185910:g2635521]
[LN:BSUB0016] [AC:Z99119:AL009126] [GN:ytsD] [FN:unknown] [OR:*Bacillus subtilis*] [DB:genpept-bct1] [DE:*Bacillus subtilis* complete genome (section 16 of 21):from 2997771 to 3213410.] [NT:similar to ABC transporter (permease)] [LE:110708] [RE:112648] [DI:complement] >gp:[GI:g2293178]
[LN:AF008220] [AC:AF008220] [PN:YtsD] [GN:ytsD] [OR:*Bacillus subtilis*]
[DB:genpept-bct2] [DE:*Bacillus subtilis* rrnB-dnaB genomic region.]
[NT:similarity to NADH dehydrogenase] [LE:67779] [RE:69719] [DI:direct]

| ORF Name | NT ID | AA ID | NT LN | AA LN | Score | P-Value |
|---|---|---|---|---|---|---|
| AI7503000985_40966_c3_2016 | 1215 | 4987 | 1626 | 541 | | |

Description
NO-HIT

| ORF Name | NT ID | AA ID | NT LN | AA LN | Score | P-Value |
|---|---|---|---|---|---|---|
| AI7503000985_4098518_f1_48 | 1216 | 4988 | 711 | 236 | 121 | 5.8e-08 |

Description
sp:[LN:ARP_PLAFA] [AC:P04931] [OR:*PLASMODIUM FALCIPARUM*] [DE:ASPAPAGINE-RICH
PROTEIN (AG319) (ARP) (FRAGMENT)] [SP:PO4931] [DB:swissprot]
>pir:[LN:A23770] [AC:A23770] [PN:asparagine-rich protein] [OR:*Plasmodium falciparum*] [DB:pir2] >gp:[GI:g160092] [LN:PFAARP] [AC:M24328:X03716]
[PN:asparagine-rich protein] [GN:Ag319] [OR:*Plasmodium falciparum*]
[SR:*Plasmodium falciparum* (Ghanaian isolate NF7) asexual bloodstage]
[DB:genpept-inv1] [DE:*Plasmodium falciparum* asparagine-rich protein (ARP), partial cds.] [LE:1] [RE:1612] [DI:direct]

| ORF Name | NT ID | AA ID | NT LN | AA LN | Score | P-Value |
|---|---|---|---|---|---|---|
| AI7503000985_4100453_c3_2260 | 1217 | 4989 | 1044 | 347 | 329 | 1.0e-20 |

Description
sp:[LN:DEGS_BACBR] [AC:P54663] [GN:DEGS] [OR:*BACILLUS BREVIS*] [EC:2.7.3.-]
[DE:SENSOR PROTEIN DEGS,] [SP:P54663] [DB:swissprot] >pir:[LN:I39834]
[AC:I39834] [PN:protein kinase] [GN:degS] [CL:regulatory protein degS]
[OR:*Bacillus brevis*] [DB:pir2] >gp:[GI:g710495] [LN:BACDEGSU] [AC:L15444]
[PN:protein kinase] [GN:degS] [OR:*Brevibacillus brevis*] [SR:*Bacillus brevis* (strain Alk36) DNA] [DB:genpept-bct2] [DE:*Bacillus brevis* protein kinase (degs) gene, complete cds;transcriptional activator protein (degU) gene, complete cds.] [NT:putative] [LE:398] [RE:1558] [DI:direct]

| ORF Name | NT ID | AA ID | NT LN | AA LN | Score | P-Value |
|---|---|---|---|---|---|---|
| AI7503000985_4100938_c2_1860 | 1218 | 4990 | 534 | 177 | 293 | 1.1e-25 |

Description
sp:[LN:GUDT_BACSU] [AC:P42237] [GN:YCBE] [OR:*BACILLUS SUBTILIS*] [DE:PROBABLE
GLUCARATE TRANSPORTER] [SP:P42237] [DB:swissprot] >pir:[LN:H69752]
[AC:H69752] [PN:probalble glucarate transporter] [GN:ycbE] [CL:hexuronate
transporter] [OR:*Bacillus subtilis*] [DB:pir2] >gp:[GI:d1007040:g709999]
[LN:BACYCB20] [AC:D30808] [PN:glucarate dehydratase] [GN:ycbE] [OR:*Bacillus subtilis*] [SR:*Bacillus subtilis* (strain:168TrpC2) DNA] [DB:genpept-bct1]
[DE:*Bacillus subtilis* DNA around 20 degrees region of chromosome containing
yckA-T genes.] [LE:3924] [RE:5291] [DI:direct] >gp:[GI:e1182200:g2632534]
[LN:BSUB0002] [AC:Z99105:AL009126] [GN:ycbE] [FN:unknown] [OR:*Bacillus subtilis*] [DB:genpept-bct1] [DE:*Bacillus subtilis* complete genome (section 2 of 21):from 194651 to 415810.] [NT:similar to glucarate transporter]
[SP:P42237] [LE:75738] [RE:77105] [DI:direct]

| ORF Name | NT ID | AA ID | NT LN | AA LN | Score | P-Value |
|---|---|---|---|---|---|---|
| AI7503000985_4110712_c1_1353 | 1219 | 4991 | 591 | 196 | | |

Description
NO-HIT

| ORF Name | NT ID | AA ID | NT LN | AA LN | Score | P-Value |
|---|---|---|---|---|---|---|
| AI7503000985_4112527_f2_563 | 1220 | 4992 | 144 | 47 | | |

-continued

| Description |
|---|
| NO-HIT |

| ORF Name | NT ID | AA ID | NT LN | AA LN | Score | P-Value |
|---|---|---|---|---|---|---|
| AI7503000985_4112788_c1_1497 | 1221 | 4993 | 141 | 46 | | |

| Description |
|---|
| NO-HIT |

| ORF Name | NT ID | AA ID | NT LN | AA LN | Score | P-Value |
|---|---|---|---|---|---|---|
| AI7503000985_4148428_f1_160 | 1222 | 4994 | 1149 | 382 | 528 | 8.3e-51 |

| Description |
|---|
| sp:[LN:ADH_ALCELT] [AC:P14940] [GN:ADH] [OR:*ALCALIGENES EUTROPHUS*] [EC:1.1.1.1] [DE:ALCOHOL DEHYDROGENASE,] [SP:P14940] [DB:swissprot] >pir:[LN:A30196] [AC:A30196] [PN:probable alcohol dehydrogenase,] [CL:alcohol dehydrogenase:long-chain alcohol dehydrogenase homology] [OR:*Alcaligenes eutrophus*] [EC:1.1.1.1] [DB:pirl] >gp:[GI:g141900] [LN:AFAADH] [AC:J03362] [OR:*Ralstonia eutropha*] [SR:*A. eutrophus* (strain H16) DNA, clone SR18] [DB:genpept-bct1] [DE:*A. eutrophus* alcohol dehydrogenase (ADH) gene, complete cds.] [NT:alcohol dehydrogenase (EC 1.1.1.1)] [LE:458] [RE:1558] [DI:direct] |

| ORF Name | NT ID | AA ID | NT LN | AA LN | Score | P-Value |
|---|---|---|---|---|---|---|
| AI7503000985_4164026_f2_793 | 1223 | 4995 | 162 | 53 | 118 | 9.1e-09 |

| Description |
|---|
| pir:[LN:S68609] [AC:S68609] [PN:recombinase Sin] [CL:transposase repressor] [OR:*Staphylococcus aureus*] [DB:pir2] >gp:[GI:g495089] [LN:STASINA] [AC:L23109] [PN:recombinase] [GN:sin] [OR:*Staphylococcus aureus*] [SR:*Staphylococcus aureus* DNA; Transposon Tn4002 (transposable elemen] [DB:genpept-bct1] [DE:*Staphylococcus aureus* recombinase (sin) gene, complete cds.] [NT:putative] [LE:389] [RE:997] [DI:direct] |

| ORF Name | NT ID | AA ID | NT LN | AA LN | Score | P-Value |
|---|---|---|---|---|---|---|
| AI7503000985_4167842_f2_530 | 1224 | 4996 | 201 | 66 | | |

| Description |
|---|
| NO-HIT |

| ORF Name | NT ID | AA ID | NT LN | AA LN | Score | P-Value |
|---|---|---|---|---|---|---|
| AI7503000985_4179635_c3_2003 | 1225 | 4997 | 126 | 41 | | |

| Description |
|---|
| NO-HIT |

| ORF Name | NT ID | AA ID | NT LN | AA LN | Score | P-Value |
|---|---|---|---|---|---|---|
| AI7503000985_4303377_f2_610 | 1226 | 4998 | 270 | 89 | 81 | 0.0019 |

| Description |
|---|
| gp:[GI:g4049784] [LN:AF063866] [AC:AF063866] [PN:ORF MSV234 hypthetical protein] [GN:MSV234] [OR:*Melanoplus sanguinipes entomopoxvirus*] [DB genpept-vrl] [DE:[Melanoplus sanguinipes entomopoxvirus, complete genome.] [LE:201477] [RE:201830] [DI:complement] |

| ORF Name | NT ID | AA ID | NT LN | AA LN | Score | P-Value |
|---|---|---|---|---|---|---|
| AI7503000985_4329453_c1_1533 | 1227 | 4999 | 336 | 111 | 220 | 3.6e-18 |

| Description |
|---|
| pir:[LN:G69781] [AC:G69782.] [PN:thioredoxin homolog ydfQ] [GN:ydfQ] [OR:*Bacillus subtilis*] [DB:pir2] >gp:[GI:d1020138:g1881358] [LN:AB001488] [AC:AB001488] [GN:ydfQ] [OR:*Bacillus subtilis*] [SR:*Bacillus subtilis* (strain:168) DNA] [DB:genpept-bct1] [DE:*Bacillus subtilis* genome sequence, 148 kb sequence of the region between 35 and 47 degree.] [NT:SIMILAR TO THIOREDOXIN.] [LE:131947] [RE:132285] [DI:direct] >gp:[GI:e1182517:g2632851] [LN:BSUB0003] [AC:Z99106:AL009126] [GN:ydfQ] [FN:unknown] [OR:*Bacillus subtilis*] [DB:genpept-bct1] [DE:*Bacillus subtilis* complete genome (section 3 of 21):from 402751 to 611850.] [NT:similar to thioredoxin] [LE:195693] [RE:196031] [DI:direct] |

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000985_4334818_f2_854 | 1228 | 5000 | 1566 | 521 | 111 | 0.018 |

Description
pir:[LN:D71618] [AC:D71618] [PN:hypothetical protein PFB0285c] [GN:PFB0285c]
[OR:*Plasmodium falciparum*] [DB:pir2] >gp:[GI:g3845144] [LN:AE001385]
[AC:AE001385:AE001362] [PN:hypothetical protein] [GN:PFB0285c]
[OR:*Plasmodium falciparum*] [SR:malaria parasite *P. falciparum*]
[DB:genpept-inv2] [DE:*Plasmodium falciparum* chromosome 2, section 22 of 73
of the complete sequence.] [NT:predicted by GlimmerM] [LE:303] [RE:4613]
[DI:complement]

| ORF Name | NT ID | AA ID | NT LN | AA LN | Score | P-Value |
|---|---|---|---|---|---|---|
| AI7503000985_4336088_c1_2078 | 1229 | 5001 | 624 | 207 | 283 | 7.6e-25 |

Description
pir:[LN:F69877] [AC:F69877] [PN:uroporphyrin-III C-methyltransferase
homolog ylnF] [GN:ylnF] [CL:*Aquifex aeolicus* siroheme synthase]
[OR:*Bacillus subtilis*] [DB:pir2] >gp:[GI:e332189:g2462962] [LW:BSPYREYLO]
[AC:AJ000974] [PN:YlnF protein] [GN:ylnF] [OR:*Bacillus subtilis*]
[DB:genpept-bct1] [DE:*Bacillus subtilis* pyrE to yloA gene region.] [LE:5769]
[RE:6257] [DI:direct] >gp:[GI:e1185155:g2633936] [LN:BSUB0009]
[AC:Z99112:AL009126] [GN:ylnF] [FN:unknown] [OR:*Bacillus subtilis*]
[DB:genpept-bct1] [DE:*Bacillus subtilis* complete genome (section 9 of 21):
from 1598421 to 1807200.] [NT:similar to uroporphyrin-III
C-methyltransferase] [LE:36582] [RE:37070] [DI:direct]

| ORF Name | NT ID | AA ID | NT LN | AA LN | Score | P-Value |
|---|---|---|---|---|---|---|
| AI7503000985_4379763_f3_1048 | 1230 | 5002 | 123 | 40 | | |

Description
NO-HIT

| ORF Name | NT ID | AA ID | NT LN | AA LN | Score | P-Value |
|---|---|---|---|---|---|---|
| AI7503000985_4392767_c1_1619 | 1231 | 5003 | 435 | 144 | 196 | 8.0e-15 |

Description
gp:[GI:e1314293:g3395543] [LN:SC4A2] [AC:AL031182] [PN:putative sugar
transferase] [GN:SC4A2.10c] [OR:*Streptomyces coelicolor*] [DB:genpept-bct1]
[DE:*Streptomyces coelicolor* cosmid 4A2.] [NT:SC4A2.10c, probable sugar
transferase, len:478;] [LE:9579] [RE:11015] [DI:complement]

| ORF Name | NT ID | AA ID | NT LN | AA LN | Score | P-Value |
|---|---|---|---|---|---|---|
| AI7503000985_4459375_f2_830 | 1232 | 5004 | 207 | 68 | | |

Description
NO-HIT

| ORF Name | NT ID | AA ID | NT LN | AA LN | Score | P-Value |
|---|---|---|---|---|---|---|
| AI7503000985_4487550_f3_980 | 1233 | 5005 | 1707 | 568 | 1408 | 4.7e-144 |

Description
pir:[LN:D69748] [AC:D69748:140419] [PN:amino acid transporter homolog ybeC]
[GN:ybeC] [OR:*Bacillus subtilis*] [DB:pir2] >gp:[GI:d1034075:g3599634]
[LN:AB006424] [AC:AB006424] [GN:ybeC] [OR:*Bacillus subtilis*] [SR:*Bacillus
subtilis* (strain:168) DNA] [DB:genpept-bct1] [DE:*Bacillus subtilis* genomic
DNA, 70 kb region between 17 and 23 degree.] [LE:34338] [RE:35957]
[DI:direct] >gp:[GI:e1182164:g2632498] [LN:BSUB0002] [AC:Z99105:AL009126]
[GN:ybeC] [FN:unknown] [OR:*Bacillus subtilis*] [DB:genpept-bct1] [DE:*Bacillus
subtilis* complete genome (section 2 of 21):from 194651 to 415810.]
[NT:similar to amino acid transporter] [LE:36687] [RE:38306] [DI:direct]

| ORF Name | NT ID | AA ID | NT LN | AA LN | Score | P-Value |
|---|---|---|---|---|---|---|
| AI7503000985_4491713_f2_533 | 1234 | 5006 | 1542 | 513 | 416 | 6.1e-39 |

Description
pir:[LN:F64554] [AC:F64554] [PN:guanosine pentaphosphate phosphohydrolase]
[OR:*Helicobacter pylori*] [DB:pir2] >gp:[GI:g2313368] [LN:AE000546]
[AC:AE000546:AE000511] [PN:guanosine pentaphosphate phosphohydrolase]
[GN:HP0278] [OR:*Helicobacter pylori* 26695] [DB:genpept-bct2]
[DE:*Helicobacter pylori* 26695 section 24 of 134 of the complete genome.]
[NT:similar to GB:M87049 SP:P25552 GB:M83316 PID:148183] [LE:6964] [RE:8418]
[DI:direct]

-continued

| ORF Name | NT ID | AA ID | NT LN | AA LN | Score | P-Value |
|---|---|---|---|---|---|---|
| AI7503000985__4553166__f3__1122 | 1235 | 5007 | 174 | 57 | | |

Description
NO-HIT

| ORF Name | NT ID | AA ID | NT LN | AA LN | Score | P-Value |
|---|---|---|---|---|---|---|
| AI7503000985__4574012__f1__208 | 1236 | 5008 | 1080 | 359 | 600 | 2.0e-58 |

Description
pir:[LN:JN0500] [AC:JN0500:S34967] [PN:dihydroorotate oxidase, , mitochondrial:dihydroorotate dehydrogenase] [GN:dhod] [CL:dihydroorotate oxidase] [OR:*Drosophila melanogaster*] [EC:1.3.3.1] [DB:pir2]

| ORF Name | NT ID | AA ID | NT LN | AA LN | Score | P-Value |
|---|---|---|---|---|---|---|
| AI7503000985__4662__f2__689 | 1237 | 5009 | 318 | 105 | 84 | 0.0046 |

Description
gp:[GI:g4049856] [LN:AF063866] [AC:AF063866] [PN:ORF MSV064 hypothetical protein] [GN:MSVOG4] [OR:*Melanoplus sanguinipes entomopoxvirus*] [DB genpept-vrl] [DE:*Melanoplus sanguinipes entomopoxvirus*, complete genome.] [LE:64316] [RE:65158] [DI:complement]

| ORF Name | NT ID | AA ID | NT LN | AA LN | Score | P-Value |
|---|---|---|---|---|---|---|
| AI7503000985__4687705__c2__1841 | 1238 | 5010 | 141 | 46 | | |

Description
NO-HIT

| ORF Name | NT ID | AA ID | NT LN | AA LN | Score | P-Value |
|---|---|---|---|---|---|---|
| AI7503000985__4687752__c1__1514 | 1239 | 5011 | 1185 | 394 | 773 | 9.1e-77 |

Description
pir:[LN:F69863] [AC:F69863] [PN:aspartate aminotransferase homolog ykrV] [GN:ykrV] [CL:aspartate transaminase] [OR:*Bacillus subtilis*] [DB:pir2] >gp:[GI:e1184948:g2633729] [LN:BSUB0008] [AC:Z99111:AL009126] [GN:ykrV] [FN:unknown] [OR:*Bacillus subtilis*] [DB:genpept-bct1] [DE:*Bacillus subtilis* complete genome (section 8 of 21):from 1394791 to 1603020.] [NT:similar to aspartate aminotransferase] [LE:30317] [RE:31513] [DI:direct]

| ORF Name | NT ID | AA ID | NT LN | AA LN | Score | P-Value |
|---|---|---|---|---|---|---|
| AI7503000985__4689390__c3__2124 | 1240 | 5012 | 147 | 48 | | |

Description
NO-HIT

| ORF Name | NT ID | AA ID | NT LN | AA LN | Score | P-Value |
|---|---|---|---|---|---|---|
| AI7503000985__4694163__c2__1791 | 1241 | 5013 | 144 | 47 | | |

Description
NO-HIT

| ORF Name | NT ID | AA ID | NT LN | AA LN | Score | P-Value |
|---|---|---|---|---|---|---|
| AI7503000985__3694652__c3__2199 | 1242 | 5014 | 135 | 44 | | |

Description
NO-HIT

| ORF Name | NT ID | AA ID | NT LN | AA LN | Score | P-Value |
|---|---|---|---|---|---|---|
| AI7503000985__4695451__f2__864 | 1243 | 5015 | 135 | 44 | | |

Description
NO-HIT

| ORF Name | NT ID | AA ID | NT LN | AA LN | Score | P-Value |
|---|---|---|---|---|---|---|
| AI7503000985__4698428__c2__1705 | 1244 | 5016 | 180 | 59 | | |

| Description | | | | | | |
|---|---|---|---|---|---|---|
| NO-HIT | | | | | | |
| ORF Name | NT ID | AA ID | NT LN | AA LN | Score | P-Value |
| AI7503000985__4705077__f2__880 | 1245 | 5017 | 123 | 40 | | |

Description
NO-HIT

| ORF Name | NT ID | AA ID | NT LN | AA LN | Score | P-Value |
|---|---|---|---|---|---|---|
| AI7503000985__4713377__f2__618 | 1246 | 5018 | 447 | 148 | 108 | 3.4e-05 |

Description
gp:[GI:e1407826:g4493896] [LN:PFMAL3P2] [AC:AL034558] [GN:MAL3P2.18]
[OR:*Plasmodium falciparum*] [SR:malaria parasite *P. falciparum*]
[DB:genpept-inv1] [DE:*Plasmodium falciparum* MAL3P2, complete sequence.]
[NT:predicted using hexExon; MAL3P2.18 (PFC0245c),] [LE:84094] [RE:95895]
[DI:complement]

| ORF Name | NT ID | AA ID | NT LN | AA LN | Score | P-Value |
|---|---|---|---|---|---|---|
| AI7503000985__4719775__c3__2182 | 1247 | 5019 | 744 | 247 | 434 | 7.6e-41 |

Description
sp:[LN:YWAC_BACSU] [AC:P39583] [GN:YWAC:IPA-7D] [OR:*BACILLUS SUBTILIS*]
[DE:HYPOTHETICAL 24.6 KD PROTEIN IN DAE-TYRZ INTERGENIC REGION] [SP:P39583]
[DB:swissprot] >pir:[LN:S39662] [AC:539662:C70050]
[PN:GTP-pyrophosphokinase homolog ywaC:protein ipa-7d] [GN:ywaC] [CL:GTP
pyrophosphokinase related protein] [OR:*Bacillus subtilis*] [DB:pir2]
>gp:[GI:g413931] [LN:BSGENR] [AC:X73124] [GN:ipa-7d] [OR:*Bacillus subtilis*]
[DB:genpept-bct1] [DE:*B. subtilis* genomic region (325 to 333).] [SP:P39583]
[LE:6981] [RE:7613] [DI:direct] >gp:[GI:e1186347:g2636383] [LN:BSUB0020]
[AC:Z99123:AL009126] [GN:ywaC] [FN:unknown] [OR:*Bacillus subtilis*]
[DB:genpept-bct1] [DE:*Bacillus subtilis* complete genome (section 20 of 21):
from 3798401 to 4010550.] [NT:alternate gene name:ipa-7d; similar to]
[SP:P39583] [LE:150346] [RE:150978] [DI:complement]

| ORF Name | NT ID | AA ID | NT LN | AA LN | Score | P-Value |
|---|---|---|---|---|---|---|
| AI7503000985__4719827__c3__1986 | 1248 | 5020 | 417 | 138 | | |

Description
NO-HIT

| ORF Name | NT ID | AA ID | NT LN | AA LN | Score | P-Value |
|---|---|---|---|---|---|---|
| AI7503000985__4720317__f2__475 | 1249 | 5021 | 1257 | 418 | 1659 | 1.2e-170 |

Description
gp:[GI:g4574233] [LN:AF106849] [AC:AF106849] [PN:FmhA] [GN:fmhA]
[OR:*Staphylococcus aureus*] [DB:genpept-bct2] [DE:*Staphylococcus aureus* FmhA
(fmhA) gene, complete cds.] [NT:similar to *Staphylococcus aureus* FemA and
FemB] [LE:201] [RE:1451] [DI:direct]

| ORF Name | NT ID | AA ID | NT LN | AA LN | Score | P-Value |
|---|---|---|---|---|---|---|
| AI7503000985__4723510__c2__1759 | 1250 | 5022 | 2661 | 886 | 2374 | 2.0e-246 |

Description
sp:[LN:PODK_CLOSY] [AC:P22983]LGN:PPDK] [OR:*CLOSTRIDIUM SYMBIOSUM*]
[SR:,*BACTEROIDES SYMBIOSUS*] [EC:2.7.9.1] [DE:(DIKINASE)] [SP:P22983]
[DB:swissprot]

| ORF Name | NT ID | AA ID | NT LN | AA LN | Score | P-Value |
|---|---|---|---|---|---|---|
| AI7503000985__4725068__c3__2219 | 1251 | 5023 | 645 | 214 | 605 | 5.8e-59 |

Description
pir:[LN:D69670] [AC:D69670] [PN:glycine betaine/carnitine/choline ABC
transporter (membrane p) opuCB] [GN:opuCB] [CL:glycine
betaine/carnitine/choline ABC transporter] [OR:*Bacillus subtilis*] [DB:pir2]
>gp:[GI:g2271390] [LN:AF009352] [AC:AF009352] [PN:transmembrane protein]
[GN:opuCB] [OR:*Bacillus subtilis*] [DB:genpept-bct1] [DE:*Bacillus subtilis*
osmoprotectant transport system OpuC includingATPase (opuCA), transmembrane
protein (opuCB), osmoprotectant binding protein precursor (opuCC) and
transmembrane protein (opuCD) genes, complete cds.] [NT;OpuCB; part of the
osmoprotectant transport system] [LE:2025] [RE:2678] [DI:direct]

-continued

>gp:[GI:e1186070:g2635895] [LN:BSUB0018] [AC:Z99121:AL009126] [PN:glycine betaine/carnitine/choline ABC] [GN:opuCB] [FN:high affinity transport of glycine betaine,] [OR:*Bacillus subtilis*] [DB:genpept-bct1] [DE:*Bacillus subtilis* complete genome (section 18 of 21): from 3399551 to 3609060.] [NT:alternate gene name: yvbD] [LE:68697] [RE:69350] [DI:complement]

| ORF Name | NT ID | AA ID | NT LN | AA LN | Score | P-Value |
|---|---|---|---|---|---|---|
| AI7503000985__4726636__c1__1543 | 1252 | 5024 | 138 | 45 | | |

Description
NO-HIT

| ORF Name | NT ID | AA ID | NT LN | AA LN | Score | P-Value |
|---|---|---|---|---|---|---|
| AI7503000985__4727187__c2__1702 | 1253 | 5025 | 2889 | 962 | 617 | 7.4e-58 |

Description
sp:[LN:PIP__LACLA] [AC:P49022] [GN:PIP] [OR:*LACTOCOCCUS LACTIS*] [SR:,SUBSPLACTIS:*STREPTOCOCCUS LACTIS*] [DE:PHAGE INFECTION PROTEIN] [SP:P49022] [DB:swissprot] >gp:[GI:g308861] [LN:LACPIP] [AC:L14679] [GN:pip] [FN:required for phage infection] [OR:*Lactococcus lactis*] [SR:*Lactococcus lactis* (strain C2, sub_species *lactis*) DNA] [DB:genpept-bct1] [DE:*Lactococcus lactis* pip and gerC2 genes, complete cds's, and rrggene, 5' end of cds.] [NT:GTG start codon] [LE:391] [RE:3096] [DI:direct]

| ORF Name | NT ID | AA ID | NT LN | AA LN | Score | P-Value |
|---|---|---|---|---|---|---|
| AI7503000985__4728187__c1__1365 | 1254 | 5026 | 234 | 77 | | |

Description
NO-HIT

| ORF Name | NT ID | AA ID | NT LN | AA LN | Score | P-Value |
|---|---|---|---|---|---|---|
| AI7503000985__4735937__f3__1114 | 1255 | 5027 | 138 | 45 | | |

Description
NO-HIT

| ORF Name | NT ID | AA ID | NT LN | AA LN | Score | P-Value |
|---|---|---|---|---|---|---|
| AI7503000985__4737550__c3__2248 | 1256 | 5028 | 759 | 252 | 387 | 7.3e-36 |

Description
gp:[GI:g4433637] [LN:AF029224] [AC:AF029224:AF029225] [PN:NirR] [GN:nirR] [FN:involved in nitrite reduction] [OR:*Staphylococcus carnosus*] [DB:genpept-bct2] [DE:*Staphylococcus carnosus* nir and nar operons, complete sequences.] [LE:1184] [RE:1906] [DI:direct]

| ORF Name | NT ID | AA ID | NT LN | AA LN | Score | P-Value |
|---|---|---|---|---|---|---|
| AI7503000985__4777217__c3__2257 | 1257 | 5029 | 1569 | 522 | 2425 | 7.9e-252 |

Description
gp:[GI:e1429596:g4756152] [LN:A67161] [AC:A67161] [FN:NARH GENE] [OR:*Staphylococcus carnosus*] [DB:genpept-pat] [DE:Sequence 1 from Patent EP0805205.] [NT:unnamed protein product] [LE:7804] [RE:9381] [DI:direct] >gp:[GI:g3929523] [LN:AF029224] [AC:AF029224:AF029225] [PN:NarH] [GN:narH] [OR:*Staphylococcus carnosus*] [DB genpept-bct2] [DE:*Staphylococcus carnosus* nir and nar operons, complete sequences.] [NT:similar to *Escherichia coli* nitrate reductases NRA] [LE:9989] [RE:11566] [DI:direct]

| ORF Name | NT ID | AA ID | NT LN | AA LN | Score | P-Value |
|---|---|---|---|---|---|---|
| AI7503000985__4787807__f3__984 | 1258 | 5030 | 210 | 69 | | |

Description
NO-HIT

| ORF Name | NT ID | AA ID | NT LN | AA LN | Score | P-Value |
|---|---|---|---|---|---|---|
| AI7503000985__4814682__f3__1288 | 1259 | 5031 | 201 | 66 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000985__4870907__f1__195 | 1260 | 5032 | 231 | 76 | | |

Description
NO-HIT

| ORF Name | NT ID | AA ID | NT LN | AA LN | Score | P-Value |
|---|---|---|---|---|---|---|
| AI7503000985__4875316__c1__1545 | 1261 | 5033 | 141 | 46 | | |

Description
NO-HIT

| ORF Name | NT ID | AA ID | NT LN | AA LN | Score | P-Value |
|---|---|---|---|---|---|---|
| AI7503000985__4875760__f1__255 | 1262 | 5034 | 135 | 44 | | |

Description
NO-HIT

| ORF Name | NT ID | AA ID | NT LN | AA LN | Score | P-Value |
|---|---|---|---|---|---|---|
| AI7503000985__4876387__c3__2099 | 1263 | 5035 | 186 | 61 | | |

Description
NO-HIT

| ORF Name | NT ID | AA ID | NT LN | AA LN | Score | P-Value |
|---|---|---|---|---|---|---|
| AI7503000985__4876932__c2__1733 | 1264 | 5036 | 249 | 82 | 74 | 0.013 |

Description
gp:[GI:g1255424] [LN:CELC33G8] [AC:U53154] [GN:C33G8.3] [OR:*Caenorhabditis elegans*] [DB:genpept-inv1] [DE:*Caenorhabditis elegans* cosmid C33G8.]
[LE:27678:27899:28087] [RE:27848:27952:28290] [DI:directJoin]

| ORF Name | NT ID | AA ID | NT LN | AA LN | Score | P-Value |
|---|---|---|---|---|---|---|
| AI7503000985__4878312__c2__1648 | 1265 | 5037 | 141 | 46 | | |

Description
NO-HIT

| ORF Name | NT ID | AA ID | NT LN | AA LN | Score | P-Value |
|---|---|---|---|---|---|---|
| AI7503000985__4882893__c3__2012 | 1266 | 5038 | 1209 | 402 | 244 | 1.0e-27 |

Description
gp:[GI:d1039027:g4512424] [LN:AB017508] [AC:AB017508] [GN:secY] [OR:*Bacillus halodurans*] [SR:*Bacillus halodurans* (strain:C-125) DNA] [DB:genpept-bct1]
[DE:*Bacillus halodurans* C-125 genomic DNA, 32 kb fragment, complete cds.]
[NT:secY homologue (identity of 70% to *B. subtilis* )] [LE:22481] [RE:23773]
[DI:direct]

| ORF Name | NT ID | AA ID | NT LN | AA LN | Score | P-Value |
|---|---|---|---|---|---|---|
| AI7503000985__4891002__c2__1834 | 1267 | 5039 | 1116 | 371 | 671 | 5.8e-66 |

Description
pir:[LN:A43577] [AC:A43577] [PN:regulatory protein pfoR] [OR:*Clostridium perfringens*] [DB:pir2]

| ORF Name | NT ID | AA ID | NT LN | AA LN | Score | P-Value |
|---|---|---|---|---|---|---|
| AI7503000985__4980378__c1__1635 | 1268 | 5040 | 537 | 178 | 578 | 4.2e-56 |

Description
gp:[GI:g4096799] [LN:SCU40158] [AC:U40158] [OR:*Staphylococcus carnosus*]
[DB:genpept-bct2] [DE:*Staphylococcus carnosus* response regulator-like
protein (orfx) gene, partial cds.] [NT:orfx; function unknown; similar to
response] [LE:<1] [RE:560] [DI:direct]

| ORF Name | NT ID | AA ID | NT LN | AA LN | Score | P-Value |
|---|---|---|---|---|---|---|
| AI7503000985__5117137__c2__1827 | 1269 | 5041 | 459 | 152 | 499 | 9.8e-48 |

Description
pir:[LN:G70069] [AC:G70069] [PN:capsular polyglutamate biosynthesis homolog
ywtA] [GN:ywtA] [OR:*Bacillus subtilis*] [DB:pir2] >gp:[GI:e1184495:g2636114]
[LN:BSUB0019] [AC:Z99122:AL009126] [GN:ywtA] [FN:unknown] [OR:*Bacillus*

-continued

*subtilis*] [DB:genpept-bct1] [DE:*Bacillus subtilis* complete genome (section
19 of 21):from 3597091 to 3809700.] [NT:similar to capsular polyglutamate
biosynthesis] [LE:100949] [RE:101398] [DI:complement]
>gp:[GI:e308089:g1894766] [LN:BSZ92954] [AC:Z92954] [GN:ywtA] [OR:*Bacillus
subtilis*] [DB:genpept-bct1] [DE:*B. subtilis* yws [A, B, C, D, E, F, G] and gerBC
genes.] [NT:product highly similar to *Bacillus anthracis* CapC] [LE:1084]
[RE:1533] [DI:direct] >gp:[GI:e1184495:g2636114] [LN:BSUB0019]
[AC:Z99122:AL009126] [GN:ywtA] [FN:unknown] [OR:*Bacillus subtilis*]
[DB:genpept] [DE:*Bacillus subtilis* complete genome (section 19 of 21):from
3597091 to 3809700.] [NT:similar to capsular polyglutamate biosynthesis]
[LE:100949] [RE:101398] [DI:complement]

| ORF Name | NT ID | AA ID | NT LN | AA LN | Score | P-Value |
| --- | --- | --- | --- | --- | --- | --- |
| AI7503000985__5128425__f2__821 | 1270 | 5042 | 1878 | 625 | 477 | 2.1e-45 |

Description
pir:[LN:F69848] [AC:F69848] [PN:transcription antiterminator BglG family
homolog yjdC] [GN:yjdC] [CL:phosphotransferase system mannitol-specific
enzyme II factor III homology] [OR:*Bacillus subtilis*] [DB:pir2]
>gp:[GI:e1183220:g2633554] [LN:BSUB0007] [AC:Z99110:AL009126] [GN:yjdC]
[FN:unknown] [OR:*Bacillus subtilis*] [DB:genpept-bct1] [DE:*Bacillus subtilis*
complete genome (section 7 of 21):from 1194391 to 1411140.] [NT:similar to
transcriptional antiterminator (BglG) [LE:75712] [RE:77658] [DI:direct]

| ORF Name | NT ID | AA ID | NT LN | AA LN | Score | P-Value |
| --- | --- | --- | --- | --- | --- | --- |
| AI7503000985__5133562__f2__656 | 1271 | 5043 | 222 | 73 | 180 | 6.3e-14 |

Description
pir:[LN:F70041] [AC:F70041] [PN:probable mercuric ion-binding protein
yvgY:periplasmic mercuric ion-binding protein merP homolog] [GN:yvgY]
[CL:mercuric resistance operon regulatory protein:heavy-metal-associated
homology] [OR:*Bacillus subtilis*] [DB:pirl] >gp:[GI:e1186039:g2635864]
[LN:BSUB0018] [AC:Z99121:AL009126] [GN:yvgY] [FN:unknown] [OR:*Bacillus
subtilis*] [DB:genpept-bct1] [DE:*Bacillus subtilis* complete genome (section
18 of 21):from 3399551 to 3609060.] [NT:similar to mercuric transport
protein] [LE:43125] [RE:43334] [DI:complement]

| ORF Name | NT ID | AA ID | NT LN | AA LN | Score | P-Value |
| --- | --- | --- | --- | --- | --- | --- |
| AI7503000985__5136002__c2__1691 | 1272 | 5044 | 366 | 121 | 136 | 2.9e-09 |

Description
pir:[LN:C70043] [AC:C70043] [PN:hypothetical protein yvlA] [GN:yvlA]
[OR:*Bacillus subtilis*] [DB:pir2] >gp:[GI:e1186201:g2636026] [LN:BSUB0018]
[AC:Z99121:AL009126] [GN:yvlA] [FN:unknown] [OR:*Bacillus subtilis*]
[DB:genpept-bct1] [DE:*Bacillus subtilis* complete genome (section 18 of 21):
from 3399551 to 3609060.] [LE:207957] [RE:208283] [DI:complement]
>gp:[GI:e1184419:g2636039] [LN:BSUB0019] [AC:Z99122:AL009126] [GN:yvlA]
[FN:unknown] [OR:*Bacillus subtilis*] [DB:genpept-bct1] [DE:*Bacillus subtilis*
complete genome (section 19 of 21):from 3597091 to 3809700.] [LE:10417]
[RE:10743] [DI:complement] >gp:[GI:g2618844] [LN:AF017113] [AC:AF017113]
[PN:YvlA] [GN:yvlA] [OR:*Bacillus subtilis*] [DB:genpept-bct2] [DE:*Bacillus
subtilis* 300–304 degree genomic sequence.] [LE:19550] [RE:19876] [DI:direct]
>gp:[GI:e1184419:g2636039] [LN:BSUB0019] [AC:Z99122:AL009126] [GN:yvlA]
[FN:unknown] [OR:*Bacillus subtilis*] [DB:genpept] [DE:*Bacillus subtilis*
complete genome (section 19 of 21):from 3597091 to 3809700.] [LE:10417]
[RE:10743] [DI:complement]

| ORF Name | NT ID | AA ID | NT LN | AA LN | Score | P-Value |
| --- | --- | --- | --- | --- | --- | --- |
| AI7503000985__5203452__c3__1989 | 1273 | 5045 | 579 | 192 | 398 | 5.0e-37 |

Description
sp:[LN:HIS5_LACLA] [AC:Q02132] [GN:HISH] [OR:*LACTOCOCCUS LACTIS*]
[SR:,*SUBSPLACTIS:STREPTOCOCCUS LACTIS*] [EC:2.4.2.-] [DE:ANIDOTRANSFERASE
HISH,] [SP:Q02132] [DB:swissprot] >pir:[LN:I45734] [AC:I45734] [PN:HisH]
[CL:amidotransferase hisH] [OR:*Lactococcus lactis* subsp. lactis] [DB:pir2]
>gp:[GI:g2565145] [LN:LLU92974] [AC:U92974:M90760:M90761] [PN:HisH]
[GN:hish] [OR:*Lactococcus lactis*] [DB:genpept-bct1] [DE:*Lactococcus lactis*
unknown gene, partial cds, and HisC (hisC), unknown, HisG (hisG), unknown,
HisB (hisB), unknown, HisH (hish), HisA (hisA), HisF (hisF), HisIE (hisIE),
unknown, unknown, LeuA (leuA), LeuB (leuB), LeuC (leuC), LeuD (leuD),
unknown, IlvD (ilvD), IlvB (ilvB), IlvN, IlvC (ilvC), IlvA (ilvA), AldB
(aldB) and aldR (aldR) genes, complete cds.] [NT:aminotransferase] [LE:7295]
[RE:7903] [DI:direct]

-continued

| ORF Name | NT ID | AA ID | NT LN | AA LN | Score | P-Value |
|---|---|---|---|---|---|---|
| AI7503000985_5281568_f3_1043 | 1274 | 5046 | 504 | 167 | 330 | 8.0e-30 |

Description
pir:[LN:C64897] [AC:C64897] [PN:probable phosphinothricin
N-acetyltransferase,] [CL:phosphinothricin N-acetyltransferase]
[OR:*Escherichia coli*] [EC:2.3.1.-] [DB:pir2] >gp:[GI:g1787719] [LN:AE000241]
[AC:AE000241:U00096] [PN:putative resistance protein] [GN:b1448]
[FN:putative transport; Drug/analog sensitivity] [OR:*Escherichia coli*]
[DB:genpept-bct2] [DE:*Escherichia coli* K-12 MG1655 section 131 of 400 of the
complete genome.] [NT:f172; 38 pct identical (3 gaps) to 169 residues of]
[LE:9570] [RE:10088] [DI:complement]

| ORF Name | NT ID | AA ID | NT LN | AA LN | Score | P-Value |
|---|---|---|---|---|---|---|
| AI7503000985_5290675_c3_2108 | 1275 | 5047 | 405 | 134 | 411 | 2.1e-38 |

Description
sp:[LN:PAND_BACSU] [AC:P52999] [GN:PAND] [OR:*BACILLUS SUBTILIS*]
[EC:4.1.1.11] [DE:(DECARBOXYLASE)] [SP:P52999] [DB:swissprot]
>pir:[LN:A69672] [AC:A69672] [PN:aspartate 1-decarboxylase panD] [GN:panD]
[CL:aspartate 1-decarboxylase] [OR:*Bacillus subtilis*] [DB:pir2]
>gp:[GI:g1146242] [LN:BACYPIA] [AC:L47709] [PN:aspartate 1-decarboxylase]
[GN:panD] [FN:pantothenic acid biosynthesis] [OR:*Bacillus subtilis*]
[DB:genpept-bct1] [EC:4.1.1.11] [DE:*Bacillus subtilis* (clone YAC15-6B)
ypiABF genes, qcrABC genes, ypjABCDEFGHI genes, birA gene, panBCD genes, dinG
gene, ypmB gene, aspB gene, asnS gene, dnaD gene, nth gene and ypoC gene,
complete cds's.] [NT:48.3% of identity to the *Escherichia coli* aspartate]
[LE:14990] [RE:15373] [DI:direct] >gp:[GI:e1183686:g2634659] [LN:BSUB0012]
[AC:Z99115:AL009126] [PN:aspartate 1-decarboxylase] [GN:panD]
[FN:pantothenate biosynthesis] [OR:*Bacillus subtilis*] [DB:genpept-bct1]
[EC:4.1.1.11] [DE:*Bacillus subtilis* complete genome (section 12 of 21):from
2195541 to 2409220.] [SP:P52999] [LE:156294] [RE:156677] [DI:complement]

| ORF Name | NT ID | AA ID | NT LN | AA LN | Score | P-Value |
|---|---|---|---|---|---|---|
| AI7503000985_5314077_c1_1448 | 1276 | 5048 | 1593 | 530 | 1036 | 1.2e-104 |

Description
sp:[LN:YIDK_ECOLI] [AC:P31448] [GN:YIDK] [OR:*ESCHERICHIA COLI*]
[DE:HYPOTHETICAL 62.1 KD PROTEIN IN EMRD-GLVG INTERGENIC REGION] [SP:P31448]
[DB:swissprot] >pir:[LN:H65169] [AC:H65169] [PN:hypothetical 62.1 kD
protein in ilvo-ibpb intergenic region] [GN:yidK 3 [OR:*Escherichia coli*]
[DB:pir2] >gp:[GI:g290528] [LN:ECOUW82] [AC:L10328] [GN:f571] [FN:unknown]
[OR:*Escherichia coli*] [SR:*Escherichia coli* K12 strain MG1655; lambda clones
EC14-52] [DB:genpept-bct1] [DE:*E. coli*; the region from 81.5 to 84.5
minutes.] [NT:similar to glucose transport proteins] [LE:47795] [RE:49510]
[DI:complement] >gp:[GI:g1790113] [LN:AE000445] [AC:AE000445:U00096]
[PN:putative cotransporter] [GN:yidK] [FN:putative transport; Not
classified] [OR:*Escherichia coli*] [DB:genpept-bct2] [DE:*Escherichia coli*
K-12 MG1655 section 335 of 400 of the complete genome.] [NT:f571; 100 pct
identical to YIDK_ECOLI SW:] [LE:5576] [RE:7291] [DI:complement]

| ORF Name | NT ID | AA ID | NT LN | AA LN | Score | P-Value |
|---|---|---|---|---|---|---|
| AI7503000985_53413_f2_855 | 1277 | 5049 | 1602 | 533 | 424 | 8.7e-40 |

Description
pir:[LN:H64532] [AC:H64532] [PN:2',3'-cyclic-nucleotide
2'-phosphodiesterase, precursor] [GN:HP0104] [CL:2',3'-cyclic-nucleotide
2'-phosphodiesterase:2',3'-cyclic-nucleotide 2'-phosphodiesterase
homology:phosphoesterase core homology] [OR:*Helicobacter pylori*]
[EC:3.1.4.16] [DB:pir1] >gp:[GI:g2313187] [LN:AE000532]
[AC:AE000532:AE000511] [PN:2',3'-cyclic-nucleotide 2'-phosphodiesterase]
[GN:HP0104] [OR:*Helicobacter pylori* 26695] [DB:genpept-bct2]
[DE:*Helicobacter pylori* 26695 section 10 of 134 of the complete genome.]
[NT:similar to GB:L42023 SP:P44764 PID:1004048] [LE:3594] [RE:5339]
[DI:complement]

| ORF Name | NT ID | AA ID | NT LN | AA LN | Score | P-Value |
|---|---|---|---|---|---|---|
| AI7503000985_5369212_c3_2196 | 1278 | 5050 | 1509 | 502 | 430 | 5.4e-40 |

Description
sp:[LN:TAGE_BACSU] [AC:P13484] [GN:TAGE:RODD:GTAA] [OR:*BACILLUS SUBTILIS*]
[EC:2.4.1.52] [DE:(EC 2.4.1.52) (TEICHOIC ACID BIOSYNTHESIS PROTEIN E)]
[SP:P13484] [DB:swissprot] >pir:[LN:506048] [AC:506048:F69720]
[PN:poly(glycerol-phosphate) alpha-glucosyltransferase, tagE:probable rodD -continued protein UDP-glucose--polyglycerol phosphate glucosyltransferase tagE]
[GN:tagE:rodD] [OR:*Bacillus subtilis*] [EC:2.4.1.52] [DB:pir2] [MP:310
degrees] >gp:[GI:g580920] [LN:BSRODC] [AC:X15200] [OR:*Bacillus subtilis*]
[DB:genpept-bct1] [DE:*Bacillus subtilis* rodC operon.] [NT:rodD (gtaA)
polypeptide (AA 1–673)] [SP:P13484] [LE:157] [RE:2178] [DI:direct]
>gp:[GI:e1184479:g2636099] [LN:BSUB0019] [AC:Z99122:AL009126]
[PN:UDP-glucose:polyglycerol phosphate] [GN:tagE] [FN:teichoic acid
biosynthesis] [OR:*Bacillus subtilis*] [DB:genpept-bct1] LEC:2.4.1.52]
[DE:*Bacillus subtilis* complete genome (section 19 of 21):from 3597091 to
3809700.] [NT:alternate gene name:rodD, gtaA, gtaD] [SP:P13484] [LE:80369]
[RE:82390] [DI:complement] >gp:[GI:e1184479:g2636099] [LN:BSUB0019]
[AC:Z99122:AL009126] [PN:UDP-glucose:polyglycerol phosphate] [GN:tagE]
[FN:teichoic acid biosynthesis] [OR:*Bacillus subtilis*] [DB:genpept]
[EC:2.4.1.52] [DE:*Bacillus subtilis* complete genome (section 19 of 21):from
3597091 to 3809700.] [NT:alternate gene name:rodD, gtaA, gtaD] [SP:P13484]
[LE:80369] [RE:82390] [DI:complement]

| ORF Name | NT ID | AA ID | NT LN | AA LN | Score | P-Value |
|---|---|---|---|---|---|---|
| AI7503000985__54207__c1__1347 | 1279 | 5051 | 138 | 45 | | |

Description
NO-HIT

| ORF Name | NT ID | AA ID | NT LN | AA LN | Score | P-Value |
|---|---|---|---|---|---|---|
| AI7503000985__56693__c1__1418 | 1280 | 5052 | 792 | 263 | 778 | 2.7e-77 |

Description
gp:[GI:g2058476] [LN:BTU71200] [AC:U71200] [PN:acetoin reductase] [OR:*Bos taurus*] [DB:genpept-mam] [DE:*Bos taurus* acetoin reductase mRNA, complete cds.] [NT:similar to acetoin reductase of *Klebsiella*] [LE:51] [RE:824] [DI:direct]

| ORF Name | NT ID | AA ID | NT LN | AA LN | Score | P-Value |
|---|---|---|---|---|---|---|
| AI7503000985__578162__f3__1226 | 1281 | 5053 | 177 | 58 | | |

Description
NO-HIT

| ORF Name | NT ID | AA ID | NT LN | AA LN | Score | P-Value |
|---|---|---|---|---|---|---|
| AI7503000985__5867262__c1__1636 | 1282 | 5054 | 126 | 41 | | |

Description
NO-HIT

| ORF Name | NT ID | AA ID | NT LN | AA LN | Score | P-Value |
|---|---|---|---|---|---|---|
| AI7503000985__5891075__f2__736 | 1283 | 5055 | 132 | 43 | | |

Description
NO-HIT

| ORF Name | NT ID | AA ID | NT LN | AA LN | Score | P-Value |
|---|---|---|---|---|---|---|
| AI7503000985__5907177__f1__392 | 1284 | 5056 | 138 | 45 | | |

Description
NO-HIT

| ORF Name | NT ID | AA ID | NT LN | AA LN | Score | P-Value |
|---|---|---|---|---|---|---|
| AI7503000985__5915653__f2__789 | 1285 | 5057 | 183 | 60 | | |

Description
NO-HIT

| ORF Name | NT ID | AA ID | NT LN | AA LN | Score | P-Value |
|---|---|---|---|---|---|---|
| AI7503000985__595260__c2__1956 | 1286 | 5058 | 3780 | 1259 | 5568 | 0.0 |

Description
gp:[GI:e1429593:g4756151] [LN:A67161] [AC:A67161] [FN:NARG GENE]
[OR:*Staphylococcus carnosus*] [DB:genpept-pat] [DE:Sequence 1 from Patent
EP0805205.] [NT:unnamed protein product] [LE:4140] [RE:7814] [DI:direct]
>gp:[GI:g3929522] [LN:AF029224] [AC:AF029224:AF029225] [PN:NarG] [GN:narG]
[OR:*Staphylococcus carnosus*] [DB:genpept-bct2] [DE:*Staphylococcus carnosus*

-continued nir and nar operons, complete sequences.] [NT:similar to *Escherichia coli* nitrate reductases NRA] [LE:6325] [RE:9999] [DI:direct]

| ORF Name | NT ID | AA ID | NT LN | AA LN | Score | P-Value |
|---|---|---|---|---|---|---|
| AI7503000985__5963300__f2__895 | 1287 | 5059 | 504 | 167 | 116 | 5.6e-06 |

Description
gp:[GI:d1044460:g5105361] [LN:AP000062] [AC:AP000062] [PN:213aa long hypothetical protein] [GN:APE1673] [OR:*Aeropyrum pernix*] [SR:*Aeropyrum pernix* (strain:K1) DNA] [DB:genpept] [DE:*Aeropyrum pernix* genomic DNA, section 5/7.] [LE:71354] [RE:71995] [DI:direct]

| ORF Name | NT ID | AA ID | NT LN | AA LN | Score | P-Value |
|---|---|---|---|---|---|---|
| AI7503000985__5988786__f1__391 | 1288 | 5060 | 135 | 44 | | |

Description
NO-HIT

| ORF Name | NT ID | AA ID | NT LN | AA LN | Score | P-Value |
|---|---|---|---|---|---|---|
| AI7503000985__6047827__c2__1778 | 1289 | 5061 | 705 | 234 | 569 | 3.8e-55 |

Description
gp:[GI:g2565161] [LN:LLU92974] [AC:U92974:M90760:M90761] [PN:AldB] [GN:aldB] [OR:*Lactococcus lactis*] [DB:genpept-bct1] [DE:*Lactococcus lactis* unknown gene, partial cds, and HisC (hisC), unknown, HisG (hisG), unknown, HisB (hisB), unknown, HisH (hish), HisA (hisA), HisF (hisF), HisIE (hisIE), unknown, unknown, LeuA (leuA), LeuB (leuB), LeuC (leuC), LeuD (leuD), unknown, IlvD (ilvD), IlvB (ilvB), IlvN, IlvC (ilvC), IlvA (ilvA), AldB (aldB) and aldR (aldR) genes, complete cds.] [NT:alpha-acetolactate decarboxylase] [LE:24488] [RE:25198] [DI:direct] >gp:[GI:g1699352] [LN:582499] [AC:582499] [PN:alpha-acetolactate decarboxylase] [GN:aldB] [OR:*Lactococcus lactis*] [SR:*Lactococcus lactis* NCDO2118 ssp. *lactis*] [DB:genpept-bct1] [DE:aldB = alpha-acetolactate decarboxylase [*Lactococcus lactis*, ssp. *lactis*, NCDO2118, Genomic, 840 nt] .] [NT:This sequence comes from FIG. 2; AldB] [LE:98] [RE:808] [DI:direct]

| ORF Name | NT ID | AA ID | NT LN | AA LN | Score | P-Value |
|---|---|---|---|---|---|---|
| AI7503000985__6070938__c1__1477 | 1290 | 5062 | 1773 | 590 | 2475 | 4.0e-257 |

Description
gp:[GI:g4574121] [LN:AF009415] [AC:AF009415] [PN:choline dehydrogenase] [GN:cudB] [OR:*Staphylococcus xylosus*] [DB:genpept-bct2] [DE:*Staphylococcus xylosus* choline transporter (cudT), putative regulatory protein (cudC) glycine betaine aldehyde dehydrogenase (cudA), and choline dehydrogenase (cudB) genes, complete cds.] [NT:CudB] [LE:4915] [RE:6597] [DI:direct]

| ORF Name | NT ID | AA ID | NT LN | AA LN | Score | P-Value |
|---|---|---|---|---|---|---|
| AI7503000985__6101063__c2__1925 | 1291 | 5063 | 138 | 45 | | |

Description
NO-HIT

| ORF Name | NT ID | AA ID | NT LN | AA LN | Score | P-Value |
|---|---|---|---|---|---|---|
| AI7503000985__6101542__f2__836 | 1292 | 5064 | 132 | 43 | | |

Description
NO-HIT

| ORF Name | NT ID | AA ID | NT LN | AA LN | Score | P-Value |
|---|---|---|---|---|---|---|
| AI7503000985__6132893__c3__2259 | 1293 | 5065 | 462 | 153 | | |

Description
NO-HIT

| ORF Name | NT ID | AA ID | NT LN | AA LN | Score | P-Value |
|---|---|---|---|---|---|---|
| AI7503000985__6136050__c2__1807 | 1294 | 5066 | 246 | 81 | 80 | 0.0033 |

Description
gp:[GI:g4980536] [LN:AE001692] [AC:AE001692:AE000512] [PN:iron(II) transport protein A] [GN:TM0050] [OR:*Thermotoga maritima*] [DB:genpept-bct2] [DE:*Thermotoga maritima* section 4 of 136 of the complete genome.]

-continued

[NT:similar to SP:P33649 PID:414746 PID:606343] [LE:81] [RE:545] [DI:direct]

| ORF Name | NT ID | AA ID | NT LN | AA LN | Score | P-Value |
|---|---|---|---|---|---|---|
| AI7503000985_6136527_c1_1463 | 1295 | 5067 | 615 | 204 | 618 | 2.4e-60 |

Description
pir:[LN:C69877] [AC:C69877] [PN:adenylylsulfate kinase homolog ylnC]
[GN:ylnC] [CL:adenylylsulfate kinase:adenylylsulfate kinase homology]
[OR:*Bacillus subtilis*] [DB:pir2] >gp:[GI:e332186:g2462959] [LN:BSPYREYLO]
[AC:AJ000974] [PN:putative adenosine 5-phosphosulfate kinase] [GN:ylnC]
[OR:*Bacillus subtilis*] [DB:genpept-bct1] [DE:*Bacillus subtilis* pyrE to yloA
gene region.] [LE:3535] [RE:4128] [DI:direct] >gp:[GI:e1185152:g2633933]
[LN:BSUB0009] [AC:Z99112:AL009126] [GN:ylnC] [FN:unknown] [OR:*Bacillus subtilis*] [DB:genpept-bct1] [DE:*Bacillus subtilis* complete genome (section 9
of 21):from 1598421 to 1807200.] [NT:similar to adenylylsulfate kinase]
[LE:34348] [RE:34941] [DI:direct]

| ORF Name | NT ID | AA ID | NT LN | AA LN | Score | P-Value |
|---|---|---|---|---|---|---|
| AI7503000985_6251592_c2_1940 | 1296 | 5068 | 150 | 49 | | |

Description
NO-HIT

| ORF Name | NT ID | AA ID | NT LN | AA LN | Score | P-Value |
|---|---|---|---|---|---|---|
| AI7503000985_6289068_c2_1750 | 1297 | 5069 | 219 | 72 | 233 | 1.0e-18 |

Description
gp:[GI:g4574118] [LN:AF009415] [AC:AF009415] [PN:choline transporter]
[GN:cudT] [OR:*Staphylococcus xylosus*] [DB:genpept-bct2] [DE:*Staphylococcus xylosus* choline transporter (cudT), putative regulatory protein (cudC),
glycine betaine aldehyde dehydrogenase (cudA), and choline dehydrogenase
(cudB) genes, complete cds.] [NT:CudT] [LE:811] [RE:2433] [DI:direct]

| ORF Name | NT ID | AA ID | NT LN | AA LN | Score | P-Value |
|---|---|---|---|---|---|---|
| AI7503000985_6369688_f2_562 | 1298 | 5070 | 915 | 304 | 130 | 5.9e-06 |

Description
gp:[GI:g4262225] [LN:ATAC00G200] [AC:AC006200] PN:putative phosphatidic
acid phosphatase] [GN:F10A8.6] [OR:*Arabidopsis thaliana*] [SR:thale cress]
[DB:genpept-pln2] [DE:*Arabidopsis thaliana* chromosome II BAC F10A8 genomic
sequence, complete sequence.] [LE:16778] [RE:17686] [DI:complement]

| ORF Name | NT ID | AA ID | NT LN | AA LN | Score | P-Value |
|---|---|---|---|---|---|---|
| AI7503000985_64442202_f3_1033 | 1299 | 5071 | 1050 | 349 | 310 | 1.0e-27 |

Description
sp:[LN:YYAD_BACSU] [AC:P37520] [GN:YYAD] [OR:*BACILLUS SUBTILIS*]
[DE:HYPOTHETICAL 37.7 KD PROTEIN IN RPSF-SPO0J INTERGENIC REGION]
[SP:P37520] [DB:swissprot] >pir:[LN:I40448] [AC:I40448:S66018:C70084:S18084]
[PN:conserved hypothetical protein yyaD (replication origin region)]
[GN:yyaD] [OR:*Bacillus subtilis*] [DB:pir2] >gp:[GI:d1005766:g467378]
[LN:BAC180K] [AC:D26185] [PN:unknown] [OR:*Bacillus subtilis*] [SR:*Bacillus subtilis* (sub species:Marburg, strain:168) DNA] [DB:genpept-bct1] [DE:*B. subtilis* DNA, 180 kilobase region of replication origin.] [LE:51420]
[RE:52436] [DI:complement] >gp:[GI:g580907] [LN:BSORIGS] [AC:X62539]
[OR:*Bacillus subtilis*] [DB:genpept-bct1] [DE:*B. subtilis* genes rpmH, rnpA,
50kd, gidA and gidB.] [NT:unnamed protein product] [SP:P37520] [LE:10964]
[RE:11980] [DI:direct] >gp:[GI:e1184820:g2636641] [LN:BSUB0021]
[AC:Z99124:AL009126] [GN:yyaD] [FN:unknown] [OR:*Bacillus subtilis*]
[DB:genpept-bct1] [DE:*Bacillus subtilis* complete genome (section 21 of 21):
from 3999281 to 4214814.] [NT:similar to hypothetical proteins from *B. subtilis*] [SP:P37520] [LE:203352] [RE:204368] [DI:complement]

| ORF Name | NT ID | AA ID | NT LN | AA LN | Score | P-Value |
|---|---|---|---|---|---|---|
| AI7503000985_651527_c1_1369 | 1300 | 5072 | 732 | 243 | 359 | 6.7e-33 |

Description
sp:[LN:HIS4_SYNY3] [AC:P74561] [GN:HISA:SLR0652] [OR:*SYNECHOCYSTIS* SP]
[SR:PCC 6803,] [EC:5.3.1.16] [DE:ISOMERASE.] [SP:P74561] [DB:swissprot]
>pir:[LN:S76756] [AC:S76756] [PN:hypothetical protein]
[CL:N-(5'-phospho-D-ribosylformimino)-5-amino-1-
(5''-phosphoribosyl)-4-imidazolecarboxamide isomerase] [OR:*Synechocystis* sp.] [SR:PCC 6803, , PCC 6803] [SR:PCC 6803,] [DB:pir2]

-continued

>gp:[GI:d1019401:g1653757] [LN:D90916] [AC:D90916:AB001339]
[PN:phosphorybosilformimino-5-amino-] [GN:hisA] [OR:*Synechocystis* sp.]
[SR:*Synechocystis* sp. (strain:PCC6803) DNA] [DB:genpept-bct1]
[DE:*Synechocystis* sp. PCC6803 complete genome, 26/27, 3270710–3418851.]
[NT:ORF_ID:slr0652] [LE:48572] [RE:49342] [DI:direct]

| ORF Name | NT ID | AA ID | NT LN | AA LN | Score | P-Value |
|---|---|---|---|---|---|---|
| AI7503000985_6522262_c2_1805 | 1301 | 5073 | 138 | 45 | | |

Description
NO-HIT

| ORF Name | NT ID | AA ID | NT LN | AA LN | Score | P-Value |
|---|---|---|---|---|---|---|
| AI7503000985_6642792_f3_978 | 1302 | 5074 | 147 | 48 | | |

Description
NO-HIT

| ORF Name | NT ID | AA ID | NT LN | AA LN | Score | P-Value |
|---|---|---|---|---|---|---|
| AI7503000985_6662875_f1_382 | 1303 | 5075 | 147 | 48 | | |

Description
NO-HIT

| ORF Name | NT ID | AA ID | NT LN | AA LN | Score | P-Value |
|---|---|---|---|---|---|---|
| AI7503000985_6678507_f1_253 | 1304 | 5076 | 207 | 68 | | |

Description
NO-HIT

| ORF Name | NT ID | AA ID | NT LN | AA LN | Score | P-Value |
|---|---|---|---|---|---|---|
| AI7503000985_6745327_f3_1336 | 1305 | 5077 | 144 | 47 | | |

Description
NO-HIT

| ORF Name | NT ID | AA ID | NT LN | AA LN | Score | P-Value |
|---|---|---|---|---|---|---|
| AI7503000985_6772250_c1_1380 | 1306 | 5078 | 141 | 46 | | |

Description
NO-HIT

| ORF Name | NT ID | AA ID | NT LN | AA LN | Score | P-Value |
|---|---|---|---|---|---|---|
| AI7503000985_6829635_c2_1695 | 1307 | 5079 | 132 | 43 | | |

Description
NO-HIT

| ORF Name | NT ID | AA ID | NT LN | AA LN | Score | P-Value |
|---|---|---|---|---|---|---|
| AI7503000985_6829812_c1_1542 | 1308 | 5080 | 948 | 315 | 795 | 4.2e-79 |

Description
gp:[GI:g4959404] [LN:AF115391] [AC:AF115391] PN:ribokinase RbsK] [GN:rbsK]
[OR:*Lactobacillus sakei*] [DB:genpept-bct2] [DE:*Lactobacillus sakei* LaaA
(laaA) gene, partial cds; LaaB (laaB), putative acetate kinase AckA (ackA),
LaaC (laaC) genes, complete cds; rbs operon, complete sequence; and LaaE
(laaE) gene, partial cds.] [LE:4450] [RE:5358] [DI:direct]

| ORF Name | NT ID | AA ID | NT LN | AA LN | Score | P-Value |
|---|---|---|---|---|---|---|
| AI7503000985_6837938_f1_376 | 1309 | 5081 | 3561 | 1186 | 198 | 2.1e-14 |

Description
sp:[LN:CDR1_HUMAN] [AC:P51861] [GN:CDR1] LOR:*HOMO SAPIENS*] [SR:,HUMAN]
[DE:CEREBELLAR-DEGENERATION-RELATED ANTIGEN 1 (CDR34)] [SP:P51861]
[DB:swissprot] >pir:[LN:A29770] [AC:A29770:A35640] [PN:cerebellar
degeneration-related protein] [GN:CDR1:CDR] [OR:*Homo sapiens*] [SR:, man]
[DB:pir2] [MP:Xq27.1–Xq27.2]

| ORF Name | NT ID | AA ID | NT LN | AA LN | Score | P-Value |
|---|---|---|---|---|---|---|

-continued

| | | | | | | |
|---|---|---|---|---|---|---|
| AI7503000985__6844012__c2__1748 | 1310 | 5082 | 1344 | 447 | 589 | 2.9e-57 |

Description
sp:[LN:DCUA__ECOLI] [AC:P04539] [GN:DCUA:GENA] [OR:*ESCHERICHIA COLI*]
[DE:ANAEROBIC C4-DICARBOXYLATE TRANSPORTER DCUA] [SP:P04539] [DB:swissprot]
>pir:[LN:QQEC94] [AC:S56366:S57340:H65223:A04471:S08589] [PN:dicarboxylate
membrane-transporter protein A:anaerobic c4-dicarboxylate transporter
dcua:aspartase membrane transport protein genA] [GN:dcuA:genA]
[CL:dicarboxylate membrane-transporter protein A] [OR:*Escherichia coli*]
[DB:pir1] [MP:94 min] >gp:[GI:g510888] [LN:ECDUCA] [AC:X79887]
[PN:dicarboxylate membrane-transporter protein] [GN:dcuB] [OR:*Escherichia
coli*] [DB:genpept-bct1] [DE:*E. coli* dcuA gene.] [SP:P04539] [LE:129]
[RE:1430] [DI:direct] >gp:[GI:g5369821] [LN:ECOUW93] [AC:U14003] [GN:genA]
[FN:membrane transport of aspartase] [OR:*Escherichia coli*] [DB:genpept-bct1]
[DE:*Escherichia coli* K-12 chromosomal region from 92.8 to 00.1 minutes.]
[LE:56300] [RE:57601] [DI:complement] >gp:[GI:g1790580] [LN:AE000486]
[AC:AE000486:U00096] [PN:anaerobic dicarboxylate transport] [GN:dcuA]
[FN:transport; Transport of small molecules:] [OR:*Escherichia coli*]
[DB:genpept-bct2] [DE:*Escherichia coli* K-12 MG1655 section 376 of 400 of the
complete genome.] [NT:f433; 100 pct identical amino acid sequence and]
[LE:6845] [RE:8146] [DI:complement]

| ORF Name | NT ID | AA ID | NT LN | AA LN | Score | P-Value |
|---|---|---|---|---|---|---|
| AI7503000985__6897133__f1__415 | 1311 | 5083 | 126 | 41 | 75 | 0.038 |

Description
gp:[GI:g53061681] [LN:AF160864] [AC:AF160864] [PN:orf256] [GN:orf256]
[OR:*Mitochondrion Tetrahymena pyriformis*] [SR:*Tetrahymena pyriformis*]
[DB:genpept] [DE:*Tetrahymena pyriformis* mitochondrial DNA, complete genome.]
[NT:Open reading frame ymf62 (CPGN)] [LE:40866] [RE:41636] [DI:direct]

| ORF Name | NT ID | AA ID | NT LN | AA LN | Score | P-Value |
|---|---|---|---|---|---|---|
| AI7503000985__6928__c1__1546 | 1312 | 5084 | 843 | 280 | | |

Description
NO-HIT

| ORF Name | NT ID | AA ID | NT LN | AA LN | Score | P-Value |
|---|---|---|---|---|---|---|
| AI7503000985__7039051__c3__2238 | 1313 | 5085 | 750 | 249 | 585 | 7.6e-57 |

Description
sp:[LN:YCKJ__BACSU] [AC:P42200] [GN:YCKJ] [OR:*BACILLUS SUBTILIS*] [DE:PROBABLE
AMINO-ACID ABC TRANSPORTER PERMEASE PROTEIN] [SP:P42200] [DB:swissprot]
>pir:[LN:I40451] [AC:I40451:D69761:S52382] [PN:glutamine ABC transporter
(permease) homolog yckJ:ABC-type transport system probable membrane spanning
protein] [GN:yckJ] [CL:histidine permease protein M] [OR:*Bacillus subtilis*]
[DB:pir2] >gp:[GI:g666982] [LN:BSPAAT] [AC:X77636] [PN:putative membrane
spanning subunit] [GN:ORF2] [OR:*Bacillus subtilis*] [DB:genpept-bct1]
[DE:*B. subtilis* putative amino acid transporter gene.] [NT:potential
ABC-transport system] [SP:P42200] [LE:909] [RE:16131 EDI:direct]
>gp:[GI:e1182312:g2632646] [LN:BSUB0002] [AC:Z99105:AL009126] [GN:yckJ]
[FN:unknown] [OR:*Bacillus subtilis*] [DB:genpept-bct1] [DE:*Bacillus subtilis*
complete genome (section 2 of 21):from 194651 to 415810.] [NT:similar to
glutamine ABC transporter (permease)] [SP:P42200] [LE:214896] [RE:215600]
[DI:complement] >gp:[GI:e1182327:g2632661] [LN:BSUB0003]
[AC:Z99106:AL009126] [GN:yckJ] [FN:unknown] [OR:*Bacillus subtilis*]
[DB:genpept-bct1] [DE:*Bacillus subtilis* complete genome (section 3 of 21):
from 402751 to 611850.] [NT:similar to glutamine ABC transporter (permease)]
[SP:P42200] [LE:6796] [RE:7500] [DI:complement] >gp:[GI:d1009628:g1805431]
[LN:D50453] [AC:D50453] [PN:homologue of glutamine transport system]
[GN:yckJ] [OR:*Bacillus subtilis*] [SR:*Bacillus subtilis* (strain:168 trpC2)
DNA] [DB:genpept-bct1] [DE:*Bacillus subtilis* DNA for 25–36 degree region
containing the amyE-srfA region, complete cds.] [LE:89199] [RE:89903]
[DI:complement]

| ORF Name | NT ID | AA ID | NT LN | AA LN | Score | P-Value |
|---|---|---|---|---|---|---|
| AI7503000985__7227175__c3__2052 | 1314 | 5086 | 189 | 62 | | |

Description
NO-HIT

| ORF Name | NT ID | AA ID | NT LN | AA LN | Score | P-Value |
|---|---|---|---|---|---|---|
| AI7503000985__7228517__c3__2197 | 1315 | 5087 | 411 | 136 | 191 | 4.3e-15 |

-continued

Description
pir:[LN:A70556] [AC:A70556] [PN:probable mutator MutT protein or homolog]
[GN:mutT2] [CL:mutT domain homology] [OR:*Mycobacterium tuberculosis*]
[DB:pir2] >gp:[GI:e317133:g2117198] [LN:MTCI65] [AC:Z95584:AL123456]
[PN:mutT2] [GN:mutT2] [OR:*Mycobacterium tuberculosis*] [DB:genpept-bct1]
[DE:*Mycobacterium tuberculosis* H37Rv complete genome; segment.50/162.]
[NT:Rv1160, (MTCI65.27), mutT, len:141. Probable] [LE:24794] [RE:25219]
[DI:direct]

| ORF Name | NT ID | AA ID | NT LN | AA LN | Score | P-Value |
|---|---|---|---|---|---|---|
| AI7503000985__7234627__c1__1580 | 1316 | 5088 | 210 | 69 | | |

Description
NO-HIT

| ORF Name | NT ID | AA ID | NT LN | AA LN | Score | P-Value |
|---|---|---|---|---|---|---|
| AI7503000985__7242128__c2__1926 | 1317 | 5089 | 345 | 114 | 352 | 3.7e-32 |

Description
gp:[GI:e314909:g2073521] [LN:SSK1MECA] [AC:Y09223] [PN:hypothetical protein]
[OR:*Staphylococcus sciuri*] [DB:genpept-bct1] [DE:*S. sciuri* mecA gene & ORF's
450, 145 & 179.] [NT:ORF450] [LE:<1] [RE:1351] [DI:complement]

| ORF Name | NT ID | AA ID | NT LN | AA LN | Score | P-Value |
|---|---|---|---|---|---|---|
| AI7503000985__7243832__c2__1644 | 1318 | 5090 | 1722 | 573 | 684 | 2.4e-67 |

Description
gp:[GI:d1044599:g5105500] [LN:AP000062] [AC:AP000062] [PN:558aa long
hypothetical protein] [GN:APE1810] [OR:*Aeropyrum pernix*] [SR:*Aeropyrum
pernix* (strain:K1) DNA] [DB:genpept] [DE:*Aeropyrum pernix* genomic DNA,
section 5/7.] [NT:motif = ATP/GTP-binding site motif A (P-loop)] [LE:155809]
[RE:157485] [DI:direct]

| ORF Name | NT ID | AA ID | NT LN | AA LN | Score | P-Value |
|---|---|---|---|---|---|---|
| AI7503000985__7245377__c1__1534 | 1319 | 5091 | 1002 | 333 | 258 | 3.4e-22 |

Description
sp:[LN:EST__ACICA] [AC:P18773] [GN:EST] [OR:*ACINETOBACTER CALCOACETICUS*]
[EC:3.1.1.-] [DE:ESTERASE,] [SP:P18773] [DB:swissprot] >gp:[GI:g303953]
[LN:ACCESTERAS] [AC:M24890:L20754] [PN:esterase] [OR:*Acinetobacter
calcoaceticus*] [SR:*Acinetobacter calcoaceticus* ssp. *iwoffii* (strain RAG-1)
DNA] [DB:genpept-bct1] [DE:*Acinetobacter calcoaceticus* esterase gene,
complete cds.] [LE:1] [RE:912] [DI:direct]

| ORF Name | NT ID | AA ID | NT LN | AA LN | Score | P-Value |
|---|---|---|---|---|---|---|
| AI7503000985__7301078__c3__2006 | 1320 | 5092 | 465 | 154 | 340 | 7.0e-31 |

Description
gp:[GI:g3114664] [LN:AF061267] [AC:AF061267] [PN:ATPase component HtxD]
[GN:htxD] [OR:*Pseudomonas stutzeri*] [DB:genpept-bct2] [DE:*Pseudomonas
stutzeri* putative alpha-ketoglutarate-dependent hypophosphite dioxygenase
(htxA), binding protein component HtxB (htxB), inner membrane component HtxC
(htxC), ATPase component HtxD (htxD), inner membrane component HtxE (htxE),
putative C-P lyasesubunits HtxF (htxF), HtxG (htxG), and HtxH (htxH) genes,
complete cds; and putative C-P lyase subunit HtxI (htxI) gene, partial cds.]
[NT:putative binding-protein-dependent hypophosphite] [LE:39961] [RE:5021]
[DI:direct]

| ORF Name | NT ID | AA ID | NT LN | AA LN | Score | P-Value |
|---|---|---|---|---|---|---|
| AI7503000985__783375__f2__893 | 1321 | 5093 | 147 | 48 | | |

Description
NO-HIT

| ORF Name | NT ID | AA ID | NT LN | AA LN | Score | P-Value |
|---|---|---|---|---|---|---|
| AI7503000985__784387__c3__1970 | 1322 | 5094 | 1425 | 474 | 781 | 1.3e-77 |

Description
pir:[LN:G71641] [AC:G71641] [PN:dihydrolipoamide dehydrogenase (pdhD)
RP805] [GN:pdhD:RP805] [CL:dihydrolipoamide dehydrogenase:dihydrolipoamide
dehydrogenase homology] [OR:*Rickettsia prowazekii*] [DB:pir2]
>gp:[GI:e1343076:g3861332] [LN:RPXX04] [AC:AJ235273:AJ235269]

-continued

[PN:DIHYDROLIPOAMIDE:DEHYDROGENASE (pdhD)] [GN:RP805] [OR:*Rickettsia prowazekii*] [DB:genpept-bct1] [DE:*Rickettsia prowazekii* strain Madrid E, complete genome; segment 4/4.] [LE:137655] [RE:139034] [DI:complement]

| ORF Name | NT ID | AA ID | NT LN | AA LN | Score | P-Value |
|---|---|---|---|---|---|---|
| AI7503000985__787677__f2__636 | 1323 | 5095 | 483 | 160 | 246 | 6.4e-21 |

Description
gp:[GI:g2735506] [LN:SCU96107] [AC:U96107] [PN:SceB precursor] [GN:sceB] [OR:*Staphylococcus carnosus*] [DB:genpept-bct2] [DE:*Staphylococcus carnosus* N5,N10-methylenetetrahydromethanopterinreductase homolog, SceB precursor (sceB) and putative transmembrane protein genes, complete cds, and putative Na+/H+ antiporter NhaC (nhaC) gene, partial cds.] [NT:major secreted protein] [LE:1894] [RE:2685] [DI:direct]

| ORF Name | NT ID | AA ID | NT LN | AA LN | Score | P-Value |
|---|---|---|---|---|---|---|
| AI7503000985__798838__c3__1987 | 1324 | 5096 | 1260 | 419 | 845 | 2.1e-84 |

Description
pir:[LN:E70368] [AC:E70368] [PN:histidinol dehydrogenase] [GN:hisD] [CL:histidinol dehydrogenase:histidinol dehydrogenase homology] [OR:*Aquifex aeolicus*] [DB:pir2] >gp:[GI:g2983343] [LN:AE000707] [AC:AE000707:AE000657] [PN:histidinol dehydrogenase] [GN:hisD] [OR:*Aquifex aeolicus*] [DB:genpept-bct2] [DE:*Aquifex aeolicus* section 39 of 109 of the complete genome.] [LE:5716] [RE:6996] [DI:complement]

| ORF Name | NT ID | AA ID | NT LN | AA LN | Score | P-Value |
|---|---|---|---|---|---|---|
| AI7503000985__823518__f1__169 | 1325 | 5097 | 225 | 74 | | |

Description
NO-HIT

| ORF Name | NT ID | AA ID | NT LN | AA LN | Score | P-Value |
|---|---|---|---|---|---|---|
| AI7503000985__832561__c3__2102 | 1326 | 5098 | 138 | 45 | | |

Description
NO-HIT

| ORF Name | NT ID | AA ID | NT LN | AA LN | Score | P-Value |
|---|---|---|---|---|---|---|
| AI7503000985__86088__f2__835 | 1327 | 5099 | 369 | 122 | 154 | 3.6e-11 |

Description
gp:[GI:g2735504] [LN:SCU96107] [AC:U96107] [ER:*Staphylococcus carnosus*] [DB:genpept-bct2] [DE:*Staphylococcus carnosus* N5,N10-methylenetetrahydromethanopterinreductase homolog, SceB precursor (sceB) and putative transmembrane protein genes, complete cds, and putative Na+/H+ antiporter NhaC (nhaC) gene, partial cds.] [NT:Orf1] [LE:<1] [RE:185] [DI:complement]

| ORF Name | NT ID | AA ID | NT LN | AA LN | Score | P-Value |
|---|---|---|---|---|---|---|
| AI7503000985__860917__f3__1170 | 1328 | 5100 | 201 | 66 | 56 | 0.0095 |

Description
pir:[LN:A71605] [AC:A71605] [PN:probable integral membrane protein PFB0845w] [GN:PFB0845w] [OR:*Plasmodium falciparum*] [DB:pir2] >gp:[GI:g3845291] [LN:AE001420] [AC:AE001420:AE001362] [PN:predicted integral membrane protein] [GN:PFB0845w] [OR:*Plasmodium falciparum*] [SR:malaria parasite *P. falciparum*] [DB:genpept-inv2] [DE:*Plasmodium falciparum* chromosome 2, section 57 of 73 of the complete sequence.] [NT:predicted by GlimmerM] [LE:9688] [RE:10611] [DI:direct]

| ORF Name | NT ID | AA ID | NT LN | AA LN | Score | P-Value |
|---|---|---|---|---|---|---|
| AI7503000985__867255__f1__235 | 1329 | 5101 | 153 | 50 | | |

Description
NO-HIT

| ORF Name | NT ID | AA ID | NT LN | AA LN | Score | P-Value |
|---|---|---|---|---|---|---|
| AI7503000985__882143__c2__1927 | 1330 | 5102 | 255 | 84 | | |

| Description | | | | | | |
|---|---|---|---|---|---|---|
| NO-HIT | | | | | | |

| ORF Name | NT ID | AA ID | NT LN | AA LN | Score | P-Value |
|---|---|---|---|---|---|---|
| AI7503000985__891000__c2__1906 | 1331 | 5103 | 147 | 48 | | |

| Description |
|---|
| NO-HIT |

| ORF Name | NT ID | AA ID | NT LN | AA LN | Score | P-Value |
|---|---|---|---|---|---|---|
| AI7503000985__895253__c3__2019 | 1332 | 5104 | 510 | 169 | 303 | 5.8e-27 |

| Description |
|---|
| pir:[LN:E71960] [AC:E71960] PN:probable peptide methionine sulfoxide reductase] [GN:jhp0210] [OR:*Helicobacter pylori*] [SR:strain J99, , strain J99] [SR:strain J99,] [DB:pir2] >gp:[GI:g4154731] [LN:AE001459] [AC:AE001459:AE001439] [PN:putative PEPTIDE:METHIONINE SULFOXIDE:REDUCTASE] [GN:jhp0210] [OR:*Helicobacter pylori* J99] [DB:genpept-bct2] [DE:*Helicobacter pylori*, strain J99 section 20 of 132 of the complete genome.] [NT:similar to *H. pylori* 26695 gene HP0224] [LE:4882] [RE:5961] [DI:direct] |

| ORF Name | NT ID | AA ID | NT LN | AA LN | Score | P-Value |
|---|---|---|---|---|---|---|
| AI7503000985__901377__c2__1785 | 1333 | 5105 | 327 | 108 | | |

| Description |
|---|
| NO-HIT |

| ORF Name | NT ID | AA ID | NT LN | AA LN | Score | P-Value |
|---|---|---|---|---|---|---|
| AI7503000985__901377__f2__596 | 1334 | 5106 | 129 | 42 | | |

| Description |
|---|
| NO-HIT |

| ORF Name | NT ID | AA ID | NT LN | AA LN | Score | P-Value |
|---|---|---|---|---|---|---|
| AI7503000985__953142__f1__219 | 1335 | 5107 | 954 | 317 | 228 | 5.1e-19 |

| Description |
|---|
| sp:[LN:YOBS_MYCTU] [AC:Q50648] [GN:MTCY227.28C] [OR:*MYCOBACTERIUM TUBERCULOSIS*] [DE:HYPOTHETICAL 26.2 KD PROTEIN CY227.28C] [SP:Q50648] [DB:swissprot] >pir:[LN:D70724] [AC:D70724] [PN:hypothetical protein Rv2573] [GN:Rv2573] [OR:*Mycobacterium tuberculosis*] [DB:pir2] >gp:[GI:e256179:g1478239] [LN:MTCY227] [AC:Z77724:AL123456] [PN:hypothetical protein Rv2573] [GN:Rv2573] [OR:*Mycobacterium tuberculosis*] [DB:genpept-bct1] [DE:*Mycobacterium tuberculosis* H37Rv complete genome; segment 114/162.] [NT:Rv2573, (MTCY227.28c), len:246. Unknown but some] [SP:Q50648] [LE:5598] [RE:6338] [DI:direct] |

| ORF Name | NT ID | AA ID | NT LN | AA LN | Score | P-Value |
|---|---|---|---|---|---|---|
| AI7503000985__953930__f2__838 | 1336 | 5108 | 132 | 43 | | |

| Description |
|---|
| NO-HIT |

| ORF Name | NT ID | AA ID | NT LN | AA LN | Score | P-Value |
|---|---|---|---|---|---|---|
| AI7503000985__961562__c1__1401 | 1337 | 5109 | 186 | 61 | | |

| Description |
|---|
| NO-HIT |

| ORF Name | NT ID | AA ID | NT LN | AA LN | Score | P-Value |
|---|---|---|---|---|---|---|
| AI7503000985__968800__c2__1796 | 1338 | 5110 | 804 | 267 | 1031 | 4.2e-104 |

| Description |
|---|
| gp:[GI:e244971:g1340128] [LN:SA1234] [AC:X97985] [OR:*Staphylococcus aureus*] [DB:genpept-bct1] [DE:*S. aureus* orfs 1, 2, 3 & 4.1] [NT:ORF1] [LE:537] [RE:1304] [DI:direct] |

| ORF Name | NT ID | AA ID | NT LN | AA LN | Score | P-Value |
|---|---|---|---|---|---|---|
| AI7503000985__9766375__f1__90 | 1339 | 5111 | 162 | 53 | | |

-continued

| Description |
|---|
| NO-HIT |

| ORF Name | NT ID | AA ID | NT LN | AA LN | Score | P-Value |
|---|---|---|---|---|---|---|
| AI7503000985__9770801__f2__621 | 1340 | 5112 | 138 | 45 | | |

| Description |
|---|
| NO-HIT |

| ORF Name | NT ID | AA ID | NT LN | AA LN | Score | P-Value |
|---|---|---|---|---|---|---|
| AI7503000985__978965__c3__2055 | 1341 | 5113 | 213 | 70 | | |

| Description |
|---|
| NO-HIT |

| ORF Name | NT ID | AA ID | NT LN | AA LN | Score | P-Value |
|---|---|---|---|---|---|---|
| AI7503000985__986312__f2__447 | 1342 | 5114 | 168 | 55 | | |

| Description |
|---|
| NO-HIT |

| ORF Name | NT ID | AA ID | NT LN | AA LN | Score | P-Value |
|---|---|---|---|---|---|---|
| AI7503000985__9875333__c1__1552 | 1343 | 5115 | 1533 | 510 | 1134 | 5.1e-115 |

| Description |
|---|
| sp:[LN:DHAL_VIBCH] [AC:P23240] IGN:ALDA] [OR:*VIBRIO CHOLERAE*] [EC:1.2.1.3] [DE:ALDEHYDE:DEHYDROGENASE,] [SP:P23240] [DB:swissprot] >gp:[GI:g155276] [LN:VIBTAGALDA] [AC:M60658] [PN:aldehyde dehydrogenase] [GN:aldA] [OR:*Vibrio cholerae*] [SR:*V. cholerae* DNA] [DB:genpept-bct1] [EC:l.2.1.3] [DE:*Vibrio cholerae* aldehyde dehydrogenase gene, complete cds, and tagA gene, 5' end.] [LE:419] [RE:1939] [DI:direct] >gp:[GI:g3004925] [LN:AF034434] [AC:AF034434] [PN:aldehyde dehydrogenase] [GN:aldA] [OR:*Vibrio cholerae*] [DB:genpept-bct2] [DE:*Vibrio cholerae* pathogenicity island, putative transposase, aldehyde dehydrogenase (aldA), toxR-activated gene A protein (tagA), putative inner membrane protein, and putative zincmetalloprotease genes, complete cds; and toxR-activated gene Dprotein (tagD) gene, partial cds.] [NT:AldA] [LE:2388] [RE:3908] [DI:complement] |

| ORF Name | NT ID | AA ID | NT LN | AA LN | Score | P-Value |
|---|---|---|---|---|---|---|
| AI7503000985__9928200__f1__189 | 1344 | 5116 | 159 | 52 | | |

| Description |
|---|
| NO-HIT |

| ORF Name | NT ID | AA ID | NT LN | AA LN | Score | P-Value |
|---|---|---|---|---|---|---|
| AI7503000985__9944635__f2__631 | 1345 | 5117 | 135 | 44 | | |

| Description |
|---|
| NO-HIT |

| ORF Name | NT ID | AA ID | NT LN | AA LN | Score | P-Value |
|---|---|---|---|---|---|---|
| AI7503000985__995300__f1__28 | 1346 | 5118 | 204 | 67 | 70 | 0.048 |

| Description |
|---|
| gp:[GI:g1173895] [LN:PFU41075] [AC:U41075] [PN:p82] rGN:RAP-1] [OR:*Plasmodium falciparum*] [SR:malaria parasite strain = IndJ-1 (clone 1 of Indian isolate J)] [DB:genpept-inv2] [DE:*Plasmodium falciparum* strain IndJ-1 rhoptry-associated protein 1 (RAP-1) gene, partial cds.] [NT:rhoptry-associated protein 1; localized to rhoptry] [LE:<1] [RE:>461] [DI:direct] |

| ORF Name | NT ID | AA ID | NT LN | AA LN | Score | P-Value |
|---|---|---|---|---|---|---|
| AI7503000985__9954012__f1__333 | 1347 | 5119 | 141 | 46 | | |

| Description |
|---|
| NO-HIT |

| ORF Name | NT ID | AA ID | NT LN | AA LN | Score | P-Value |
|---|---|---|---|---|---|---|
| AI7503000985__10317307__f2__121 | 1348 | 5120 | 267 | 88 | 81 | 0.016 |

Description
sp:[LN:TAGB_BACSU] [AC:P27621] [GN:TAGB] [OR:*BACILLUS SUBTILIS*] [DE:TEICHOIC
ACID BIOSYNTHESIS PROTEIN B PRECURSOR] [SP:P27621] [DB:swissprot]
>pir:[LN:C49757] [AC:C49757:C69720] [PN:polyglycerol phosphate techoic acid
biosynthesis protein tagB] [GN:tagB] [OR:*Bacillus subtilis*] [DB:pir2]
>gp:[GI:g143725] [LN:BACTAGABCD] [AC:M57497] [GN:tagB] [OR:*Bacillus
subtilis*] [SR:*B. subtilis* (strain 168) DNA] [DB:genpept-bct1] [DE:*B. subtilis*
tagA, tagB, tagC and tagD genes, complete cds.] [NT:putative] [LE:1603]
[RE:2748] [DI:direct] >gp:[GI:e1184482:g2636102] [LN:BSUB0019]
[AC:Z99122:AL009126] [GN:tagB] [FN:polyglycerol phosphate assembly and
export] [OR:*Bacillus subtilis*] [DB:genpept-bct1] [DE:*Bacillus subtilis*
complete genome (section 19 of 21):from 3597091 to 3809700.] [SP:P27621]
[LE:84143] [RE:85288] [DI:direct] >gp:[GI:e1184482:g2636102] [LN:BSUB0019]
[AC:Z99122:AL009126] [GN:tagB] [FN:polyglycerol phosphate assembly and
export] [OR:*Bacillus subtilis*] [DB:genpept] [DE:*Bacillus subtilis* complete
genome (section 19 of 21):from 3597091 to 3809700.] [SP:P27621] [LE:84143]
[RE:85288] [DI:direct]

| ORF Name | NT ID | AA ID | NT LN | AA LN | Score | P-Value |
|---|---|---|---|---|---|---|
| AI7503000985_10626525_f1_58 | 1349 | 5121 | 1023 | 340 | 810 | 1.1e-80 |

Description
pir:[LN:E69831] [AC:EG9831] [PN:conserved hypothetical protein yhfP]
[GN:yhfP] [CL:*Bacillus subtilis* conserved hypothetical protein yhfP]
[OR:*Bacillus subtilis*] [DB:pir2] >gp:[GI:e1183034:g2633368] [LN:BSUB0006]
[AC:Z99109:AL00912G] [GN:yhfP] [FN:unknown] [OR:*Bacillus subtilis*]
[DB:genpept-bct1] [DE:*Bacillus subtilis* complete genome (section 6 of 21):
from 999501 to 1209940.] [NT:similar to hypothetical proteins] [LE:106496]
[RE:107488] [DI:direct] >gp:[GI:e324995:g2226252] [LN:BSY14084] [AC:Y14084]
[PN:hypothetical protein] [GN:yhfP] [OR:*Bacillus subtilis*] [DB:genpept-bct1]
[DE:*B. subtilis* chromosomal DNA, region 78–80 degrees:aprE to comK.]
[NT:high similarity to yhdH from *E. coli* (Swiss Prot) [LE:924] [RE:1916]
[DI:direct]

| ORF Name | NT ID | AA ID | NT LN | AA LN | Score | P-Value |
|---|---|---|---|---|---|---|
| AI7503000985_10976625_c1_226 | 1350 | 5122 | 888 | 295 | 870 | 4.8e-87 |

Description
sp:[LN:YHXD_BACSU] [AC:P40398:O07554] [GN:YHXD] [OR:*BACILLUS SUBTILIS*]
[EC:1.-.-.-] [DE:(EC 1.-.-.-) (ORFY)] [SP:P40398:O07554] [DB:swissprot]
>pir:[LN:E69835] [AC:E69835:S43612] [PN:ribitol dehydrogenase homolog yhxD]
[GN:yhxD] [CL:short-chain alcohol dehydrogenase homology] [OR:*Bacillus
subtilis*] [DB:pir2] >gp:[GI:e1183045:g2633379] [LN:BSUB0006]
[AC:Z99109:AL009126] [GN:yhxD] [FN:unknown] [OR:*Bacillus subtilis*]
[DB:genpept-bct1] [DE:*Bacillus subtilis* complete genome (section 6 of 21):
from 999501 to 1209940.] [NT:similar to ribitol dehydrogenase] [SP:P40398]
[LE:117706] [RE:118605] [DI:complement] >gp:[GI:e324973:g2226172]
[LN:BSY14081] [AC:Y14081] [PN:hypothetical protein] [GN:yhxD] [OR:*Bacillus
subtilis*] [DB:genpept-bct1] [DE:*Bacillus subtilis* chromosomal DNA, region 92
degrees:region between comK and addAB.] [NT:bp 1–501 overlaps with bp
1525–1947 (end):from EMBL] [SP:P40398] [LE:1] [RE:900] [DI:complement]

| ORF Name | NT ID | AA ID | NT LN | AA LN | Score | P-Value |
|---|---|---|---|---|---|---|
| AI7503000985_11114677_f2_73 | 1351 | 5123 | 204 | 67 | | |

Description
NO-HIT

| ORF Name | NT ID | AA ID | NT LN | AA LN | Score | P-Value |
|---|---|---|---|---|---|---|
| AI7503000985_11740778_f2_80 | 1352 | 5124 | 216 | 71 | | |

Description
NO-HIT

| ORF Name | NT ID | AA ID | NT LN | AA LN | Score | P-Value |
|---|---|---|---|---|---|---|
| AI7503000985_1207250_c3_313 | 1353 | 5125 | 480 | 159 | 89 | 0.032 |

Description
sp:[LN:ATP6_APIME] [AC:Q00275] [GN:ATP6] [OR:*APIS MELLIFERA*] [SR:,HONEYBEE]
[EC:3.6.1.34] [DE:ATP SYNTHASE A CHAIN, (PROTEIN 6)] [SP:Q00275]
[DB:swissprot] >pir:[LN:A42622] [AC:A42622:S52964] [PN:H+-transporting ATP
synthase, chain 6] [CL:H+-transporting ATP synthase protein 6]
[OR:mitochondrion *Apis mellifera*] [SR:, honeybee] [EC:3.6.1.34] [DB:pir2]
>gp:[GI:g552442] [LN:AMFGENOM] [AC:L06178] [PN:ATPase subunit 6]

-continued

[OR:*Mitochondrion Apis mellifera ligustica*] [SR:common honeybee] [DB:genpept-inv1] [DE:*Apis mellifera ligustica* complete mitochondrial genome.] [LE:4584] [RE:5264] [DI:direct] >gp:[GI:g552451] [LN:AMFMTATPAS] [AC:M87065] [PN:adenosine triphosphatase 6] [GN:ATPase6] [OR:*Mitochondrion Apis mellifera ligustica*] [SR:*Mitochondrion Apis mellifera ligustica* (organelle Mitochondrio] [DB:genpept-inv1] [DE:*Apis mellifera* mitochondrial adenosine triphosphatase 8 (ATPase8) gene, complete cds; adenosine triphosphatase 6 (ATPase6) gene, complete cds.] [LE:141] [RE:821] [DI:direct]

| ORF Name | NT ID | AA ID | NT LN | AA LN | Score | P-Value |
|---|---|---|---|---|---|---|
| AI7503000985_1290703_c1_227 | 1354 | 5126 | 141 | 46 | | |

Description
NO-HIT

| ORF Name | NT ID | AA ID | NT LN | AA LN | Score | P-Value |
|---|---|---|---|---|---|---|
| AI7503000985_14644018_f1_39 | 1355 | 5127 | 969 | 322 | 324 | 3.4e-29 |

Description
gp:[GI:g2196513] [LN:SEU77778] [AC:U77778:U29130] [PN:putative membrane protein] [GN:epiH] [FN:involved in epidermin secretion] [OR:*Staphylococcus epidermidis*] [DB:genpept-bct1] [DE:*Staphylococcus epidermidis* plasmid pTue32 putative ABC transporter subunits (epiG), (epiE), and (epiF), putative membrane protein(epiH), EpiT' (epiT') and EpiT" (epiT") genes, complete cds.] [NT:EpiH] [LE:2615] [RE:3607] [DI:direct]

| ORF Name | NT ID | AA ID | NT LN | AA LN | Score | P-Value |
|---|---|---|---|---|---|---|
| AI7503000985_14647750_c2_238 | 1356 | 5128 | 141 | 46 | | |

Description
NO-HIT

| ORF Name | NT ID | AA ID | NT LN | AA LN | Score | P-Value |
|---|---|---|---|---|---|---|
| AI7503000986_14656952_f2_93 | 1357 | 5129 | 633 | 210 | | |

Description
NO-HIT

| ORF Name | NT ID | AA ID | NT LN | AA LN | Score | P-Value |
|---|---|---|---|---|---|---|
| AI7503000986_15035952_f2_91 | 1358 | 5130 | 477 | 158 | | |

Description
NO-HIT

| ORF Name | NT ID | AA ID | NT LN | AA LN | Score | P-Value |
|---|---|---|---|---|---|---|
| AI7503000986_15117317_c2_243 | 1359 | 5131 | 2184 | 727 | 953 | 2.4e-102 |

Description
sp:[LN:TAGF_BACSU] [AC:P13485] [GN:TAGF:RODC:TAG3] [OR:*BACILLUS SUBTILIS*] [DE:TEICHOIC ACID BIOSYNTHESIS PROTEIN F] [SP:P13485] [DB:swissprot] >pir:[LN:S06049] [AC:S06049:G69720] [PN:probable CDPglycerol glycerophosphotransferase, :CDP-glycerol:polyglycerol phosphate glycero-phosphotransferase tagF:rodC protein:teichoic-acid synthase] [GN:rodC:tag-3:tagF ] [OR:*Bacillus subtilis*] [EC:2.7.8.12] [DB:pir2] [MP:310 degrees] >gp:[GI:g40100] [LN:BSRODC] [AC:X15200] [OR:*Bacillus subtilis*] [DB:genpept-bct1] [DE:*Bacillus subtilis* rodC operon.] [NT:rodC (tag3) polypeptide (AA 1–746)] [SP:P13485] [LE:2178] [RE:4418] [DI:direct] >gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:*Bacillus subtilis*] [DB:genpept-bct1] [DE:*Bacillus subtilis* complete genome (section 19 of 21): from 3597091to 3809700.] [NT:alternate gene name: rodC] [SP:P13485] [LE:78129] [RE:80369] [DI:complement] >gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:*Bacillus subtilis*] [DB:genpept] [DE:*Bacillus subtilis* complete genome (section 19 of 21): from 3597091to 3809700.] [NT:alternate gene name: rodC] [SP:P13485] [LE:78129] [RE:80369] [DI:complement]

-continued

| ORF Name | NT ID | AA ID | NT LN | AA LN | Score | P-Value |
|---|---|---|---|---|---|---|
| AI7503000986__15136562__c2__253 | 1360 | 5132 | 1500 | 499 | 1636 | 3.2e−168 |

Description
gp:[GI:d1039113:g4514332] [LN:AB013369] [AC:AB013369] [OR:*Bacillus halodurans*] [SR:*Bacillus halodurans* (strain:C-125) DNA] [DB:genpept-bct1] [DE:*Bacillus halodurans* C-125 yesT and comEC genes, partial andcomplete cds.] [NT:unknown] [LE:4328] [RE:5830] [DI:direct]

| ORF Name | NT ID | AA ID | NT LN | AA LN | Score | P-Value |
|---|---|---|---|---|---|---|
| AI7503000986__15829135__c2__237 | 1361 | 5133 | 204 | 67 | 105 | 1.0e−05 |

Description
pir:[LN:E69764] [AC:E69764] [PN:hypothetical protein ycnI] [GN:ycnI] [OR:*Bacillus subtilis*] [DB:pir2] >gp:[GI:e1182361:g2632695] [LN:BSUB0003] [AC:Z99106:AL009126] [GN:ycnI] [FN:unknown] [OR:*Bacillus subtilis*] [DB:genpept-bct1] [DE:*Bacillus subtilis* complete genome (section 3 of 21): from 402751 to611850.] [LE:43004] [RE:43618] [DI:complement] >gp:[GI:d1009660:g1805463] [LN:D50453] [AC:D50453] [GN:ycnI] [OR:*Bacillus subtilis*] [SR:*Bacillus subtilis* (strain:168 trpC2) DNA] [DB:genpept-bct1] [DE:*Bacillus subtilis* DNA for 25–36 degree region containing theamyE-srfA region, complete cds.] [LE:125407] [RE:126021] [DI:complement]

| ORF Name | NT ID | AA ID | NT LN | AA LN | Score | P-Value |
|---|---|---|---|---|---|---|
| AI7503000986__159377__c3__317 | 1362 | 5134 | 171 | 56 | | |

Description
NO-HIT

| ORF Name | NT ID | AA ID | NT LN | AA LN | Score | P-Value |
|---|---|---|---|---|---|---|
| AI7503000986__17047575__f3__150 | 1363 | 5135 | 171 | 56 | | |

Description
NO-HIT

| ORF Name | NT ID | AA ID | NT LN | AA LN | Score | P-Value |
|---|---|---|---|---|---|---|
| AI7503000986__174218__c1__209 | 1364 | 5136 | 1989 | 662 | 1225 | 1.1e−124 |

Description
sp:[LN:YHCA__BACSU] [AC:P54585] [GN:YHCA] [OR:*BACILLUS SUBTILIS*] [DE:HYPOTHETICAL 58.3 KD PROTEIN IN GLPD-CSPB INTERGENIC REGION] [SP:P54585] [DB:swissprot] >pir:[LN:E69821] [AC:E69821] [PN:multidrug resistance protein homolog yhcA] [GN:yhcA] [CL:lincomycin-resistance protein lmrB] [OR:*Bacillus subtilis*] [DB:pir2] >gp:[GI:e1182890:g2633224] [LN:BSUB0005] [AC:Z99108:AL009126] [GN:yhcA] [FN:unknown] [OR:*Bacillus subtilis*] [DB:genpept-bct1] [DE:*Bacillus subtilis* complete genome (section 5 of 21): from 802821 to1011250.] [NT:similar to multidrug resistance protein] [SP:P54585] [LE:174464] [RE:176062] [DI:direct]

| ORF Name | NT ID | AA ID | NT LN | AA LN | Score | P-Value |
|---|---|---|---|---|---|---|
| AI7503000986__179653__c3__325 | 1365 | 5137 | 666 | 221 | 100 | 0.015 |

Description
sp:[LN:TCR2__BACSU] [AC:P14512] [GN:TET] [OR:*BACILLUS SUBTILIS*] [DE:TETRACYCLINE RESISTANCE PROTEIN] [SP:P14512] [DB:swissprot] >pir:[LN:S42238] [AC:S42238] [PN:tetracyclin resistance protein] [GN:tet] [CL:tetracycline resistance protein] [OR:*Staphylococcus aureus*] [DB:pir2] >gp:[GI:g476735] [LN:PNS1CG] [AC:M16217] [GN:tet] [OR:Plasmid pNS1] [SR:Plasmid pNS1 from *Staphylococcus aureus*, plasmid pTP5 DNA] [DB:genpept-bct1] [DE:Plasmid pNS1 (from *Staphylococcus aureus*) encodingtetracycline-resistance (tet), complete genome.] [LE:305] [RE:1684] [DI:direct] >gp:[GI:g456770] [LN:S67449] [AC:S67449] [PN:Tet(K)] [GN:tet(K)] [OR:*Staphylococcus aureus*] [SR:*Staphylococcus aureus* pT181] [DB:genpept-bct1] [DE:tet(K)=tetracycline efflux protein [*Staphylococcus aureus*, pT181,Plasmid, 1380 nt].] [NT:tetracycline efflux protein; This sequence comes] [LE:1] [RE:1380] [DI:direct] >gp:[GI:g1052998] [LN:SAU38428] [AC:U38428] [PN:tetracycline resistance protein] [GN:tet] [OR:*Staphylococcus aureus*] [SR:*Staphylococcus aureus* plasmid pKH6] [DB:genpept-bct1] [DE:*Staphylococcus aureus* tetracycline resistance plasmid pKH6,complete sequence.] [LE:321] [RE:1700] [DI:direct] >gp:[GI:g1053140] [LN:SAU38656] [AC:U38656] [PN:tetracycline resistance protein] [GN:tet] [OR:*Staphylococcus aureus*] [SR:*Staphylococcus aureus* plasmid pKH1] [DB:genpept-bct1] [DE:*Staphylococcus aureus* tetracycline resistance plasmid pKH1, tetgene, -continued

| ORF Name | NT ID | AA ID | NT LN | AA LN | Score | P-Value |
|---|---|---|---|---|---|---|
| AI7503000986_19548755_f3_132 | 1366 | 5138 | 168 | 55 | | |

Description
NO-HIT

| ORF Name | NT ID | AA ID | NT LN | AA LN | Score | P-Value |
|---|---|---|---|---|---|---|
| AI7503000986_1970178_f3_146 | 1367 | 5139 | 219 | 72 | | |

Description
NO-HIT

| ORF Name | NT ID | AA ID | NT LN | AA LN | Score | P-Value |
|---|---|---|---|---|---|---|
| AI7503000986_19742962_c1_221 | 1368 | 5140 | 1026 | 341 | 423 | 1.1e−39 |

Description
gp:[GI:e1486019:g4995689] [LN:LLA011653] [AC:AJ011653] [PN:aldose
1-epimerase] [GN:galM] [FN:mutarotase] [OR:*Lactococcus lactis*]
[DB:genpept-bct1] [EC:5.1.3.3] [DE:*Lactococcus lactis* (strain MG1363)
galactose operon (galAMKTEgenes).] [LE:1990] [RE:3009] [DI:direct]

| ORF Name | NT ID | AA ID | NT LN | AA LN | Score | P-Value |
|---|---|---|---|---|---|---|
| AI7503000986_19960885_c1_228 | 1369 | 5141 | 156 | 51 | | |

Description
NO-HIT

| ORF Name | NT ID | AA ID | NT LN | AA LN | Score | P-Value |
|---|---|---|---|---|---|---|
| AI7503000986_20579752_c3_319 | 1370 | 5142 | 150 | 49 | | |

Description
NO-HIT

| ORF Name | NT ID | AA ID | NT LN | AA LN | Score | P-Value |
|---|---|---|---|---|---|---|
| AI7503000986_20580443_c3_310 | 1371 | 5143 | 333 | 110 | 173 | 3.5e−13 |

Description
gp:[GI:g3582220] [LN:AE001272] [AC:AE001272] [PN:conserved hypothetical
protein] [GN:ORF00047] [OR:*Lactococcus lactis*] [DB:genpept-bct2]
[DE:*Lactococcus lactis* DPC3147 plasmid pMRC01, complete plasmidsequence.]
[NT:similar to GB:X69895 SP:P39044 PID:40067 percent] [LE:44384] [RE:44728]
[DI:direct]

| ORF Name | NT ID | AA ID | NT LN | AA LN | Score | P-Value |
|---|---|---|---|---|---|---|
| AI7503000986_20718790_f3_138 | 1372 | 5144 | 150 | 49 | | |

Description
NO-HIT

| ORF Name | NT ID | AA ID | NT LN | AA LN | Score | P-Value |
|---|---|---|---|---|---|---|
| AI7503000986_20789507_c2_280 | 1373 | 5145 | 186 | 61 | | |

Description
NO-HIT

| ORF Name | NT ID | AA ID | NT LN | AA LN | Score | P-Value |
|---|---|---|---|---|---|---|
| AI7503000986_20897125_c1_212 | 1374 | 5146 | 975 | 324 | 504 | 2.9e−48 |

Description
pir:[LN:H69806] [AC:H69806] [PN:divalent cation transport protein homolog
yfjQ] [GN:yfjQ] [CL:magnesium and cobalt transport protein] [OR:*Bacillus
subtilis*] [DB:pir2] >gp: [GI:e1182790:g2633124] [LN:BSUB0005]
[AC:Z99108:AL009126] [GN:yfjQ] [FN:unknown] [OR:*Bacillus subtilis*]
[DB:genpept-bct1] [DE:*Bacillus subtilis* complete genome (section 5 of 21):
from 802821 to1011250.] [NT:similar to divalent cation transport protein]
[LE:68033] [RE:68992] [DI:complement] >gp:[GI:d1025214:g2780401] [LN:D78509]
[AC:D78509] [PN:YfjQ] [OR:*Bacillus subtilis*] [SR:*Bacillus subtilis*
(strain:AC327) DNA] [DB:genpept-bct1] [DE:*Bacillus subtilis* YfjG-YfjR genes, -continued complete cds.] [LE:17333] [RE:18292] [DI:direct]

| ORF Name | NT ID | AA ID | NT LN | AA LN | Score | P-Value |
|---|---|---|---|---|---|---|
| AI7503000986_21676937_c1_190 | 1375 | 5147 | 132 | 43 | | |

Description
NO-HIT

| ORF Name | NT ID | AA ID | NT LN | AA LN | Score | P-Value |
|---|---|---|---|---|---|---|
| AI7503000986_22074200_f3_184 | 1376 | 5148 | 126 | 42 | | |

Description
NO-HIT

| ORF Name | NT ID | AA ID | NT LN | AA LN | Score | P-Value |
|---|---|---|---|---|---|---|
| AI7503000986_22277215_f3_142 | 1377 | 5149 | 1164 | 387 | 109 | 1.5e−05 |

Description
pir:[LN:C44863] [AC:C44863] [PN:R45 antigen] [OR:*Plasmodium falciparum*]
[DB:pir3]

| ORF Name | NT ID | AA ID | NT LN | AA LN | Score | P-Value |
|---|---|---|---|---|---|---|
| AI7503000986_22455213_f3_169 | 1378 | 5150 | 687 | 228 | 411 | 2.1e−38 |

Description
gp:[GI:g4982229] [LN:AE001807] [AC:AE001807:AE000512] [PN:response regulator
DrrA] [GN:TM1655] [OR:*Thermotoga maritima*] [DB:genpept-bct2] [DE:*Thermotoga
maritima* section 119 of 136 of the complete genome.] [NT:similar to
PID:1575577 GB:AE000512 percent] [LE:12477] [RE:13220] [DI:complement]

| ORF Name | NT ID | AA ID | NT LN | AA LN | Score | P-Value |
|---|---|---|---|---|---|---|
| AI7503000986_22867942_c1_224 | 1379 | 5151 | 711 | 236 | 417 | 4.8e−39 |

Description
gp:[GI:g4262236] [LN:ATAC006200] [AC:AC006200] [PN:putative ribose
5-phosphate isomerase] [GN:F10A8.17] [OR:*Arabidopsis thaliana*] [SR:*thale
cress*] [DB:genpept-pln2] [DE:*Arabidopsis thaliana* chromosome II BAC F10A8
genomic sequence,complete sequence.] [LE:58788] [RE:59585] [DI:complement]

| ORF Name | NT ID | AA ID | NT LN | AA LN | Score | P-Value |
|---|---|---|---|---|---|---|
| AI7503000986_22869687_c1_186 | 1380 | 5152 | 438 | 145 | 143 | 5.2e−10 |

Description
pir:[LN:A64946] [AC:A64946] [PN:hypothetical protein b1841] [CL:copper
resistance protein pcoC] [OR:*Escherichia coli*] [DB:pir2] >gp:[GI:g1788146]
[LN:AE000278] [AC:AE000278:U00096] [PN:orf, hypothetical protein] [GN:b1841]
[FN:orf; Unknown] [OR:*Escherichia coli*] [DB:genpept-bct2] [DE:*Escherichia
coli* K-12 MG1655 section 168 of 400 of the completegenome.] [NT:f124; This
124 aa ORF is 39 pct identical (6 gaps)] [LE:4445] [RE:4819] [DI:complement]

| ORF Name | NT ID | AA ID | NT LN | AA LN | Score | P-Value |
|---|---|---|---|---|---|---|
| AI7503000986_23556552_c2_240 | 1381 | 5153 | 405 | 134 | 123 | 6.9e−08 |

Description
sp:[LN:YCX1_PORPU] [AC:P51192] [OR:*PORPHYRA PURPUREA*] [DE:HYPOTHETICAL 20.1
KD PROTEIN IN YCF37-PSAF INTERGENIC REGION (ORF174)] [SP:P51192]
[DB:swissprot] >pir:[LN:S73113] [AC:S73113] [PN:hypothetical protein 174]
[OR:chloroplast *Porphyra purpurea*] [DB:pir2]

| ORF Name | NT ID | AA ID | NT LN | AA LN | Score | P-Value |
|---|---|---|---|---|---|---|
| AI7503000986_23601557_f1_10 | 1382 | 5154 | 201 | 66 | | |

Description
NO-HIT

| ORF Name | NT ID | AA ID | NT LN | AA LN | Score | P-Value |
|---|---|---|---|---|---|---|
| AI7503000986_23601577_f3_144 | 1383 | 5155 | 186 | 61 | | |

-continued

| Description |
|---|
| NO-HIT |

| ORF Name | NT ID | AA ID | NT LN | AA LN | Score | P-Value |
|---|---|---|---|---|---|---|
| AI7503000986_23611437_c1_188 | 1384 | 5156 | 135 | 44 | | |

| Description |
|---|
| NO-HIT |

| ORF Name | NT ID | AA ID | NT LN | AA LN | Score | P-Value |
|---|---|---|---|---|---|---|
| AI7503000986_23839193_c1_193 | 1385 | 5157 | 1614 | 537 | 1324 | 3.7e−135 |

| Description |
|---|
| pir:[LN:F69649] [AC:F69649] [PN:L-lactate permease lctP] [GN:lctP] [CL:L-lactate permease] [OR:*Bacillus subtilis*] [DB:pir2] >gp:[GI:e1182258:g2632592] [LN:BSUB0002] [AC:Z99105:AL009126] [PN:L-lactate permease] [GN:lctP] [OR:*Bacillus subtilis*] [DB:genpept-bct1] [DE:*Bacillus subtilis* complete genome (section 2 of 21): from 194651 to415810.] [NT:alternate gene name: ycgC] [LE:135677] [RE:137302] [DI:direct] |

| ORF Name | NT ID | AA ID | NT LN | AA LN | Score | P-Value |
|---|---|---|---|---|---|---|
| AI7503000986_23876887_f1_60 | 1386 | 5158 | 123 | 40 | | |

| Description |
|---|
| NO-HIT |

| ORF Name | NT ID | AA ID | NT LN | AA LN | Score | P-Value |
|---|---|---|---|---|---|---|
| AI7503000986_23923412_f1_31 | 1387 | 5159 | 225 | 74 | | |

| Description |
|---|
| NO-HIT |

| ORF Name | NT ID | AA ID | NT LN | AA LN | Score | P-Value |
|---|---|---|---|---|---|---|
| AI7503000986_23929627_f3_160 | 1388 | 5160 | 177 | 58 | 46 | 0.046 |

| Description |
|---|
| pir:[LN:I40601] [AC:I40601:S70950] [PN:mobilization protein] [GN:mobA] [OR:*Bacteroides vulgatus*] [DB:pir2] >gp:[GI:g1079659] [LN:BVU38243] [AC:U38243:M72418] [PN:mobilization protein] [GN:mobA] [FN:conjugal transfer of Tn4555] [OR:*Bacteroides vulgatus*] [DB:genpept-bct1] [DE:*Bacteroides vulgatus* beta-lactamase (cfxA) gene, complete cds andmobilization protein (mobA) gene, complete cds.] [LE:1208] [RE:2611] [DI:complement] |

| ORF Name | NT ID | AA ID | NT LN | AA LN | Score | P-Value |
|---|---|---|---|---|---|---|
| AI7503000986_24250317_c1_203 | 1389 | 5161 | 156 | 51 | | |

| Description |
|---|
| NO-HIT |

| ORF Name | NT ID | AA ID | NT LN | AA LN | Score | P-Value |
|---|---|---|---|---|---|---|
| AI7503000986_24267567_f3_163 | 1390 | 5162 | 645 | 214 | 99 | 0.0046 |

| Description |
|---|
| pir:[LN:C70649] [AC:C70649] [PN:hypothetical protein Rv3058c] [GN:Rv3058c] [OR:*Mycobacterium tuberculosis*] [DB:pir2] >gp:[GI:e290931:g1781155] [LN:MTCY22D7] [AC:Z83866:AL123456] [PN:hypothetical protein Rv3058c] [GN:Rv3058c] [OR:*Mycobacterium tuberculosis*] [DB:genpept-bct1] [DE:*Mycobacterium tuberculosis* H37Rv complete genome; segment 133/162.] [NT:Rv3058c, (MTCY22D7.23), len: 216. Function:] [LE:4546] [RE:5196] [DI:complement] |

| ORF Name | NT ID | AA ID | NT LN | AA LN | Score | P-Value |
|---|---|---|---|---|---|---|
| AI7503000986_24394175_f3_151 | 1391 | 5163 | 159 | 52 | | |

| Description |
|---|
| NO-HIT |

| ORF Name | NT ID | AA ID | NT LN | AA LN | Score | P-Value |
|---|---|---|---|---|---|---|
| AI7503000986_24407827_c2_266 | 1392 | 5164 | 561 | 186 | | |

-continued

| Description |
|---|
| NO-HIT |

| ORF Name | NT ID | AA ID | NT LN | AA LN | Score | P-Value |
|---|---|---|---|---|---|---|
| AI7503000986_24412826_c3_323 | 1393 | 5165 | 963 | 320 | 286 | 3.7e−25 |

| Description |
|---|
| sp:[LN:HUTG_KLEAE] [AC:P19452] [GN:HUTG] [OR:*KLEBSIELLA AEROGENES*] [EC:3.5.3.8] [DE:(HISTIDINE UTILIZATION PROTEIN G) (FRAGMENT)] [SP:P19452] [DB:swissprot] >gp:[GI:g149204] [LN:KPNHUTC] [AC:M34604] [OR:*Klebsiella aerogenes*] [SR:*Klebsiella aerogenes* (strain W70) DNA] [DB:genpept-bct1] [DE:*K.aerogenes* histidine utilization repressor C (hutC) gene, completecds.] [NT:histidine utilization repressor G] [LE:<1] [RE:669] [DI:direct] |

| ORF Name | NT ID | AA ID | NT LN | AA LN | Score | P-Value |
|---|---|---|---|---|---|---|
| AI7503000986_24415925_c1_211 | 1394 | 5166 | 903 | 300 | 282 | 9.7e−25 |

| Description |
|---|
| gp:[GI:g1209223] [LN:ACCEST] [AC:L38252] [PN:esterase] [GN:est] [OR:*Acinetobacter lwoffii*] [DB:genpept-bct1] [DE:*Acinetobacter lwoffii* orf1 and esterase (est) genes, complete cds.] [LE:638] [RE:1549] [DI:direct] |

| ORF Name | NT ID | AA ID | NT LN | AA LN | Score | P-Value |
|---|---|---|---|---|---|---|
| AI7503000986_24662825_c2_279 | 1395 | 5167 | 618 | 205 | 538 | 7.3e−52 |

| Description |
|---|
| pir:[LN:H70068] [AC:H70068] [PN:hypothetical protein ywrF] [GN:ywrF] [OR:*Bacillus subtilis*] [DB:pir2] >gp:[GI:e1184514:g2636133] [LN:BSUB0019] [AC:Z99122:AL009126] [GN:ywrF] [FN:unknown] [OR:*Bacillus subtilis*] [DB:genpept-bct1] [DE:*Bacillus subtilis* complete genome (section 19 of 21): from 3597091to 3809700.] [LE:119966] [RE:120583] [DI:direct] >gp:[GI:e311284:g1929333] [LN:BSZ93767] [AC:Z93767] [GN:ywrF] [OR:*Bacillus subtilis*] [DB:genpept-bct1] [DE:*B.subtilis* DNA; 15.2 kb fragment, from ywqN gene to ywrO gene.] [LE:4588] [RE:5205] [DI:complement] >gp:[GI:e1184514:g2636133] [LN:BSUB0019] [AC:Z99122:AL009126] [GN:ywrF] [FN:unknown] [OR:*Bacillus subtilis*] [DB:genpept] [DE:*Bacillus subtilis* complete genome (section 19 of 21): from 3597091to 3809700.] [LE:119966] [RE:120583] [DI:direct] |

| ORF Name | NT ID | AA ID | NT LN | AA LN | Score | P-Value |
|---|---|---|---|---|---|---|
| AI7503000986_2470010_c1_191 | 1396 | 5168 | 723 | 240 | 157 | 1.3e−08 |

| Description |
|---|
| gp:[GI:e1407791:g4493935] [LN:PFMAL3P5] [AC:AL034556] [GN:MAL3P5.8] [OR:*Plasmodium falciparum*] [SR:malaria parasite *P. falciparum*] [DB:genpept-inv1] [DE:*Plasmodium falciparum* MAL3P5, complete sequence.] [NT:predicted using hexExon; MAL3P5.8 (PFC0610c),] [LE:29992] [RE:33537] [DI:complement] |

| ORF Name | NT ID | AA ID | NT LN | AA LN | Score | P-Value |
|---|---|---|---|---|---|---|
| AI7503000986_24803386_c1_201 | 1397 | 5169 | 1080 | 359 | 215 | 1.4e−15 |

| Description |
|---|
| pir:[LN:G70728] [AC:G70728] [PN:hypothetical protein Rv2563] [GN:Rv2563] [OR:*Mycobacterium tuberculosis*] [DB:pir2] >gp:[GI:e1299946:g3261618] [LN:MTCY9C4] [AC:Z77250:AL123456] [PN:hypothetical protein Rv2563] [GN:Rv2563] [OR:*Mycobacterium tuberculosis*] [DB:genpept-bct1] [DE:*Mycobacterium tuberculosis* H37Rv complete genome; segment 113/162.] [NT:Rv2563, (MTCY9C4.05c), len: 349. Unknown membrane] [LE:5757] [RE:6806] [DI:direct] |

| ORF Name | NT ID | AA ID | NT LN | AA LN | Score | P-Value |
|---|---|---|---|---|---|---|
| AI7503000986_2540907_c3_304 | 1398 | 5170 | 186 | 61 | | |

| Description |
|---|
| NO-HIT |

| ORF Name | NT ID | AA ID | NT LN | AA LN | Score | P-Value |
|---|---|---|---|---|---|---|
| AI7503000986_25527188_c1_225 | 1399 | 5171 | 1137 | 378 | 830 | 8.3e−83 |

| Description |
|---|
| pir:[LN:E69640] [AC:E69640] [PN:hippurate hydrolase hipO] [GN:hipO] |

[CL:hippurate hydrolase] [OR:*Bacillus subtilis*] [DB:pir2]
>gp:[GI:e1184178:g2635394] [LN:BSUB0015] [AC:Z99118:AL009126] [PN:hippurate
hydrolase] [GN:hipO] [OR:*Bacillus subtilis*] [DB:genpept-bct1] [EC:3.5.1.32]
[DE:*Bacillus subtilis* complete genome (section 15 of 21): from 2795131to
3013540.] [LE:203660] [RE:204910] [DI:complement] >gp:[GI:e1185802:g2635413]
[LN:BSUB0016] [AC:Z99119:AL009126] [PN:hippurate hydrolase] [GN:hipO]
[OR:*Bacillus subtilis*] [DB:genpept-bct1] [EC:3.5.1.32] [DE:*Bacillus subtilis*
complete genome (section 16 of 21): from 2997771to 3213410.] [LE:1020]
[RE:2270] [DI:complement] >gp:[GI:g2293256] [LN:AF008220] [AC:AF008220]
[PN:putative hippurate hydrolase] [GN:hipO] [OR:*Bacillus subtilis*]
[DB:genpept-bct2] [DE:*Bacillus subtilis* rrnB-dnaB genomic region.]
[LE:178157] [RE:179407] [DI:direct]

| ORF Name | NT ID | AA ID | NT LN | AA LN | Score | P-Value |
|---|---|---|---|---|---|---|
| AI7503000986_25551640_c1_214 | 1400 | 5172 | 861 | 286 | 112 | 0.0023 |

Description
gp:[GI:e1331922:g3758855] [LN:PFMAL3P6] [AC:Z98551] [GN:MAL3P6.11]
[OR:*Plasmodium falciparum*] [SR:malaria parasite *P. falciparum*]
[DB:genpept-inv1] [DE:*Plasmodium falciparum* MAL3P6, complete sequence.]
[NT:predicted using hexExon; MAL3P6.11 (PFC0760c),] [LE:53772] [RE:63956]
[DI:complement]

| ORF Name | NT ID | AA ID | NT LN | AA LN | Score | P-Value |
|---|---|---|---|---|---|---|
| AI7503000986_25579390_f1_50 | 1401 | 5173 | 1194 | 397 | 402 | 8.5e−37 |

Description
gp:[GI:e1294490:g3169038] [LN:SC1C3] [AC:AL023702] [PN:putative transferase]
[GN:SC1C3.12] [OR:*Streptomyces coelicolor*] [DB:genpept-bct1]
[DE:*Streptomyces coelicolor* cosmid 1C3.] [NT:SC1C3.12, possible transferase,
len: 697 aa; weakly] [LE:13186] [RE:15279] [DI:direct]

| ORF Name | NT ID | AA ID | NT LN | AA LN | Score | P-Value |
|---|---|---|---|---|---|---|
| AI7503000986_25910952_c3_309 | 1402 | 5174 | 141 | 46 | | |

Description
NO-HIT

| ORF Name | NT ID | AA ID | NT LN | AA LN | Score | P-Value |
|---|---|---|---|---|---|---|
| AI7503000986_26753588_f1_44 | 1403 | 5175 | 1383 | 460 | 344 | 2.6e−31 |

Description
pir:[LN:H69762] [AC:H69762] [PN:two-component sensor histidine kinase
homolog yclK] [GN:yclK] [OR:*Bacillus subtilis*] [DB:pir2]
>gp:[GI:e1182343:g2632677] [LN:BSUB0003] [AC:Z99106:AL009126] [GN:yclK]
[FN:unknown] [OR:*Bacillus subtilis*] [DB:genpept-bct1] [DE:*Bacillus subtilis*
complete genome (section 3 of 21): from 402751 to611850.] [NT:similar to
two-component sensor histidine kinase] [LE:24077] [RE:25498] [DI:direct]
>gp:[GI:d1009643:g1805446] [LN:D50453] [AC:D50453] [PN:homologue of alkaline
phosphatase synthesis] [GN:yclK] [OR:*Bacillus subtilis*] [SR:*Bacillus
subtilis* (strain:168 trpC2) DNA] [DB:genpept-bct1] [DE:*Bacillus subtilis* DNA
for 25–36 degree region containing theamyE-srfA region, complete cds.]
[LE:106480] [RE:107901] [DI:direct]

| ORF Name | NT ID | AA ID | NT LN | AA LN | Score | P-Value |
|---|---|---|---|---|---|---|
| AI7503000986_272550_c2_268 | 1404 | 5176 | 123 | 40 | | |

Description
NO-HIT

| ORF Name | NT ID | AA ID | NT LN | AA LN | Score | P-Value |
|---|---|---|---|---|---|---|
| AI7503000986_292883_c2_229 | 1405 | 5177 | 126 | 41 | | |

Description
NO-HIT

| ORF Name | NT ID | AA ID | NT LN | AA LN | Score | P-Value |
|---|---|---|---|---|---|---|
| AI7503000986_29565627_c3_286 | 1406 | 5178 | 879 | 292 | | |

Description
NO-HIT

-continued

| ORF Name | NT ID | AA ID | NT LN | AA LN | Score | P-Value |
|---|---|---|---|---|---|---|
| AI7503000986_30476575_c1_216 | 1407 | 5179 | 165 | 54 | | |

Description
NO-HIT

| ORF Name | NT ID | AA ID | NT LN | AA LN | Score | P-Value |
|---|---|---|---|---|---|---|
| AI7503000986_30703458_c2_230 | 1408 | 5180 | 906 | 301 | 1241 | 2.3e−126 |

Description
sp:[LN:PTSB_STAXY] [AC:P51184] [GN:SCRA] [OR:*STAPHYLOCOCCUS XYLOSUS*]
[EC:2.7.1.69] [DE:(EC 2.7.1.69) (EII-SCR)] [SP:P51184] [DB:swissprot]
>pir:[LN:S39978] [AC:S39978] [PN:scrA protein] [CL:phosphotransferase
system sucrose-specific enzyme II, factor II] [OR:*Staphylococcus xylosus*]
[DB:pir2] >gp:[GI:g407908] [LN:SXSCRA] [AC:X69800] [PN:EIIscr] [GN:scrA]
[OR:*Staphylococcus xylosus*] [DB:genpept-bct1] [DE:*S.xylosus* scrA gene and
unidentified open reading frames.] [NT:ORF2] [SP:P51184] [LE:1053] [RE:2495]
[DI:direct]

| ORF Name | NT ID | AA ID | NT LN | AA LN | Score | P-Value |
|---|---|---|---|---|---|---|
| AI7503000986_34032561_c3_316 | 1409 | 5181 | 123 | 40 | | |

Description
NO-HIT

| ORF Name | NT ID | AA ID | NT LN | AA LN | Score | P-Value |
|---|---|---|---|---|---|---|
| AI7503000986_34199202_c1_189 | 1410 | 5182 | 540 | 179 | 343 | 3.3e−31 |

Description
gp:[GI:e1184294:g2635712] [LN:BSUB0017] [AC:Z99120:AL009126]
[PN:transcriptional regulator] [GN:paiA] [FN:negative regulation of
sporulation, septation] [OR:*Bacillus subtilis*] [DB:genpept-bct1]
[DE:*Bacillus subtilis* complete genome (section 17 of 21): from 3197001to
3414420.] [LE:106800] [RE:107318] [DI:complement]

| ORF Name | NT ID | AA ID | NT LN | AA LN | Score | P-Value |
|---|---|---|---|---|---|---|
| AI7503000986_34610667_c3_297 | 1411 | 5183 | 690 | 229 | 465 | 3.9e−44 |

Description
pir:[LN:B69377] [AC:B69377] [PN:ABC transporter, ATP-binding protein
homolog] [CL:unassigned ATP-binding cassette proteins: ATP-binding cassette
homology] [OR:*Archaeoglobus fulgidus*] [DB:pir2] >gp:[GI:g2649576]
[LN:AE001033] [AC:AE001033:AE000782] [PN:ABC transporter, ATP-binding
protein] [GN:AF1018] [OR:*Archaeoglobus fulgidus*] [DB:genpept-bct2]
[DE:*Archaeoglobus fulgidus* section 74 of 172 of the complete genome.]
[NT:similar to GB:L77117 SP:Q58206 PID:1591493 percent] [LE:2126] [RE:2812]
[DI:complement]

| ORF Name | NT ID | AA ID | NT LN | AA LN | Score | P-Value |
|---|---|---|---|---|---|---|
| AI7503000986_35955213_c3_302 | 1412 | 5184 | 165 | 54 | | |

Description
NO-HIT

| ORF Name | NT ID | AA ID | NT LN | AA LN | Score | P-Value |
|---|---|---|---|---|---|---|
| AI7503000986_36140963_f2_120 | 1413 | 5185 | 1431 | 476 | 226 | 1.9e−15 |

Description
sp:[LN:TAGF_BACSU] [AC:P13485] [GN:TAGF:RODC:TAG3] [OR:*BACILLUS SUBTILIS*]
[DE:TEICHOIC ACID BIOSYNTHESIS PROTEIN F] [SP:P13485] [DB:swissprot]
>pir:[LN:S06049] [AC:S06049:G69720] [PN:probable CDPglycerol
glycerophosphotransferase, :CDP-glycerol:polyglycerol phosphate
glycero-phosphotransferase tagF:rodC protein:teichoic-acid synthase]
[GN:rodC:tag-3:tagF] [OR:*Bacillus subtilis*] [EC:2.7.8.12] [DB:pir2] [MP:310
degrees] >gp:[GI:g40100] [LN:BSRODC] [AC:X15200] [OR:*Bacillus subtilis*]
[DB:genpept-bct1] [DE:*Bacillus subtilis* rodC operon.] [NT:rodC (tag3)
polypeptide (AA 1–746)] [SP:P13485] [LE:2178] [RE:4418] [DI:direct]
>gp:[GI:e1184478:g2636098] [LN:BSUB0019] [AC:Z99122:AL009126]
[PN:CDP-glycerol:polyglycerol phosphate] [GN:tagF] [FN:teichoic acid
biosynthesis] [OR:*Bacillus subtilis*] [DB:genpept-bct1] [DE:*Bacillus subtilis*
complete genome (section 19 of 21): from 3597091to 3809700.] [NT:alternate
gene name: rodC] [SP:P13485] [LE:78129] [RE:80369] [DI:complement]

-continued

>gp:[GI:e1184478:g2636098] [LN:BSUB0019] [AC:Z99122:AL009126] [PN:CDP-glycerol:polyglycerol phosphate] [GN:tagF] [FN:teichoic acid biosynthesis] [OR:*Bacillus subtilis*] [DB:genpept] [DE:*Bacillus subtilis* complete genome (section 19 of 21): from 3597091to 3809700.] [NT:alternate gene name: rodC] [SP:P13485] [LE:78129] [RE:80369] [DI:complement]

| ORF Name | NT ID | AA ID | NT LN | AA LN | Score | P-Value |
|---|---|---|---|---|---|---|
| AI7503000986__3906385__f3__183 | 1414 | 5186 | 126 | 41 | | |

Description
NO-HIT

| ORF Name | NT ID | AA ID | NT LN | AA LN | Score | P-Value |
|---|---|---|---|---|---|---|
| AI7503000986__3957511__c2__248 | 1415 | 5187 | 126 | 41 | | |

Description
NO-HIT

| ORF Name | NT ID | AA ID | NT LN | AA LN | Score | P-Value |
|---|---|---|---|---|---|---|
| AI7503000986__4062562__c2__269 | 1416 | 5188 | 183 | 60 | | |

Description
NO-HIT

| ORF Name | NT ID | AA ID | NT LN | AA LN | Score | P-Value |
|---|---|---|---|---|---|---|
| AI7503000986__4178140__c2__270 | 1417 | 5189 | 141 | 46 | | |

Description
NO-HIT

| ORF Name | NT ID | AA ID | NT LN | AA LN | Score | P-Value |
|---|---|---|---|---|---|---|
| AI7503000986__4297627__f2__119 | 1418 | 5190 | 132 | 43 | | |

Description
NO-HIT

| ORF Name | NT ID | AA ID | NT LN | AA LN | Score | P-Value |
|---|---|---|---|---|---|---|
| AI7503000986__4382062__f1__19 | 1419 | 5191 | 189 | 62 | | |

Description
NO-HIT

| ORF Name | NT ID | AA ID | NT LN | AA LN | Score | P-Value |
|---|---|---|---|---|---|---|
| AI7503000986__4496062__c3__287 | 1420 | 5192 | 345 | 114 | 168 | 1.2e−12 |

Description
pir:[LN:E69764] [AC:E69764] [PN:hypothetical protein ycnI] [GN:ycnI] [OR:*Bacillus subtilis*] [DB:pir2] >gp:[GI:e1182361:g2632695] [LN:BSUB0003] [AC:Z99106:AL009126] [GN:ycnI] [FN:unknown] [OR:*Bacillus subtilis*] [DB:genpept-bct1] [DE:*Bacillus subtilis* complete genome (section 3 of 21): from 402751 to611850.] [LE:43004] [RE:43618] [DI:complement] >gp:[GI:d1009660:g1805463] [LN:D50453] [AC:D50453] [GN:ycnI] [OR:*Bacillus subtilis*] [SR:*Bacillus subtilis* (strain:168 trpC2) DNA] [DB:genpept-bct1] [DE:*Bacillus subtilis* DNA for 25–36 degree region containing theamyE-srfA region, complete cds.] [LE:125407] [RE:126021] [DI:complement]

| ORF Name | NT ID | AA ID | NT LN | AA LN | Score | P-Value |
|---|---|---|---|---|---|---|
| AI7503000986__4687893__c1__213 | 1421 | 5193 | 1059 | 352 | 523 | 2.8e−50 |

Description
gp:[GI:g2822338] [LN:AF016485] [AC:AF016485] [OR:*Halobacterium* sp. NRC-1] [DB:genpept-bct2] [DE:*Halobacterium* sp. NRC-1 plasmid pNRC100, complete plasmid sequence.] [NT:ORF H0660; similar to ORF in Sulfolobus] [LE:60258] [RE:61397] [DI:complement] >gp:[GI:g2822427] [LN:AF016485] [AC:AF016485] [OR:*Halobacterium* sp. NRC-1] [DB:genpept-bct2] [DE:*Halobacterium* sp. NRC-1 plasmid pNRC100, complete plasmid sequence.] [NT:ORF H1696; similar to *Sulolobus solfataricus*] [LE:161992] [RE:163131] [DI:direct]

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000986_4689007_f1_49 | 1422 | 5194 | 123 | 40 | | |

Description
NO-HIT

| ORF Name | NT ID | AA ID | NT LN | AA LN | Score | P-Value |
|---|---|---|---|---|---|---|
| AI7503000986_4727217_f1_25 | 1423 | 5195 | 402 | 133 | | |

Description
NO-HIT

| ORF Name | NT ID | AA ID | NT LN | AA LN | Score | P-Value |
|---|---|---|---|---|---|---|
| AI7503000986_4797125_f3_148 | 1424 | 5196 | 1647 | 548 | 970 | 1.2e−97 |

Description
sp:[LN:ARAB_BACSU] [AC:P94524] [GN:ARAB] [OR:*BACILLUS SUBTILIS*]
[EC:2.7.1.16] [DE:L-RIBULOKINASE,] [SP:P94524] [DB:swissprot]
>pir:[LN:D69587] [AC:D69587] [PN:L-ribulokinase araB] [GN:araB]
[OR:*Bacillus subtilis*] [DB:pir2] >gp:[GI:e1184128:g2635344] [LN:BSUB0015]
[AC:Z99118:AL009126] [PN:L-ribulokinase] [GN:araB] [FN:L-arabinose
utilization] [OR:*Bacillus subtilis*] [DB:genpept-bct1] [EC:2.7.1.16]
[DE:*Bacillus subtilis* complete genome (section 15 of 21): from 2795131to
3013540.] [SP:P94524] [LE:149661] [RE:151343] [DI:complement]
>gp:[GI:e1165307:g1770015] [LN:BSZ75208] [AC:Z75208] [PN:L-ribulokinase]
[GN:araB] [OR:*Bacillus subtilis*] [DB:genpept-bct1] [DE:*B.subtilis* genomic
sequence 89009bp.] [NT:homology to araB of *Escherichia coli*;identified on]
[SP:P94524] [LE:18564] [RE:20246] [DI:direct]

| ORF Name | NT ID | AA ID | NT LN | AA LN | Score | P-Value |
|---|---|---|---|---|---|---|
| AI7503000986_4881588_c2_258 | 1425 | 5197 | 465 | 154 | 134 | 4.7e−09 |

Description
pir:[LN:A69783] [AC:A69783] [PN:transcription regulator MarR family homolog
ydgG] [GN:ydgG] [OR:*Bacillus subtilis*] [DB:pir2] >gp:[GI:d1020150:g1881370]
[LN:AB001488] [AC:AB001488] [GN:ydgG] [OR:*Bacillus subtilis*] [SR:*Bacillus
subtilis* (strain:168) DNA] [DB:genpept-bct1] [DE:*Bacillus subtilis* genome
sequence, 148 kb sequence of the regionbetween 35 and 47 degree.]
[NT:FUNCTION UNKNOWN.] [LE:142152] [RE:142610] [DI:direct]
>gp:[GI:e1182530:g2632864] [LN:BSUB0003] [AC:Z99106:AL009126] [GN:ydgG]
[FN:unknown] [OR:*Bacillus subtilis*] [DB:genpept-bct1] [DE:*Bacillus subtilis*
complete genome (section 3 of 21): from 402751 to611850.] [NT:similar to
transcriptional regulator (MarR family)] [LE:205898] [RE:206356] [DI:direct]
>gp:[GI:e1182543:g26328771] [LN:BSUB0004] [AC:Z99107:AL009126] [GN:ydgG]
[FN:unknown] [OR:*Bacillus subtilis*] [DB:genpept-bct1] [DE:*Bacillus subtilis*
complete genome (section 4 of 21): from 600701 to813890.] [NT:similar to
transcriptional regulator (MarR family)] [LE:7948] [RE:8406] [DI:direct]

| ORF Name | NT ID | AA ID | NT LN | AA LN | Score | P-Value |
|---|---|---|---|---|---|---|
| AI7503000986_5111253_f1_6 | 1426 | 5198 | 147 | 48 | | |

Description
NO-HIT

| ORF Name | NT ID | AA ID | NT LN | AA LN | Score | P-Value |
|---|---|---|---|---|---|---|
| AI7503000986_5128587_f1_12 | 1427 | 5199 | 696 | 231 | 336 | 1.8e−30 |

Description
pir:[LN:A69811] [AC:A69811] [PN:conserved hypothetical protein yflK]
[GN:yflK] [CL:hypothetical protein HI0278] [OR:*Bacillus subtilis*] [DB:pir2]
>gp:[GI:e1182755:g2633089] [LN:BSUB0005] [AC:Z99108:AL009126] [GN:yflK]
[FN:unknown] [OR:*Bacillus subtilis*] [DB:genpept-bct1] [DE:*Bacillus subtilis*
complete genome (section 5 of 21): from 802821 to1011250.] [NT:similar to
hypothetical proteins] [LE:34765] [RE:35430] [DI:direct]
>gp:[GI:d1023167:g2443233] [LN:D86417] [AC:D86417] [PN:YflK] [OR:*Bacillus
subtilis*] [SR:*Bacillus subtilis* (strain:AC327) DNA] [DB:genpept-bct1]
[DE:*Bacillus subtilis* 35.7 kb genomic DNA, 70–73 degree region,complete
cds.] [LE:13092] [RE:13757] [DI:complement]

| ORF Name | NT ID | AA ID | NT LN | AA LN | Score | P-Value |
|---|---|---|---|---|---|---|
| AI7503000986_5283390_c2_259 | 1428 | 5200 | 1416 | 471 | 465 | 3.9e−44 |

Description
gp:[GI:g3676414] [LN:AF051917] [AC:AF051917:L19570] [PN:unknown]

-continued

[OR:*Staphylococcus aureus*] [DB:genpept-bct2] [DE:*Staphylococcus aureus* plasmid pSK41, complete sequence.] [NT:Orf423] [LE:755] [RE:2026] [DI:direct]

| ORF Name | NT ID | AA ID | NT LN | AA LN | Score | P-Value |
|---|---|---|---|---|---|---|
| AI7503000986_6307_f3_182 | 1429 | 5201 | 174 | 57 | | |

Description
NO-HIT

| ORF Name | NT ID | AA ID | NT LN | AA LN | Score | P-Value |
|---|---|---|---|---|---|---|
| AI7503000986_6930462_c2_260 | 1430 | 5202 | 1227 | 408 | 634 | 4.9e−62 |

Description
pir:[LN:E69783] [AC:E69783] [PN:bicyclomycin resistance protein homolog ydgK] [GN:ydgK] [CL:bicyclomycin resistance protein] [OR:*Bacillus subtilis*] [DB:pir2] >gp:[GI:d1020154:g1881374] [LN:AB001488] [AC:AB001488] [GN:ydgK] [OR:*Bacillus subtilis*] [SR:*Bacillus subtilis* (strain:168) DNA] [DB:genpept-bct1] [DE:*Bacillus subtilis* genome sequence, 148 kb sequence of the regionbetween 35 and 47 degree.] [NT:SIMILAR TO BICYCLOMYCIN RESISTANCE PROTEIN.] [LE:146860] [RE:148068] [DI:direct] >gp:[GI:e1182547:g2632881] [LN:BSUB0004] [AC:Z99107:AL009126] [GN:ydgK] [FN:unknown] [OR:*Bacillus subtilis*] [DB:genpept-bct1] [DE:*Bacillus subtilis* complete genome (section 4 of 21): from 600701 to813890.] [NT:similar to bicyclomycin resistance protein] [LE:12656] [RE:13864] [DI:direct]

| ORF Name | NT ID | AA ID | NT LN | AA LN | Score | P-Value |
|---|---|---|---|---|---|---|
| AI7503000986_7242812_f3_152 | 1431 | 5203 | 627 | 208 | 373 | 2.2e−34 |

Description
sp:[LN:3MGH_BACSU] [AC:P94378] [GN:YXLJ] [OR:*BACILLUS SUBTILIS*] [EC:3.2.2.-] [DE:PUTATIVE 3-METHYLADENINE DNA GLYCOSYLASE,] [SP:P94378] [DB:swissprot] >pir:[LN:D70082] [AC:D70082] [PN:DNA-3-methyladenine glycosidase homolog yxlJ] [GN:yxlJ] [OR:*Bacillus subtilis*] [DB:pir2] >gp:[GI:e1186361:g2636397] [LN:BSUB0020] [AC:Z99123:AL009126] [GN:yxlJ] [FN:unknown] [OR:*Bacillus subtilis*] [DB:genpept-bct1] [DE:*Bacillus subtilis* complete genome (section 20 of 21): from 3798401to 4010550.] [NT:similar to DNA-3-methyladenine glycosidase] [SP:P94378] [LE:164671] [RE:165261] [DI:complement] >gp:[GI:d1012408:g1783264] [LN:D83026] [AC:D83026:D45911] [GN:yxlJ] [OR:*Bacillus subtilis*] [SR:*Bacillus subtilis* (strain:BGSC 1A1) DNA] [DB:genpept-bct1] [DE:*Bacillus subtilis* genome sequence covering lic-cel region.] [NT:homologous to DNA glycosylases; hypothetical] [LE:59204] [RE:59794] [DI:direct]

| ORF Name | NT ID | AA ID | NT LN | AA LN | Score | P-Value |
|---|---|---|---|---|---|---|
| AI7503000986_803137_f1_5 | 1432 | 5204 | 165 | 54 | | |

Description
NO-HIT

| ORF Name | NT ID | AA ID | NT LN | AA LN | Score | P-Value |
|---|---|---|---|---|---|---|
| AI7503000986_804837_f1_59 | 1433 | 5205 | 963 | 320 | 342 | 4.3e−31 |

Description
gp:[GI:e327689:g2407930] [LN:LLPFLDB13] [AC:AJ000326] [GN:orfA] [FN:putative membrane protein] [OR:*Lactococcus lactis*] [DB:genpept-bct1] [DE:*Lactococcus lactis* pfl gene (strain DB1341).] [LE:464] [RE:1381] [DI:direct]

| ORF Name | NT ID | AA ID | NT LN | AA LN | Score | P-Value |
|---|---|---|---|---|---|---|
| AI7503000986_814838_c1_208 | 1434 | 5206 | 660 | 219 | 472 | 7.1e−45 |

Description
pir:[LN:D69821] [AC:D69821] [PN:hypothetical protein yhbJ] [GN:yhbJ] [OR:*Bacillus subtilis*] [DB:pir2] >gp:[GI:e1182889:g2633223] [LN:BSUB0005] [AC:Z99108:AL009126] [GN:yhbJ] [FN:unknown] [OR:*Bacillus subtilis*] [DB:genpept-bct1] [DE:*Bacillus subtilis* complete genome (section 5 of 21): from 802821 to1011250.] [LE:173758] [RE:174423] [DI:direct]

| ORF Name | NT ID | AA ID | NT LN | AA LN | Score | P-Value |
|---|---|---|---|---|---|---|
| AI7503000986_837578_c3_326 | 1435 | 5207 | 1233 | 410 | 708 | 7.0e−70 |

-continued

Description
pir:[LN:D70179] [AC:D70179] [PN:Na+/H+ antiporter (nhaC-1) homolog]
[OR:*Borrelia burgdorferi*] [SR:, Lyme disease spirochete] [DB:pir2]
>gp:[GI:g2688567] [LN:AE001165] [AC:AE001165:AE000783] [PN:Na+/H+ antiporter
(nhaC-1)] [GN:BB0637] [OR:*Borrelia burgdorferi*] [SR:Lyme disease spirochete]
[DB:genpept-bct2] [DE:*Borrelia burgdorferi* (section 51 of 70) of the
complete genome.] [NT:similar to GB:M73530 SP:P27611 PID:143245] [LE:6377]
[RE:7726] [DI:direct]

| ORF Name | NT ID | AA ID | NT LN | AA LN | Score | P-Value |
| --- | --- | --- | --- | --- | --- | --- |
| AI7503000986_8568_c3_289 | 1436 | 5208 | 429 | 142 | 73 | 0.017 |

Description
gp:[GI:g4151243] [LN:AF063590] [AC:AF063590] [PN:microcin E492 immunity
protein] [GN:mceB] [OR:*Klebsiella pneumoniae*] [DB:genpept-bct2]
[DE:*Klebsiella pneumoniae* microcin E492 precursor (mceA) and microcinE492
immunity protein (mceB) genes, complete cds.] [NT:overlapping with mceA]
[LE:541] [RE:828] [DI:complement]

| ORF Name | NT ID | AA ID | NT LN | AA LN | Score | P-Value |
| --- | --- | --- | --- | --- | --- | --- |
| AI7503000986_901515_c3_318 | 1437 | 5209 | 285 | 94 | 81 | 0.0019 |

Description
gp:[GI:g4731215] [LN:BMMITOCH03] [AC:AF110612] [PN:cytochrome b apoenzyme]
[GN:Cytb] [OR:*Mitochondrion Boophilus microplus*] [SR:southern cattle tick]
[DB:genpept-inv2] [DE:*Boophilus microplus* cytochrome b apoenzyme (Cytb)
gene, partialcds; tRNA-Ser, tRNA-Leu, tRNA-Cys, and tRNA-Met genes,
completesequence; and NADH dehydrogenase subunit 2 (ND2) gene, partial
cds,mitochondrial genes for mitochondrial products.] [LE:<1] [RE:285]
[DI:direct] >gp:[GI:g4731215] [LN:BMMITOCH03] [AC:AF110612] [PN:cytochrome b
apoenzyme] [GN:Cytb] [OR:*Mitochondrion Boophilus microplus*] [SR:southern
cattle tick] [DB:genpept] [DE:*Boophilus microplus* cytochrome b apoenzyme
(Cytb) gene, partialcds; tRNA-Ser, tRNA-Leu, tRNA-Cys, and tRNA-Met genes,
completesequence; and NADH dehydrogenase subunit 2 (ND2) gene, partial
cds,mitochondrial genes for mitochondrial products.] [LE:<1] [RE:285]
[DI:direct]

| ORF Name | NT ID | AA ID | NT LN | AA LN | Score | P-Value |
| --- | --- | --- | --- | --- | --- | --- |
| AI7503000986_968751_f2_63 | 1438 | 5210 | 123 | 40 | | |

Description
NO-HIT

| ORF Name | NT ID | AA ID | NT LN | AA LN | Score | P-Value |
| --- | --- | --- | --- | --- | --- | --- |
| AI7503000986_975261_f3_149 | 1439 | 5211 | 168 | 55 | 60 | 0.022 |

Description
sp:[LN:YC36_GUITH] [AC:O78501] [GN:YCF36] [OR:*GUILLARDIA THETA*]
[SR:,*CRYPTOMONAS PHI*] [DE:HYPOTHETICAL 18.4 KD PROTEIN YCF36] [SP:O78501]
[DB:swissprot] >gp:[GI:g3603031] [LN:AF041468]
[AC:AF041468:X14171:X62349:X51511:X14504:X52158:X52912:X56806:M7654 7]
[PN:hypothetical chloroplast RF36] [GN:ycf36] [OR:Chloroplast *Guillardia
theta*] [SR:*Guillardia theta*] [DB:genpept-pln2] [DE:*Guillardia theta* complete
plastid genome.] [LE:88514] [RE:88981] [DI:direct]

| ORF Name | NT ID | AA ID | NT LN | AA LN | Score | P-Value |
| --- | --- | --- | --- | --- | --- | --- |
| AI7503000986_9797911_f3_139 | 1440 | 5212 | 126 | 41 | | |

Description
NO-HIT

| ORF Name | NT ID | AA ID | NT LN | AA LN | Score | P-Value |
| --- | --- | --- | --- | --- | --- | --- |
| AI7503000986_984628_f2_65 | 1441 | 5213 | 132 | 43 | | |

Description
NO-HIT

| ORF Name | NT ID | AA ID | NT LN | AA LN | Score | P-Value |
| --- | --- | --- | --- | --- | --- | --- |
| AI7503000986_990952_f3_155 | 1442 | 5214 | 1209 | 402 | 744 | 1.1e−73 |

Description
gp:[GI:d1042605:g5103194] [LN:AP000342] [AC:AP000342] [GN:ydhA] [OR:Plasmid -continued R100] [SR:Plasmid R100 (lab_host:*Escherichia coli* strain K-12) DNA]
[DB:genpept] [DE:Plasmid R100 genomic DNA.] [NT:58% identical (1 gap) to 376
residues of 404 aa] [LE:37813] [RE:39018] [DI:complement]

| ORF Name | NT ID | AA ID | NT LN | AA LN | Score | P-Value |
|---|---|---|---|---|---|---|
| AI7503000986_9944132_f1_20 | 1443 | 5215 | 189 | 62 | | |

Description
NO-HIT

| ORF Name | NT ID | AA ID | NT LN | AA LN | Score | P-Value |
|---|---|---|---|---|---|---|
| AI7503000987_10188258_f1_158 | 1444 | 5216 | 129 | 42 | | |

Description
NO-HIT

| ORF Name | NT ID | AA ID | NT LN | AA LN | Score | P-Value |
|---|---|---|---|---|---|---|
| AI7503000987_10547152_f1_153 | 1445 | 5217 | 144 | 47 | | |

Description
NO-HIT

| ORF Name | NT ID | AA ID | NT LN | AA LN | Score | P-Value |
|---|---|---|---|---|---|---|
| AI7503000987_10662763_c2_764 | 1446 | 5218 | 1089 | 362 | 688 | 9.2e−68 |

Description
sp:[LN:YACL_BACSU] [AC:Q06754] [GN:YACL] [OR:*BACILLUS SUBTILIS*]
[DE:HYPOTHETICAL 40.9 KD PROTEIN IN MECB-GLTX INTERGENIC REGION] [SP:Q06754]
[DB:swissprot] >pir:[LN:S66118] [AC:S66118:D69741] [PN:conserved
hypothetical protein yacL] [GN:yacL] [CL:conserved hypothetical protein
yacL] [OR:*Bacillus subtilis*] [DB:pir2] >gp:[GI:d1005865:g467477]
[LN:BAC180K] [AC:D26185] [PN:unknown] [OR:*Bacillus subtilis*] [SR:*Bacillus
subtilis* (sub_species:Marburg, strain:168) DNA] [DB:genpept-bct1] [DE:*B.
subtilis* DNA, 180 kilobase region of replication origin.] [LE:172273]
[RE:173373] [DI:direct] >gp:[GI:e1182022:g2632356] [LN:BSUB0001]
[AC:Z99104:AL009126] [GN:yacL] [FN:unknown] [OR:*Bacillus subtilis*]
[DB:genpept-bct1] [DE:*Bacillus subtilis* complete genome (section 1 of 21):
from 1 to213080.] [NT:similar to hypothetical proteins] [SP:Q06754]
[LE:108671] [RE:109771] [DI:direct]

| ORF Name | NT ID | AA ID | NT LN | AA LN | Score | P-Value |
|---|---|---|---|---|---|---|
| AI7503000987_10667002_c1_690 | 1447 | 5219 | 207 | 68 | | |

Description
NO-HIT

| ORF Name | NT ID | AA ID | NT LN | AA LN | Score | P-Value |
|---|---|---|---|---|---|---|
| AI7503000987_10734838_c2_819 | 1448 | 5220 | 996 | 331 | 397 | 6.3e−37 |

Description
sp:[LN:ER19_YEAST] [AC:P32377] [GN:ERG19:MVD1:MPD:YNR043W:N3427]
[OR:*SACCHAROMYCES CEREVISIAE*] [SR:,BAKER'S YEAST] [EC:4.1.1.33]
[DE:*PYROPHOSPHATE DECARBOXYLASE*)] [SP:P32377] [DB:swissprot]
>pir:[LN:S63374] [AC:S63374:S20057] [PN:diphosphomevalonate
decarboxylase,:protein N3427:protein YNR043w] [GN:MVD1:ERG19:MPD]
[OR:*Saccharomyces cerevisiae*] [EC:4.1.1.33] [DB:pir2] [MP:14R]
>gp:[GI:e238625:g1292890] [LN:SCERG19] [AC:X97557] [PN:diphosphomevalonate
decarboxylase] [GN:ERG19] [OR:*Saccharomyces cerevisiae*] [SR:baker's yeast]
[DB:genpept-pln1] [EC:4.1.1.33] [DE:*S.cerevisiae* ERG19 gene.] [SP:P32377]
[LE:544] [RE:1734] [DI:direct] >gp:[GI:e239591:g1302550] [LN:SCYNR043W]
[AC:Z71658:Y13139] [GN:MVD1] [OR:*Saccharomyces cerevisiae*] [SR:baker's
yeast] [DB:genpept-pln1] [DE:*S.cerevisiae* chromosome XIV reading frame ORF
YNR043w.] [NT:ORF YNR043w] [SP:P32377] [LE:229] [RE:1419] [DI:direct]

| ORF Name | NT ID | AA ID | NT LN | AA LN | Score | P-Value |
|---|---|---|---|---|---|---|
| AI7503000987_10735832_c1_722 | 1449 | 5221 | 273 | 90 | 67 | 0.0041 |

Description
pir:[LN:E71854] [AC:E71854] [PN:hypothetical protein jhp1053] [GN:jhp1053]
[OR:*Helicobacter pylori*] [SR:strain J99, , strain J99] [SR:strain J99,]
[DB:pir2] >gp:[GI:g4155644] [LN:AE001533] [AC:AE001533:AE001439]
[PN:putative] [GN:jhp1053] [OR:*Helicobacter pylori* J99] [DB:genpept-bct2]

-continued

[DE:*Helicobacter pylori*, strain J99 section 94 of 132 of the completegenome.] [NT:similar to *H. pylori* 26695 gene HP1124] [LE:5370] [RE:6365] [DI:complement]

| ORF Name | NT ID | AA ID | NT LN | AA LN | Score | P-Value |
|---|---|---|---|---|---|---|
| AI7503000987_10928_c2_757 | 1450 | 5222 | 1242 | 413 | 230 | 1.2e−16 |

Description
pir:[LN:T03492] [AC:T03492] [PN:hypothetical protein] [OR:*Rhodobacter capsulatus*] [DB:pir2] [MP:1] >gp:[GI:g3128293] [LN:AF010496] [AC:AF010496] [PN:hypothetical protein] [OR:*Rhodobacter capsulatus*] [DB:genpept-bct2] [DE:*Rhodobacter capsulatus* strain SB1003, partial genome.] [LE:54291] [RE:55613] [DI:complement]

| ORF Name | NT ID | AA ID | NT LN | AA LN | Score | P-Value |
|---|---|---|---|---|---|---|
| AI7503000987_110766_f1_13 | 1451 | 5223 | 132 | 43 | | |

Description
NO-HIT

| ORF Name | NT ID | AA ID | NT LN | AA LN | Score | P-Value |
|---|---|---|---|---|---|---|
| AI7503000987_117893_c3_957 | 1452 | 5224 | 426 | 141 | | |

Description
NO-HIT

| ORF Name | NT ID | AA ID | NT LN | AA LN | Score | P-Value |
|---|---|---|---|---|---|---|
| AI7503000987_11894032_c3_930 | 1453 | 5225 | 126 | 41 | | |

Description
NO-HIT

| ORF Name | NT ID | AA ID | NT LN | AA LN | Score | P-Value |
|---|---|---|---|---|---|---|
| AI7503000987_12267167_c2_786 | 1454 | 5226 | 135 | 44 | | |

Description
NO-HIT

| ORF Name | NT ID | AA ID | NT LN | AA LN | Score | P-Value |
|---|---|---|---|---|---|---|
| AI7503000987_1227250_f3_539 | 1455 | 5227 | 996 | 331 | 562 | 2.1e−54 |

Description
sp:[LN:YXEI_BACSU] [AC:P54948] [GN:YXEI:LP9A] [OR:*BACILLUS SUBTILIS*] [DE:HYPOTHETICAL 37.2 KD PROTEIN IN IDH-DEOR INTERGENIC REGION] [SP:P54948] [DB:swissprot] >pir:[LN:C70075] [AC:C70075] [PN:penicillin amidase homolog yxeI] [GN:yxeI] [CL:*choloylglycine hydrolase*] [OR:*Bacillus subtilis*] [DB:pir2] >gp:[GI:e1184679:g2636500] [LN:BSUB0021] [AC:Z99124:AL009126] [GN:yxeI] [FN:unknown] [OR:*Bacillus subtilis*] [DB:genpept-bct1] [DE:*Bacillus subtilis* complete genome (section 21 of 21): from 3999281to 4214814.] [NT:similar to penicillin amidase] [SP:P54948] [LE:62053] [RE:63039] [DI:complement] >gp:[GI:d1008921:g1408494] [LN:D45912] [AC:D45912] [GN:yxeI] [OR:*Bacillus subtilis*] [SR:*Bacillus subtilis* (strain:BGSC 1A1 (Marburg 168; trpC2)) DNA] [DB:genpept-bct1] [DE:*Bacillus subtilis* genome sequence between the iol and hut operon,partial and complete cds.] [NT:homologous to penicillin acylase] [LE:8437] [RE:9423] [DI:direct]

| ORF Name | NT ID | AA ID | NT LN | AA LN | Score | P-Value |
|---|---|---|---|---|---|---|
| AI7503000987_12516511_c2_813 | 1456 | 5228 | 129 | 42 | 164 | 4.7e−12 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, completecds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000987_12601637_c3_898 | 1457 | 5229 | 144 | 47 | 76 | 0.0065 |

Description
pir:[LN:B70148] [AC:B70148] [PN:ribosomal protein S12] [GN:BB0387:rpsL] [CL:*Escherichia coli* ribosomal protein S12] [OR:*Borrelia burgdorferi*] [SR:, -continued Lyme disease spirochete] [DB:pir2] >gp:[GI:g2688295] [LN:AE001144]
[AC:AE001144:AE000783] [PN:ribosomal protein S12 (rpsL)] [GN:BB0387]
[OR:*Borrelia burgdorferi*] [SR:Lyme disease spirochete] [DB:genpept-bct2]
[DE:*Borrelia burgdorferi* (section 30 of 70) of the complete genome.]
[NT:similar to SP:P18662 percent identity: 79.03;] [LE:1809] [RE:2183]
[DI:complement]

| ORF Name | NT ID | AA ID | NT LN | AA LN | Score | P-Value |
|---|---|---|---|---|---|---|
| AI7503000987_12714833_c2_863 | 1458 | 5230 | 1218 | 405 | 95 | 0.021 |

Description
pir:[LN:S72278] [AC:S72278:S78483] [PN:ATP-dependent Clp proteinase,
homolog] [GN:clpC] [OR:plastid *Plasmodium falciparum*] [EC:3.4.21.-]
[DB:pir2]

| ORF Name | NT ID | AA ID | NT LN | AA LN | Score | P-Value |
|---|---|---|---|---|---|---|
| AI7503000987_12902217_f2_349 | 1459 | 5231 | 681 | 226 | 292 | 8.5e−26 |

Description
pir:[LN:D69906] [AC:D69906] [PN:hypothetical protein yojG] [GN:yojG]
[OR:*Bacillus subtilis*] [DB:pir2] >gp:[GI:e1185418:g2634339] [LN:BSUB0011]
[AC:Z99114:AL009126] [GN:yojG] [FN:unknown] [OR:*Bacillus subtilis*]
[DB:genpept-bct1] [DE:*Bacillus subtilis* complete genome (section 11 of 21):
from 2000171to 2207900.] [LE:120715] [RE:121143] [DI:complement]
>gp:[GI:g3169323] [LN:AF026147] [AC:AF026147] [PN:YojG] [GN:yojG]
[FN:unknown] [OR:*Bacillus subtilis*] [DB:genpept-bct2] [DE:*Bacillus subtilis*
YojA (yojA), YojB (yojB), YojC (yojC), YojD(yojD), YojE (yojE), YojF (yojF),
YojG (yojG), YojH (yojH), YojI(yojI), YojJ (yojJ), YojK (yojK), YojL (yojL),
YojM (yojM), YojN(yojN), and YojO (yojO) genes, complete cds; and OdhA
(odhA) gene,partial cds.] [LE:4122] [RE:4550] [DI:direct]

| ORF Name | NT ID | AA ID | NT LN | AA LN | Score | P-Value |
|---|---|---|---|---|---|---|
| AI7503000987_12932802_f1_115 | 1460 | 5232 | 126 | 41 | | |

Description
NO-HIT

| ORF Name | NT ID | AA ID | NT LN | AA LN | Score | P-Value |
|---|---|---|---|---|---|---|
| AI7503000987_134702_f1_113 | 1461 | 5233 | 834 | 277 | 673 | 3.6e−66 |

Description
sp:[LN:THID_BACSU] [AC:P39610] [GN:THID:IPA-52R] [OR:*BACILLUS SUBTILIS*]
[EC:2.7.4.7] [DE:(HMP-P KINASE)] [SP:P39610] [DB:swissprot] >pir:[LN:S39707]
[AC:S39707:F69722] [PN:phosphomethylpyrimidine kinase thiD:protein ipa-52r]
[GN:thiD] [CL:phosphomethylpyrimidine phosphate kinase] [OR:*Bacillus
subtilis*] [DB:pir2] >gp:[GI:g413976] [LN:BSGENR] [AC:X73124] [GN:ipa-52r]
[OR:*Bacillus subtilis*] [DB:genpept-bct1] [DE:*B.subtilis* genomic region (325
to 333).] [SP:P39610] [LE:55788] [RE:56603] [DI:complement]
>gp:[GI:e1186301:g2636337] [LN:BSUB0020] [AC:Z99123:AL009126]
[PN:phosphomethylpyrimidine kinase] [GN:thiD] [FN:thiamin biosynthesis]
[OR:*Bacillus subtilis*] [DB:genpept-bct1] [EC:2.7.4.7] [DE:*Bacillus subtilis*
complete genome (section 20 of 21): from 3798401to 4010550.] [NT:alternate
gene name: ywdB, ipa-52r] [SP:P39610] [LE:101359] [RE:102174] [DI:direct]

| ORF Name | NT ID | AA ID | NT LN | AA LN | Score | P-Value |
|---|---|---|---|---|---|---|
| AI7503000987_13695125_c2_771 | 1462 | 5234 | 603 | 200 | 117 | 9.1e−06 |

Description
gp:[GI:g3025463] [LN:CAU58131] [AC:U58131] [PN:SigX] [GN:sigX]
[OR:*Clostridium acetobutylicum*] [DB:genpept-bct2] [DE:*Clostridium
acetobutylicum* pho-sigX gene region, phoP, phoR, sigX,orf36, and orf18
genes, complete cds.] [NT:proposed ECF subfamily RNA polymerase sigmafactor]
[LE:3293] [RE:3847] [DI:direct]

| ORF Name | NT ID | AA ID | NT LN | AA LN | Score | P-Value |
|---|---|---|---|---|---|---|
| AI7503000987_1379061_c3_991 | 1463 | 5235 | 153 | 50 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987__13835930__c3__950 | 1464 | 5236 | 276 | 91 | | |

Description
NO-HIT

| ORF Name | NT ID | AA ID | NT LN | AA LN | Score | P-Value |
|---|---|---|---|---|---|---|
| AI7503000987__13876005__c1__677 | 1465 | 5237 | 339 | 112 | | |

Description
NO-HIT

| ORF Name | NT ID | AA ID | NT LN | AA LN | Score | P-Value |
|---|---|---|---|---|---|---|
| AI7503000987__14254437__c3__903 | 1466 | 5238 | 123 | 40 | | |

Description
NO-HIT

| ORF Name | NT ID | AA ID | NT LN | AA LN | Score | P-Value |
|---|---|---|---|---|---|---|
| AI7503000987__14460882__f1__107 | 1467 | 5239 | 177 | 58 | 236 | 7.3e−20 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, completecds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000987__14501556__f2__325 | 1468 | 5240 | 171 | 56 | | |

Description
NO-HIT

| ORF Name | NT ID | AA ID | NT LN | AA LN | Score | P-Value |
|---|---|---|---|---|---|---|
| AI7503000987__14537578__c2__763 | 1469 | 5241 | 147 | 48 | | |

Description
NO-HIT

| ORF Name | NT ID | AA ID | NT LN | AA LN | Score | P-Value |
|---|---|---|---|---|---|---|
| AI7503000987__14547143__c3__912 | 1470 | 5242 | 522 | 173 | 501 | 6.0e−48 |

Description
sp:[LN:YAAJ__BACSU] [AC:P21335] [GN:YAAJ] [OR:*BACILLUS SUBTILIS*] [DE:HYPOTHETICAL 17.8 KD PROTEIN IN SERS-DNAH INTERGENIC REGION] [SP:P21335] [DB:swissprot] >pir:[LN:S11690] [AC:S11690:S66048:B69737] [PN:conserved hypothetical protein yaaJ] [GN:yaaJ] [CL:hypothetical protein Yaaj] [OR:*Bacillus subtilis*] [DB:pir2] >gp:[GI:d1005796:g467408] [LN:BAC180K] [AC:D26185] [PN:unknown] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:89452] [RE:89937] [DI:direct] >gp:[GI:g40011] [LN:BSORF17] [AC:X52144] [OR:*Bacillus subtilis*] [DB:genpept-bct1] [DE:*Bacillus subtilis* DNA for ORF17, small cytoplasmic RNA and partialdnaX gene.] [NT:ORF17 (AA 1–161)] [SP:P21335] [LE:129] [RE:614] [DI:direct] >gp:[GI:e1181951:g2632285] [LN:BSUB0001] [AC:Z99104:AL009126] [GN:yaaJ] [FN:unknown] [OR:*Bacillus subtilis*] [DB:genpept-bct1] [DE:*Bacillus subtilis* complete genome (section 1 of 21): from 1 to213080.] [NT:similar to hypothetical proteins] [SP:P21335] [LE:25850] [RE:26335] [DI:direct]

| ORF Name | NT ID | AA ID | NT LN | AA LN | Score | P-Value |
|---|---|---|---|---|---|---|
| AI7503000987__14587817__f3__520 | 1471 | 5243 | 528 | 175 | | |

Description
NO-HIT

| ORF Name | NT ID | AA ID | NT LN | AA LN | Score | P-Value |
|---|---|---|---|---|---|---|
| AI7503000987__14647510__f1__27 | 1472 | 5244 | 255 | 84 | | |

Description
NO-HIT

-continued

| ORF Name | NT ID | AA ID | NT LN | AA LN | Score | P-Value |
|---|---|---|---|---|---|---|
| AI7503000987_14879688_c1_704 | 1473 | 5245 | 927 | 308 | 234 | 5.1e−26 |

Description
pir:[LN:A71042] [AC:A71042] [PN:probable mevalonate kinase] [GN:PH1625]
[OR:*Pyrococcus horikoshii*] [DB:pir2] >gp:[GI:d1031680:g3258054]
[LN:AP000006]
[AC:AP000006:AB005215:AB009510:AB009511:AB009512:AB009513:AB009514]
[PN:335aa long hypothetical mevalonate kinase] [GN:PH1625] [OR:*Pyrococcus horikoshii*] [SR:*Pyrococcus horikoshii* (strain:OT3) DNA, clone:*Pyrococcus horikoshii*] [DB:genpept-bct1] [DE:*Pyrococcus horikoshii* OT3 genomic DNA, 1166001–1485000 nt. position(6/7).] [NT:similar to owl:MTU47134 percent identity: 41.993 in] [LE:275590] [RE:276597] [DI:complement]

| ORF Name | NT ID | AA ID | NT LN | AA LN | Score | P-Value |
|---|---|---|---|---|---|---|
| AI7503000987_14882681_c1_717 | 1474 | 5246 | 210 | 69 | 99 | 2.4e−05 |

Description
gp:[GI:g2897106] [LN:AF020798] [AC:AF020798] [PN:repressor]
[OR:*Streptococcus thermophilus bacteriophage* TP-J34] [DB:genpept-phg]
[DE:*Streptococcus thermophilus bacteriophage* lysogeny module,
integrasehomolog (int), putative host cell surface-exposed
lipoprotein,putative metallo-proteinase, repressor, Cro-like
regulatoryprotein, and P1-antirepressor homolog genes, complete cds.]
[NT:CI-like regulatory protein; orf121] [LE:4825] [RE:5190] [DI:complement]

| ORF Name | NT ID | AA ID | NT LN | AA LN | Score | P-Value |
|---|---|---|---|---|---|---|
| AI7503000987_14885260_c2_839 | 1475 | 5247 | 441 | 146 | 209 | 5.3e−17 |

Description
gp:[GI:g2444132] [LN:U88974] [AC:U88974] [PN:ORF25] [OR:*Streptococcus thermophilus temperate bacteriophage* O1205] [DB:genpept-phg]
[DE:*Streptococcus thermophilus temperate bacteriophage* O1205,
completegenome.] [NT:putative small subunit of the terminase] [LE:13835]
[RE:14329] [DI:direct]

| ORF Name | NT ID | AA ID | NT LN | AA LN | Score | P-Value |
|---|---|---|---|---|---|---|
| AI7503000987_15735181_f3_451 | 1476 | 5248 | 204 | 67 | | |

Description
NO-HIT

| ORF Name | NT ID | AA ID | NT LN | AA LN | Score | P-Value |
|---|---|---|---|---|---|---|
| AI7503000987_15782160_c3_905 | 1477 | 5249 | 747 | 248 | 469 | 1.5e−44 |

Description
gp:[GI:g1458327] [LN:CELF08F3] [AC:U64847] [GN:F08F3.4] [OR:*Caenorhabditis elegans*] [SR:*Caenorhabditis elegans* strain=Bristol N2] [DB:genpept-inv1]
[DE:*Caenorhabditis elegans* cosmid F08F3.] [LE:1515:1817:2044:2841]
[RE:1758:1994:2276:3110] [DI:directJoin]

| ORF Name | NT ID | AA ID | NT LN | AA LN | Score | P-Value |
|---|---|---|---|---|---|---|
| AI7503000987_15892932_c3_902 | 1478 | 5250 | 129 | 42 | | |

Description
NO-HIT

| ORF Name | NT ID | AA ID | NT LN | AA LN | Score | P-Value |
|---|---|---|---|---|---|---|
| AI7503000987_16054827_c3_959 | 1479 | 5251 | 357 | 118 | 184 | 2.4e−14 |

Description
pir:[LN:T00183] [AC:T00183] [PN:hypothetical protein 50] [OR:*Staphylococcus aureus phage phi* PVL] [DB:pir3] >gp:[GI:d1032884:g3341957] [LN:AB009866]
[AC:AB009866] [OR:*bacteriophage phi* PVL] [SR:*bacteriophage phi* PVL
(specific_host:*Staphylococcus aureus* ATC] [DB:genpept-phg] [DE:*Bacteriophage phi* PVL proviral DNA, complete sequence.] [NT:orf 50] [LE:36701] [RE:37069]
[DI:direct]

| ORF Name | NT ID | AA ID | NT LN | AA LN | Score | P-Value |
|---|---|---|---|---|---|---|
| AI7503000987_16212803_c2_844 | 1480 | 5252 | 318 | 105 | 124 | 5.4e−08 |

-continued

Description
pir:[LN:S58144] [AC:S58144] [PN:gene 15 protein] [OR:phage SPP1] [DB:pir2]
>gp:[GI:e244843:g2764862] [LN:BSPP1GENM] [AC:X97918] [OR:*Bacteriophage* SPP1]
[DB:genpept-phg] [DE:*Bacteriophage* SPP1 complete nucleotide sequence.]
[NT:gene 15] [LE:9012] [RE:9320] [DI:direct] >gp:[GI:g1052813]
[LN:SPP1HEADG] [AC:X89721] [GN:15] [OR:*Bacteriophage* SPP1] [DB:genpept-phg]
[DE:*Bacteriophage* SPP1 head morphogenesis genes 7 to 15.] [NT:product
required for head morphogenesis] [LE:5788] [RE:6096] [DI:direct]

| ORF Name | NT ID | AA ID | NT LN | AA LN | Score | P-Value |
| --- | --- | --- | --- | --- | --- | --- |
| AI7503000987__16413130__f1__128 | 1481 | 5253 | 246 | 81 | 146 | 1.8e−08 |

Description
gp:[GI:g3929312] [LN:AF100426] [AC:AF100426] [PN:fimbriae-associated protein
Fap1] [GN:fap1] [OR:*Streptococcus parasanguinis*] [DB:genpept-bct2]
[DE:*Streptococcus parasanguis* fimbriae-associated protein Fap1 (fap1)gene,
complete cds.] [NT:invovled in fimbriae assembly and fimbriae-mediated]
[LE:284] [RE:7996] [DI:direct]

| ORF Name | NT ID | AA ID | NT LN | AA LN | Score | P-Value |
| --- | --- | --- | --- | --- | --- | --- |
| AI7503000987__16603427__c2__861 | 1482 | 5254 | 531 | 176 | | |

Description
NO-HIT

| ORF Name | NT ID | AA ID | NT LN | AA LN | Score | P-Value |
| --- | --- | --- | --- | --- | --- | --- |
| AI7503000987__16681687__c1__635 | 1483 | 5255 | 1029 | 342 | 694 | 2.1e−68 |

Description
sp:[LN:YACI_BACSU] [AC:P37570] [GN:YACI] [OR:*BACILLUS SUBTILIS*]
[DE:HYPOTHETICAL 41.1 KD PROTEIN IN LYSS-MECB INTERGENIC REGION (ORFX)]
[SP:P37570] [DB:swissprot] >pir:[LN:S66114] [AC:S66114:I40507:B69741]
[PN:creatine kinase homolog yacI] [GN:yacI] [OR:*Bacillus subtilis*]
[DB:pir2] >gp:[GI:d1005861:g467473] [LN:BAC180K] [AC:D26185] [PN:unknown]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:166083] [RE:167174] [DI:direct]
>gp:[GI:e1182018:g2632352] [LN:BSUB0001] [AC:Z99104:AL009126] [GN:yacI]
[FN:unknown] [OR:*Bacillus subtilis*] [DB:genpept-bct1] [DE:*Bacillus subtilis*
complete genome (section 1 of 21): from 1 to213080.] [NT:similar to creatine
kinase] [SP:P37570] [LE:102481] [RE:103572] [DI:direct]

| ORF Name | NT ID | AA ID | NT LN | AA LN | Score | P-Value |
| --- | --- | --- | --- | --- | --- | --- |
| AI7503000987__16798777__c1__646 | 1484 | 5256 | 3558 | 1185 | 5906 | 0.0 |

Description
sp:[LN:RPOB_STAAU] [AC:P47768] [GN:RPOB] [OR:*STAPHYLOCOCCUS AUREUS*]
[EC:2.7.7.6] [DE:BETA CHAIN] (RNA POLYMERASE BETA SUBUNIT)] [SP:P47768]
[DB:swissprot] >pir:[LN:S59951] [AC:S59951] [PN:DNA-directed RNA
polymerase, beta chain] [GN:rpoB] [CL:DNA-directed RNA polymerase beta
chain] [OR:*Staphylococcus aureus*] [EC:2.7.7.6] [DB:pir2] >gp:[GI:g677851]
[LN:SARPLRPO] [AC:X64172] [PN:DNA-directed RNA polymerase beta chain]
[GN:rpoB] [OR:*Staphylococcus aureus*] [DB:genpept-bct1] [EC:2.7.7.6]
[DE:*S.aureus* rplL, orf202, rpoB(rif) and rpoC genes for ribosomalprotein
L7/L12, hypothetical protein ORF202, DNA-directed RNApolymerase beta & beta'
chains.] [SP:P47768] [LE:1222] [RE:4770] [DI:direct]

| ORF Name | NT ID | AA ID | NT LN | AA LN | Score | P-Value |
| --- | --- | --- | --- | --- | --- | --- |
| AI7503000987__16972575__f1__196 | 1485 | 5257 | 186 | 61 | 76 | 0.036 |

Description
gp:[GI:g4580755] [LN:AF061085] [AC:AF061085] [PN:P-glycoprotein]
[OR:*Gossypium herbaceum*] [DB:genpept-pln2] [DE:*Gossypium herbaceum*
P-glycoprotein gene, partial cds.] [NT:similar to P-glycoprotein in *Hordeum
vulgare* and] [LE:<22] [RE:>894] [DI:direct]

| ORF Name | NT ID | AA ID | NT LN | AA LN | Score | P-Value |
| --- | --- | --- | --- | --- | --- | --- |
| AI7503000987__1702__f2__209 | 1486 | 5258 | 522 | 173 | 88 | 0.0089 |

Description
pir:[LN:T00168] [AC:T00168] [PN:hypothetical protein 33] [OR:*Staphylococcus
aureus phage phi* PVL] [DB:pir3] >gp:[GI:d1032869:g3341942] [LN:AB009866]
[AC:AB009866] [OR:*bacteriophage phi* PVL] [SR:*bacteriophage phi* PVL -continued (specific_host:*Staphylococcus aureus* ATC] [DB:genpept-phg] [DE:*Bacteriophage phi* PVL proviral DNA, complete sequence.] [NT:orf 33] [LE:28172] [RE:28582] [DI:complement]

| ORF Name | NT ID | AA ID | NT LN | AA LN | Score | P-Value |
|---|---|---|---|---|---|---|
| AI7503000987_19690876_c3_935 | 1487 | 5259 | 876 | 291 | 662 | 5.3e−65 |

Description
sp:[LN:YWFL_BACSU] [AC:P39648] [GN:YWFL:IPA-90D] [OR:*BACILLUS SUBTILIS*] [DE:HYPOTHETICAL 31.4 KD PROTEIN IN PTA 3'REGION] [SP:P39648] [DB:swissprot] >pir:[LN:S39745] [AC:S39745:D70056] [PN:ywfL protein:hypothetical protein ipa-90d] [GN:ywfL] [OR:*Bacillus subtilis*] [DB:pir2] >gp:[GI:g414014] [LN:BSGENR] [AC:X73124] [GN:ipa-90d] [OR:*Bacillus subtilis*] [DB:genpept-bct1] [DE:*B.subtilis* genomic region (325 to 333).] [SP:P39648] [LE:93300] [RE:94145] [DI:direct] >gp:[GI:e1186264:g2636300] [LN:BSUB0020] [AC:Z99123:AL009126] [GN:ywfL] [FN:unknown] [OR:*Bacillus subtilis*] [DB:genpept-bct1] [DE:*Bacillus subtilis* complete genome (section 20 of 21): from 3798401to 4010550.] [NT:alternate gene name: ipa-90d] [SP:P39648] [LE:63814] [RE:64659] [DI:complement]

| ORF Name | NT ID | AA ID | NT LN | AA LN | Score | P-Value |
|---|---|---|---|---|---|---|
| AI7503000987_19695386_c3_953 | 1488 | 5260 | 771 | 256 | 111 | 0.00059 |

Description
pir:[LN:T00180] [AC:T00180] [PN:hypothetical protein 46] [OR:*Staphylococcus aureus phage phi* PVL] [DB:pir3] >gp:[GI:d1032881:g3341954] [LN:AB009866] [AC:AB009866] [OR:*bacteriophage phi* PVL] [SR:*bacteriophage phi* PVL (specific_host:*Staphylococcus aureus* ATC] [DB:genpept-phg] [DE:*Bacteriophage phi* PVL proviral DNA, complete sequence.] [NT:orf 46] [LE:35157] [RE:36050] [DI:direct]

| ORF Name | NT ID | AA ID | NT LN | AA LN | Score | P-Value |
|---|---|---|---|---|---|---|
| AI7503000987_20078287_f3_533 | 1489 | 5261 | 825 | 274 | 145 | 2.5e−07 |

Description
pir:[LN:B70798] [AC:B70798] [PN:probable membrane protein] [GN:Rv3737] [OR:*Mycobacterium tuberculosis*] [DB:pir2] >gp:[GI:e1264597:g2960161] [LN:MTV025] [AC:AL022121:AL123456] [PN:hypothetical protein Rv3737] [GN:Rv3737] [OR:*Mycobacterium tuberculosis*] [DB:genpept-bct1] [DE:*Mycobacterium tuberculosis* H37Rv complete genome; segment 155/162.] [NT:Rv3737, (MTV025.085), len: 529. Probable membrane] [LE:94796] [RE:96385] [DI:direct] >gp:[GI:e1264597:g2960161] [LN:MTV025] [AC:AL022121:AL123456] [PN:hypothetical protein Rv3737] [GN:Rv3737] [OR:*Mycobacterium tuberculosis*] [DB:genpept] [DE:*Mycobacterium tuberculosis* H37Rv complete genome; segment 155/162.] [NT:Rv3737, (MTV025.085), len: 529. Probable membrane] [LE:94796] [RE:96385] [DI:direct]

| ORF Name | NT ID | AA ID | NT LN | AA LN | Score | P-Value |
|---|---|---|---|---|---|---|
| AI7503000987_20087752_f2_352 | 1490 | 5262 | 1506 | 501 | 397 | 2.5e−36 |

Description
sp:[LN:TAGE_BACSU] [AC:P13484] [GN:TAGE:RODD:GTAA] [OR:*BACILLUS SUBTILIS*] [EC:2.4.1.52] [DE:(EC 2.4.1.52) (TEICHOIC ACID BIOSYNTHESIS PROTEIN E)] [SP:P13484] [DB:swissprot] >pir:[LN:S06048] [AC:S06048:F69720] [PN:poly(glycerol-phosphate) alpha-glucosyltransferase, tagE:probable rodD protein:UDP-glucose--polyglycerol phosphate glucosyltransferase tagE] [GN:tagE:rodD] [OR:*Bacillus subtilis*] [EC: 2.4.1.52] [DB:pir2] [MP:310 degrees] >gp:[GI:g580920] [LN:BSRODC] [AC:X15200] [OR:*Bacillus subtilis*] [DB:genpept-bct1] [DE:*Bacillus subtilis* rodC operon.] [NT:rodD (gtaA) polypeptide (AA 1−673)] [SP:P13484] [LE:157] [RE:2178] [DI:direct] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:*Bacillus subtilis*] [DB:genpept-bct1] [EC:2.4.1.52] [DE:*Bacillus subtilis* complete genome (section 19 of 21): from 3597091to 3809700.] [NT:alternate gene name: rodD, gtaA, gtaD] [SP:P13484] [LE:80369] [RE:82390] [DI:complement] >gp:[GI:e1184479:g2636099] [LN:BSUB0019] [AC:Z99122:AL009126] [PN:UDP-glucose:polyglycerol phosphate] [GN:tagE] [FN:teichoic acid biosynthesis] [OR:*Bacillus subtilis*] [DB:genpept] [EC:2.4.1.52] [DE:*Bacillus subtilis* complete genome (section 19 of 21): from 3597091to 3809700.] [NT:alternate gene name: rodD, gtaA, gtaD] [SP:P13484] [LE:80369] [RE:82390] [DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987_20322153_c2_818 | 1491 | 5263 | 219 | 72 | | |

Description
NO-HIT

| ORF Name | NT ID | AA ID | NT LN | AA LN | Score | P-Value |
|---|---|---|---|---|---|---|
| AI7503000987_20331552_c1_659 | 1492 | 5264 | 996 | 331 | 447 | 3.2e−42 |

Description
pir:[LN:C69066] [AC:C69066] [PN:*ornithine cyclodeaminase*] [GN:MTH1495]
[OR:*Methanobacterium thermoautotrophicum*] [DB:pir2] >gp:[GI:g2622612]
[LN:AE000910] [AC:AE000910:AE000666] [PN:*ornithine cyclodeaminase*]
[GN:MTH1495] [OR:*Methanobacterium thermoautotrophicum*] [DB:genpept-bct2]
[DE:*Methanobacterium thermoautotrophicum* from bases 1349621 to
1362200 (section 116 of 148) of the complete genome.] [NT:Function Code:5.09-
L-Amino Acid Metabolism,] [LE:963] [RE:1982] [DI:complement]

| ORF Name | NT ID | AA ID | NT LN | AA LN | Score | P-Value |
|---|---|---|---|---|---|---|
| AI7503000987_20511590_c3_893 | 1493 | 5265 | 384 | 127 | 414 | 1.0e−38 |

Description
sp:[LN:RL7_MICLU] [AC:P02395] [GN:RPLL] [OR:*MICROCOCCUS LUTEUS*]
[SR:,*MICROCOCCUS LYSODEIKTICUS*] [DE:50S RIBOSOMAL PROTEIN L7/L12 (MA1/MA2)]
[SP:P02395] [DB:swissprot] >pir:[LN:R7MCML] [AC:A02771] [PN:ribosomal
protein L7/L12:ribosomal protein MA] [CL:*Escherichia coli* ribosomal protein
L12] [OR:*Micrococcus luteus*:*Micrococcus lysodeikticus*] [DB:pir1]

| ORF Name | NT ID | AA ID | NT LN | AA LN | Score | P-Value |
|---|---|---|---|---|---|---|
| AI7503000987_20756260_c1_729 | 1494 | 5266 | 408 | 135 | 184 | 2.4e−14 |

Description
pir:[LN:T00194] [AC:T00194] [PN:hypothetical protein 61] [OR:*Staphylococcus
aureus phage phi* PVL] [DB:pir3] >gp:[GI:d1032895:g3341968] [LN:AB009866]
[AC:AB009866] [OR:*bacteriophage phi* PVL] [SR:*bacteriophage phi* PVL
(specific_host:*Staphylococcus aureus* ATC] [DB:genpept-phg] [DE:*Bacteriophage
phi* PVL proviral DNA, complete sequence.] [NT:orf 61] [LE:39932] [RE:40402]
[DI:direct]

| ORF Name | NT ID | AA ID | NT LN | AA LN | Score | P-Value |
|---|---|---|---|---|---|---|
| AI7503000987_20980262_c2_762 | 1495 | 5267 | 2472 | 823 | 2959 | 0.0 |

Description
sp:[LN:MECB_BACSU] [AC:P37571] [GN:MECB:CLPC] [OR:*BACILLUS SUBTILIS*]
[DE:NEGATIVE REGULATOR OF GENETIC COMPETENCE MECB] [SP:P37571]
[DB:swissprot] >pir:[LN:I40508] [AC:I40508:S66115:I40385:H69600] [PN:class
III stress response-related ATPase clpC:adenosine triphosphatase
clpC:clpA/clpB protein homolog] [GN:clpC:mecB] [CL:ATP-dependent Clp
proteinase chain A] [OR:*Bacillus subtilis*] [DB:pir2]
>gp:[GI:d1005862:g467474] [LN:BAC180K] [AC:D26185] [PN:clpA/clpB family]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:167171] [RE:169603] [DI:direct] >gp:[GI:g442360]
[LN:BSU02604] [AC:U02604] [PN:ClpC adenosine triphosphatase] [GN:mecB]
[FN:competence gene repressor; required for cell] [OR:*Bacillus subtilis*]
[DB:genpept-bct1] [DE:*Bacillus subtilis* Marburg 168 ClpC adenosine
triphosphatase (mecB)gene, complete cds, orfX and orfY, partial cds.]
[LE:335] [RE:2767] [DI:direct] >gp:[GI:e1182019:g2632353] [LN:BSUB0001]
[AC:Z99104:AL009126] [PN:class III stress response-related ATPase] [GN:clpC]
[FN:negative regulator of late competence genes;] [OR:*Bacillus subtilis*]
[DB:genpept-bct1] [DE:*Bacillus subtilis* complete genome (section 1 of 21):
from 1 to213080.] [NT:alternate gene name: mecB] [SP:P37571] [LE:103569]
[RE:106001] [DI:direct]

| ORF Name | NT ID | AA ID | NT LN | AA LN | Score | P-Value |
|---|---|---|---|---|---|---|
| AI7503000987_2117202_c2_831 | 1496 | 5268 | 177 | 58 | | |

Description
NO-HIT

| ORF Name | NT ID | AA ID | NT LN | AA LN | Score | P-Value |
|---|---|---|---|---|---|---|
| AI7503000987_21484465_c2_848 | 1497 | 5269 | 516 | 171 | 98 | 0.019 |

Description

-continued gp:[GI:g3702331] [LN:ATAC005397] [AC:AC005397] [GN:T3F17.17] [OR:*Arabidopsis thaliana*] [SR:thale cress] [DB:genpept-pln2] [DE:*Arabidopsis thaliana* chromosome II BAC T3F17 genomic sequence,complete sequence.] [NT:hypothetical protein] [LE:52308:52593:52780:53023] [RE:52505:52691:52902:53157] [DI:directJoin]

| ORF Name | NT ID | AA ID | NT LN | AA LN | Score | P-Value |
|---|---|---|---|---|---|---|
| AI7503000987__21598838__f3__534 | 1498 | 5270 | 465 | 154 | 155 | 7.2e−11 |

Description
sp:[LN:YJJP__HAEIN] [AC:P44520] [GN:HI0108] [OR:*HAEMOPHILUS INFLUENZAE*] [DE:HYPOTHETICAL PROTEIN HI0108] [SP:P44520] [DB:swissprot] >pir:[LN:I64142] [AC:I64142] [PN:hypothetical protein HI0108] [OR:*Haemophilus influenzae*] [DB:pir2] >gp:[GI:g1573061] [LN:U32696] [AC:U32696:L42023] [PN:conserved hypothetical protein] [GN:HI0108] [OR:*Haemophilus influenzae* Rd] [DB:genpept-bct2] [DE:*Haemophilus influenzae* Rd section 11 of 163 of the complete genome.] [NT:similar to GB:U14003 SP:P39402 PID:537207 GB:U00096] [LE:4095] [RE:4988] [DI:direct]

| ORF Name | NT ID | AA ID | NT LN | AA LN | Score | P-Value |
|---|---|---|---|---|---|---|
| AI7503000987__21603777__f1__144 | 1499 | 5271 | 126 | 41 | | |

Description
NO-HIT

| ORF Name | NT ID | AA ID | NT LN | AA LN | Score | P-Value |
|---|---|---|---|---|---|---|
| AI7503000987__21758468__c3__992 | 1500 | 5272 | 489 | 162 | 123 | 6.9e−08 |

Description
pir:[LN:B70351] [AC:B70351] [PN:ribosomal-protein-alanine acetyltransferase] [GN:rimI] [CL:*Escherichia coli* peptide N-acetyltransferase rimI] [OR:*Aquifex aeolicus*] [DB:pir2] >gp:[GI:g2983204] [LN:AE000696] [AC:AE000696:AE000657] [PN:ribosomal-protein-alanine acetyltransferase] [GN:rimI] [OR:*Aquifex aeolicus*] [DB:genpept-bct2] [DE:*Aquifex aeolicus* section 28 of 109 of the complete genome.] [LE:3558] [RE:4022] [DI:complement]

| ORF Name | NT ID | AA ID | NT LN | AA LN | Score | P-Value |
|---|---|---|---|---|---|---|
| AI7503000987__22042128__f3__519 | 1501 | 5273 | 150 | 49 | | |

Description
NO-HIT

| ORF Name | NT ID | AA ID | NT LN | AA LN | Score | P-Value |
|---|---|---|---|---|---|---|
| AI7503000987__22069160__c1__652 | 1502 | 5274 | 393 | 130 | 623 | 7.1e−61 |

Description
sp:[LN:RS12__STAAU] [AC:P48942] [GN:RPSL] [OR:*STAPHYLOCOCCUS AUREUS*] [DE:30S RIBOSOMAL PROTEIN S12] [SP:P48942] [DB:swissprot] >gp:[GI:g706921] [LN:SAU20869] [AC:U20869] [PN:ribosomal protein S12] [GN:rpsL] [OR:*Staphylococcus aureus*] [DB genpept-bct2] [DE:*Staphylococcus aureus* ribosomal protein S12 (rpsL) gene, completecds, ribosomal protein S7 (rpsG) and ORF 1 genes, partial cds.] [LE:418] [RE:831] [DI:direct]

| ORF Name | NT ID | AA ID | NT LN | AA LN | Score | P-Value |
|---|---|---|---|---|---|---|
| AI7503000987__2211036__f2__414 | 1503 | 5275 | 174 | 57 | | |

Description
NO-HIT

| ORF Name | NT ID | AA ID | NT LN | AA LN | Score | P-Value |
|---|---|---|---|---|---|---|
| AI7503000987__22272200__c1__735 | 1504 | 5276 | 939 | 312 | | |

Description
NO-HIT

| ORF Name | NT ID | AA ID | NT LN | AA LN | Score | P-Value |
|---|---|---|---|---|---|---|
| AI7503000987__22400261__c2__843 | 1505 | 5277 | 834 | 277 | 634 | 4.9e−62 |

Description
gp:[GI:e139438:g1369939] [LN:BTP9011] [AC:X84706] [PN:major head protein]

-continued

[GN:mhp] [OR:*Bacteriophage* B1] [DB:genpept-phg] [DE:*Bacteriophage* TP901-1 genomic region.] [LE:360] [RE:1181] [DI:direct]

| ORF Name | NT ID | AA ID | NT LN | AA LN | Score | P-Value |
|---|---|---|---|---|---|---|
| AI7503000987__22539010_f3__603 | 1506 | 5278 | 129 | 42 | | |

Description
NO-HIT

| ORF Name | NT ID | AA ID | NT LN | AA LN | Score | P-Value |
|---|---|---|---|---|---|---|
| AI7503000987__22539186_f1__67 | 1507 | 5279 | 138 | 45 | | |

Description
NO-HIT

| ORF Name | NT ID | AA ID | NT LN | AA LN | Score | P-Value |
|---|---|---|---|---|---|---|
| AI7503000987__22689067_f1__205 | 1508 | 5280 | 1221 | 406 | 1218 | 6.3e−124 |

Description
sp:[LN:NUPC_BACSU] [AC:P39141] [GN:NUPC] [OR:*BACILLUS SUBTILIS*] [DE:PYRIMIDINE NUCLEOSIDE TRANSPORT PROTEIN] [SP:P39141] [DB:swissprot] >gp:[GI:d1008934:g1408507] [LN:D45912] [AC:D45912] [PN:pyrimidine nucleoside transport protein] [GN:mupC] [OR:*Bacillus subtilis*] [SR:*Bacillus subtilis* (strain:BGSC 1A1 (Marburg 168; trpC2)) DNA] [DB:genpept-bct1] [DE:*Bacillus subtilis* genome sequence between the iol and hut operon,partial and complete cds.] [LE:20443] [RE:21624] [DI:direct]

| ORF Name | NT ID | AA ID | NT LN | AA LN | Score | P-Value |
|---|---|---|---|---|---|---|
| AI7503000987__22694377_c2__776 | 1509 | 5281 | 741 | 246 | 762 | 1.3e−75 |

Description
pir:[LN:S59955] [AC:S59955] [PN:hypothetical protein 202] [CL:hypothetical protein MJ0882] [OR:*Staphylococcus aureus*] [DB:pir2] >gp:[GI:g677850] [LN:SARPLRPO] [AC:X64172] [PN:hypothetical protein] [GN:ORF202] [OR:*Staphylococcus aureus*] [DB:genpept-bct1] [DE:*S.aureus* rplL, orf202, rpoB(rif) and rpoC genes for ribosomalprotein L7/L12, hypothetical protein ORF202, DNA-directed RNApolymerase beta & beta' chains.] [LE:399] [RE:1007] [DI:direct]

| ORF Name | NT ID | AA ID | NT LN | AA LN | Score | P-Value |
|---|---|---|---|---|---|---|
| AI7503000987__22773302_c1__741 | 1510 | 5282 | 1803 | 600 | 1371 | 3.9e−140 |

Description
gp:[GI:e286568:g2764983] [LN:BP187PLYH] [AC:Y07740] [PN:cell wall hydrolase Ply187] [GN:ply187] [OR:*Staphylococcus phage* 187] [DB:genpept-phg] [DE:*Staphylococcus phage* 187 ply187 and hol187 genes.] [LE:222] [RE:2108] [DI:direct]

| ORF Name | NT ID | AA ID | NT LN | AA LN | Score | P-Value |
|---|---|---|---|---|---|---|
| AI7503000987__22790941_c2__847 | 1511 | 5283 | 543 | 180 | 143 | 5.2e−10 |

Description
gp:[GI:e244714:g2764866] [LN:BSPP1GENM] [AC:X97918] [OR:*Bacteriophage* SPP1] [DB:genpept-phg] [DE:*Bacteriophage* SPP1 complete nucleotide sequence.] [NT:gene 17.1] [LE:10481] [RE:11014] [DI:direct]

| ORF Name | NT ID | AA ID | NT LN | AA LN | Score | P-Value |
|---|---|---|---|---|---|---|
| AI7503000987__23442135_c1__685 | 1512 | 5284 | 675 | 224 | 156 | 7.9e−11 |

Description
pir:[LN:F71309] [AC:F71309] [PN:probable phosphoglycolate phosphatase (gph-2)] [GN:TP0554] [OR:*Treponema pallidum* subsp. *pallidum*] [SR:, *syphilis spirochete*] [DB:pir2] >gp:[GI:g3322848] [LN:AE001231] [AC:AE001231:AE000520] [PN:phosphoglycolate phosphatase (gph-2)] [GN:TP0554] [OR:*Treponema pallidum*] [DB:genpept-bct2] [DE:*Treponema pallidum* section 47 of 87 of the complete genome.] [NT:similar to GB:L42023 SP:P44755 PID:1004013] [LE:1483] [RE:2151] [DI:direct]

| ORF Name | NT ID | AA ID | NT LN | AA LN | Score | P-Value |
|---|---|---|---|---|---|---|
| AI7503000987__23469213_c2__838 | 1513 | 5285 | 411 | 136 | | |

-continued

| ORF Name | NT ID | AA ID | NT LN | AA LN | Score | P-Value |
|---|---|---|---|---|---|---|
| | | | | | | |

Description
NO-HIT

| ORF Name | NT ID | AA ID | NT LN | AA LN | Score | P-Value |
|---|---|---|---|---|---|---|
| AI7503000987_23477213_c1_701 | 1514 | 5286 | 1011 | 336 | 1085 | 7.9e−110 |

Description
pir:[LN:S39743] [AC:S39743:D69683] [PN:phosphotransacetylase pta] [GN:pta]
[CL:phosphate acetyltransferase] [OR:*Bacillus subtilis*] [DB:pir2]
>gp:[GI:g580883] [LN:BSGENR] [AC:X73124] [GN:ipa-88d] [OR:*Bacillus subtilis*]
[DB:genpept-bct1] [DE:*B.subtilis* genomic region (325 to 333).] [SP:P39646]
[LE:91234] [RE:92205] [DI:direct] >gp:[GI:e1186266:g2636302] [LN:BSUB0020]
[AC:Z99123:AL009126] [PN:phosphotransacetylase] [GN:pta] [OR:*Bacillus
subtilis*] [DB:genpept-bct1] [EC:2.3.1.8] [DE:*Bacillus subtilis* complete
genome (section 20 of 21): from 3798401to 4010550.] [NT:alternate gene name:
ipa-88d, ywfJ] [SP:P39646] [LE:65754] [RE:66725] [DI:complement]

| ORF Name | NT ID | AA ID | NT LN | AA LN | Score | P-Value |
|---|---|---|---|---|---|---|
| AI7503000987_23554700_c3_1002 | 1515 | 5287 | 162 | 53 | | |

Description
NO-HIT

| ORF Name | NT ID | AA ID | NT LN | AA LN | Score | P-Value |
|---|---|---|---|---|---|---|
| AI7503000987_23572178_c3_958 | 1516 | 5288 | 195 | 64 | | |

Description
NO-HIT

| ORF Name | NT ID | AA ID | NT LN | AA LN | Score | P-Value |
|---|---|---|---|---|---|---|
| AI7503000987_23601637_c2_794 | 1517 | 5289 | 816 | 271 | 374 | 1.7e−34 |

Description
pir:[LN:S60902] [AC:S60902:S49238:S44071] [PN:CDP-ribitol
pyrophosphorylase] [OR:*Haemophilus influenzae*] [DB:pir2] >gp:[GI:g471234]
[LN:HISBCAL] [AC:X78559] [OR:*Haemophilus influenzae*] [DB:genpept-bct1]
[DE:*H.influenzae* DNA for serotype b capsulation locus.] [NT:orf1] [LE:434]
[RE:1858] [DI:direct]

| ORF Name | NT ID | AA ID | NT LN | AA LN | Score | P-Value |
|---|---|---|---|---|---|---|
| AI7503000987_23603391_c3_969 | 1518 | 5290 | 294 | 97 | 94 | 0.00030 |

Description
gp:[GI:e1389970:g4539393] [LN:ATF28A21] [AC:AL035526] [PN:hypothetical
protein] [GN:F28A21.150] [OR:*Arabidopsis thaliana*] [SR:thale cress]
[DB:genpept-pln1] [DE:*Arabidopsis thaliana* DNA chromosome 4, BAC clone
F28A21 (ESSAproject).] [LE:62401:62755:63247] [RE:62693:63126:63337]
[DI:complementJoin]

| ORF Name | NT ID | AA ID | NT LN | AA LN | Score | P-Value |
|---|---|---|---|---|---|---|
| AI7503000987_23617140_c1_686 | 1519 | 5291 | 1404 | 467 | 441 | 6.0e−44 |

Description
pir:[LN:A69832] [AC:A69832] [PN:long-chain fatty-acid-CoA ligase homolog
yhfT] [GN:yhfT] [CL:acetate--CoA ligase homology] [OR:*Bacillus subtilis*]
[DB:pir2] >gp:[GI:e1183038:g2633372] [LN:BSUB0006] [AC:Z99109:AL009126]
[GN:yhfT] [FN:unknown] [OR:*Bacillus subtilis*] [DB:genpept-bct1] [DE:*Bacillus
subtilis* complete genome (section 6 of 21): from 999501 to1209940.]
[NT:similar to long-chain fatty-acid-CoA ligase] [LE:110451] [RE:111890]
[DI:complement] >gp:[GI:e324999:g2226256] [LN:BSY14084] [AC:Y14084]
[PN:hypothetical protein] [GN:yhfT] [OR:*Bacillus subtilis*] [DB:genpept-bct1]
[DE:*B.subtilis* chromosomal DNA, region 78–80 degrees: aprE to comK.]
[NT:similarity to long-chain-acyl-CoA synthetase from] [LE:4879] [RE:6318]
[DI:complement]

| ORF Name | NT ID | AA ID | NT LN | AA LN | Score | P-Value |
|---|---|---|---|---|---|---|
| AI7503000987_23673313_f2_408 | 1520 | 5292 | 198 | 65 | 64 | 0.0061 |

-continued

Description
gp:[GI:g3329651] [LN:CELT17A3] [AC:AF078787] [GN:T17A3.9] [OR:*Caenorhabditis elegans*] [DB:genpept-inv2] [DE:*Caenorhabditis elegans* cosmid T17A3.] [LE:15875:16120:16852] [RE:16060:16380:17211] [DI:complementJoin]

| ORF Name | NT ID | AA ID | NT LN | AA LN | Score | P-Value |
|---|---|---|---|---|---|---|
| AI7503000987_23709631_c1_676 | 1521 | 5293 | 123 | 40 | | |

Description
NO-HIT

| ORF Name | NT ID | AA ID | NT LN | AA LN | Score | P-Value |
|---|---|---|---|---|---|---|
| AI7503000987_23712830_c1_713 | 1522 | 5294 | 489 | 162 | 227 | 6.6e−19 |

Description
gp:[GI:g4049992] [LN:AF077306] [AC:AF077306] [PN:gp157] [OR:*Streptococcus thermophilus bacteriophage* Sfi19] [DB:genpept-phg] [DE:*Streptococcus thermophilus bacteriophage* Sfi19 gp157, gp233,putative helicase , gp151, gp271, putative primase, and gp143genes, complete cds.] [NT:orf157] [LE:1] [RE:474] [DI:direct]

| ORF Name | NT ID | AA ID | NT LN | AA LN | Score | P-Value |
|---|---|---|---|---|---|---|
| AI7503000987_23867125_f2_333 | 1523 | 5295 | 204 | 67 | 57 | 0.018 |

Description
pir:[LN:S21443] [AC:S21443] [PN:hypothetical protein] [OR:*Dictyostelium discoideum*] [DB:pir2]

| ORF Name | NT ID | AA ID | NT LN | AA LN | Score | P-Value |
|---|---|---|---|---|---|---|
| AI7503000987_23910052_f3_585 | 1524 | 5296 | 147 | 48 | | |

Description
NO-HIT

| ORF Name | NT ID | AA ID | NT LN | AA LN | Score | P-Value |
|---|---|---|---|---|---|---|
| AI7503000987_2392837_c1_732 | 1525 | 5297 | 426 | 141 | 226 | 8.4e−19 |

Description
gp:[GI:e244844:g2764864] [LN:BSPP1GENM] [AC:X97918] [OR:*Bacteriophage* SPP1] [DB:genpept-phg] [DE:*Bacteriophage* SPP1 complete nucleotide sequence.] [NT:gene 16.1] [LE:9632] [RE:10066] [DI:direct]

| ORF Name | NT ID | AA ID | NT LN | AA LN | Score | P-Value |
|---|---|---|---|---|---|---|
| AI7503000987_24026077_c3_966 | 1526 | 5298 | 954 | 317 | 560 | 3.4e−54 |

Description
pir:[LN:S58137] [AC:S58137:S24456] [PN:gene 7 protein] [OR:phage SPP1] [DB:pir2] >gp:[GI:e244838:g2764848] [LN:BSPP1GENM] [AC:X97918] [OR:*Bacteriophage* SPP1] [DB:genpept-phg] [DE:*Bacteriophage* SPP1 complete nucleotide sequence.] [NT:gene 7] [LE:3802] [RE:4728] [DI:direct] >gp:[GI:g1052806] [LN:SPP1HEADG] [AC:X89721] [GN:7] [OR:*Bacteriophage* SPP1] [DB:genpept-phg] [DE:*Bacteriophage* SPP1 head morphogenesis genes 7 to 15.] [NT:product required for head morphogenesis] [LE:578] [RE:1504] [DI:direct]

| ORF Name | NT ID | AA ID | NT LN | AA LN | Score | P-Value |
|---|---|---|---|---|---|---|
| AI7503000987_24026576_c2_854 | 1527 | 5299 | 180 | 59 | | |

Description
NO-HIT

| ORF Name | NT ID | AA ID | NT LN | AA LN | Score | P-Value |
|---|---|---|---|---|---|---|
| AI7503000987_24229837_c1_716 | 1528 | 5300 | 243 | 80 | 97 | 3.9e−05 |

Description
pir:[LN:A56273] [AC:A56273] [PN:hypothetical protein (bacteriocin saiA 3'-region)] [OR:*Lactobacillus sake*] [DB:pir2] >gp:[GI:g599850] [LN:LSSAKACLU] [AC:Z46867] [GN:orf1] [OR:*Lactobacillus sakei*] [DB:genpept-bct1] [DE:*L.sake* sakacin A gene cluster.] [LE:5] [RE:268] [DI:complement]

-continued

| ORF Name | NT ID | AA ID | NT LN | AA LN | Score | P-Value |
|---|---|---|---|---|---|---|
| AI7503000987_24258462_c3_982 | 1529 | 5301 | 336 | 111 | 200 | 4.8e−16 |

Description
gp:[GI:g928831] [LN:BK5TATTP] [AC:L44593] [FN:unidentified] [OR:*Lactococcus lactis* phage BK5-T] [SR:*Bacteriophage* BK5-T DNA] [DB:genpept-phg] [DE:*Bacteriophage* BK5-T ORF'410, 3' end pf cds, 20 ORFs, repressorprotein, and Cro repressor protein genes, complete cds, ORF70'gene, 5' end of cds.] [NT:ORF95; putative] [LE:7452] [RE:7739] [DI:direct]

| ORF Name | NT ID | AA ID | NT LN | AA LN | Score | P-Value |
|---|---|---|---|---|---|---|
| AI7503000987_24275342_c1_718 | 1530 | 5302 | 378 | 125 | | |

Description
NO-HIT

| ORF Name | NT ID | AA ID | NT LN | AA LN | Score | P-Value |
|---|---|---|---|---|---|---|
| AI7503000987_24320256_f1_134 | 1531 | 5303 | 165 | 54 | | |

Description
NO-HIT

| ORF Name | NT ID | AA ID | NT LN | AA LN | Score | P-Value |
|---|---|---|---|---|---|---|
| AI7503000987_24328127_f3_452 | 1532 | 5304 | 204 | 67 | 154 | 2.6e−10 |

Description
sp:[LN:YKGC_ECOLI] [AC:P77212] [GN:YKGC] [OR:*ESCHERICHIA COLI*] [DE:INTERGENIC REGION] [SP:P77212] [DB:swissprot] >pir:[LN:H64756] [AC:H64756] [PN:probable mercury(II) reductase,;ykgC protein] [GN:ykgC] [OR:*Escherichia coli*] [EC:1.16.1.1] [DB:pir2] >gp:[GI:g1657503] [LN:ECU73857] [AC:U73857] [OR:*Escherichia coli*] [DB:genpept-bct1] [DE:*Escherichia coli* chromosome minutes 6–8.] [NT:similar to *S. aureus* mercury(II) reductase] [LE:26473] [RE:27825] [DI:complement] >gp:[GI:g1786495] [LN:AE000137] [AC:AE000137:U00096] [PN:putative oxidoreductase] [GN:ykgC] [FN:putative enzyme; Not classified] [OR:*Escherichia coli*] [DB:genpept-bct2] [DE:*Escherichia coli* K-12 MG1655 section 27 of 400 of the completegenome.] [NT:f450; 35 pct identical (29 gaps) to 430 residues of] [LE:6292] [RE:7644] [DI:complement]

| ORF Name | NT ID | AA ID | NT LN | AA LN | Score | P-Value |
|---|---|---|---|---|---|---|
| AI7503000987_24337800_c2_862 | 1533 | 5305 | 1386 | 461 | 945 | 5.4e−95 |

Description
pir:[LN:T00158] [AC:T00158] [PN:amidase,] [OR:*Staphylococcus aureus* phage phi PVL] [EC:3.5.-.-] [DB:pir3] >gp:[GI:d1032859:g3341932] [LN:AB009866] [AC:AB009866] [PN:amidase (peptidoglycan hydrolase)] [OR:*bacteriophage phi* PVL] [SR:*bacteriophage phi* PVL (specific_host:*Staphylococcus aureus* ATC] [DB:genpept-phg] [DE:*Bacteriophage phi* PVL proviral DNA, complete sequence.] [NT:orf 25] [LE:20199] [RE:21653] [DI:direct]

| ORF Name | NT ID | AA ID | NT LN | AA LN | Score | P-Value |
|---|---|---|---|---|---|---|
| AI7503000987_2438878_f1_126 | 1534 | 5306 | 213 | 70 | 288 | 2.3e−25 |

Description
sp:[LN:ARSC_STAAU] [AC:P30330] [GN:ARSC] [OR:*STAPHYLOCOCCUS AUREUS*] [DE:*ARSENATE REDUCTASE* (ARSENICAL PUMP MODIFIER)] [SP:P30330] [DB:swissprot] >pir:[LN:D41903] [AC:D41903] [PN:*arsenate reductase*,] [GN:arsC] [CL:protein-tyrosine-phosphatase, low molecular weight] [OR:*Staphylococcus aureus*] [EC:1.-.-.-] [DB:pir1] >gp:[GI:g150729] [LN:PI2ARSRBC] [AC:M86824] [PN:*arsenate reductase*] [GN:arsC] [FN:Reduction of arsenate to arsenite] [OR:Plasmid pI258] [SR:Plasmid pI258 DNA] [DB:genpept-bct1] [DE:Plasmid pI258 arsenic resistance operon (arsRBC) genes, completecds.] [LE:1894] [RE:2289] [DI:direct]

| ORF Name | NT ID | AA ID | NT LN | AA LN | Score | P-Value |
|---|---|---|---|---|---|---|
| AI7503000987_24401462_c3_921 | 1535 | 5307 | 591 | 196 | 367 | 9.6e−34 |

Description
sp:[LN:YCKF_BACSU] [AC:P42404] [GN:YCKF] [OR:*BACILLUS SUBTILIS*] [DE:HYPOTHETICAL 20.0 KD PROTEIN IN TLPC-SRFAA INTERGENIC REGION (ORF9)] [SP:P42404] [DB:swissprot] >pir:[LN:H69760] [AC:H69760] [PN:conserved hypothetical protein yckF] [GN:yckF] [CL:conserved hypothetical protein -continued MJ1247] [OR:*Bacillus subtilis*] [DB:pir2] >gp:[GI:d1007003:g1438846]
[LN:BACYCK] [AC:D30762] [PN:unknown] [GN:yckF] [OR:*Bacillus subtilis*]
[SR:*Bacillus subtilis* (strain:168trpC2) DNA, clone__lib:lambda DASHI]
[DB:genpept-bct1] [DE:*Bacillus subtilis* DNA around 28 degrees region of
chromosomecontaining yckA-H genes.] [LE:7448] [RE:8005] [DI:complement]
>gp:[GI:e1182297:g2632631] [LN:BSUB0002] [AC:Z99105:AL009126] [GN:yckF]
[FN:unknown] [OR:*Bacillus subtilis*] [DB:genpept-bct1] [DE:*Bacillus subtilis*
complete genome (section 2 of 21): from 194651 to415810.] [NT:similar to
hypothetical proteins] [LE:179524] [RE:180081] [DI:complement]
>gp:[GI:d1009614:g1805417] [LN:D50453] [AC:D50453] [GN:yckF] [OR:*Bacillus
subtilis*] [SR:*Bacillus subtilis* (strain:168 trpC2) DNA] [DB:genpept-bct1]
[DE:*Bacillus subtilis* DNA for 25-36 degree region containing theamyE-srfA
region, complete cds.] [LE:53828] [RE:54385] [DI:complement]

| ORF Name | NT ID | AA ID | NT LN | AA LN | Score | P-Value |
|---|---|---|---|---|---|---|
| AI7503000987__24407327__c1__643 | 1536 | 5308 | 696 | 231 | 892 | 2.2e-89 |

Description
pir:[LN:E69694] [AC:E69694:S39861:S40073] [PN:ribosomal protein L1]
[GN:rplA] [CL:*Escherichia coli* ribosomal protein L1] [OR:*Bacillus subtilis*]
[DB:pir2] >gp:[GI:e1182036:g2632370] [LN:BSUB0001] [AC:Z99104:AL009126]
[PN:ribosomal protein L1 (BL1)] [GN:rplA] [OR:*Bacillus subtilis*]
[DB:genpept-bct1] [DE:*Bacillus subtilis* complete genome (section 1 of 21):
from 1 to213080.] [SP:Q06797] [LE:119107] [RE:119805] [DI:direct]

| ORF Name | NT ID | AA ID | NT LN | AA LN | Score | P-Value |
|---|---|---|---|---|---|---|
| AI7503000987__24414050__c2__806 | 1537 | 5309 | 2793 | 930 | 4374 | 0.0 |

Description
gp:[GI:e1296735:g3201550] [LN:SEY17116] [AC:Y17116] [PN:fibrinogen-binding
protein] [OR:*Staphylococcus epidermidis*] [DB:genpept-bct1]
[DE:*Staphylococcus epidermidis* gene encoding fibrinogen-bindingprotein,
complete CDS.] [LE:38] [RE:3316] [DI:direct]

| ORF Name | NT ID | AA ID | NT LN | AA LN | Score | P-Value |
|---|---|---|---|---|---|---|
| AI7503000987__24415875__c1__660 | 1538 | 5310 | 300 | 99 | 129 | 1.7e-07 |

Description
gp:[GI:g1458327] [LN:CELF08F3] [AC:U64847] [GN:F08F3.4] [OR:*Caenorhabditis
elegans*] [SR:*Caenorhabditis elegans* strain=Bristol N2] [DB:genpept-inv1]
[DE:*Caenorhabditis elegans* cosmid F08F3.] [LE:1515:1817:2044:2841]
[RE:1758:1994:2276:3110] [DI:directJoin]

| ORF Name | NT ID | AA ID | NT LN | AA LN | Score | P-Value |
|---|---|---|---|---|---|---|
| AI7503000987__24422175__f2__402 | 1539 | 5311 | 132 | 43 | | |

Description
NO-HIT

| ORF Name | NT ID | AA ID | NT LN | AA LN | Score | P-Value |
|---|---|---|---|---|---|---|
| AI7503000987__24429643__c2__793 | 1540 | 5312 | 222 | 73 | 58 | 0.011 |

Description
sp:[LN:YA28__PYRHO] [AC:O58584] [GN:PHAL028] [OR:*PYROCOCCUS HORIKOSHII*]
[DE:HYPOTHETICAL PROTEIN PHAL028] [SP:O58584] [DB:swissprot]
>pir:[LN:B71136] [AC:B71136] [PN:hypothetical protein PH0854] [GN:PH0854]
[CL:hypothetical protein HI0719] [OR:*Pyrococcus horikoshii*] [DB:pir2]
>gp:[GI:d1030891:g3257265] [LN:AP000003]
[AC:AP000003:AB009484:AB009485:AB009486:AB009487:AB009488:AB009489]
[PN:137aa long hypothetical protein] [GN:PH0854] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 544001-777000 nt. position(3/7).] [NT:similar to
Swiss__Prot:P37552 percent identity:] [LE:218223] [RE:218636] [DI:complement]

| ORF Name | NT ID | AA ID | NT LN | AA LN | Score | P-Value |
|---|---|---|---|---|---|---|
| AI7503000987__24491037__c1__719 | 1541 | 5313 | 495 | 164 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987__24500387_c3__961 | 1542 | 5314 | 564 | 187 | 85 | 0.0016 |

Description
sp:[LN:Y53__BPT3] [AC:P20327] [GN:5.3] [OR:*BACTERIOPHAGE* T3] [DE:HYPOTHETICAL
GENE 5.3 PROTEIN] [SP:P20327] [DB:swissprot] >pir:[LN:S07514] [AC:S07514]
[PN:gene 5.3 protein] [GN:5.3] [CL:phage T7 gene 2.8 protein] [OR:phage T3]
[DB:pir2] >gp:[GI:g15705] [LN:POT3111G] [AC:X17255] [GN:5.3]
[OR:*Bacteriophage* T3] [DB:genpept-phg] [DE:*Bacteriophage* T3 gene 1 to gene
11.] [SP:P20327] [LE:12333] [RE:12638] [DI:direct]

| ORF Name | NT ID | AA ID | NT LN | AA LN | Score | P-Value |
|---|---|---|---|---|---|---|
| AI7503000987__245953_c3__881 | 1543 | 5315 | 579 | 192 | 231 | 2.5e−19 |

Description
gp:[GI:g1314295] [LN:LMU40604] [AC:U40604] [FN:unknown] [OR:*Listeria
monocytogenes*] [DB:genpept-bct2] [DE:*Listeria monocytogenes* ClpC ATPase
(mec) gene, complete cds.] [NT:ORF2; putative 19 kDa protein] [LE:672]
[RE:1196] [DI:direct]

| ORF Name | NT ID | AA ID | NT LN | AA LN | Score | P-Value |
|---|---|---|---|---|---|---|
| AI7503000987__24617130_c3__896 | 1544 | 5316 | 3648 | 1215 | 5258 | 0.0 |

Description
gp:[GI:e187583:g1495791] [LN:SARPOCGEN] [AC:X89233] [PN:DNA-directed RNA
polymerase] [GN:rpoC] [OR:*Staphylococcus aureus*] [DB:genpept-bct1]
[EC:2.7.7.6] [DE:*S.aureus* DNA for rpoC gene.] [NT:B' subunit] [SP:P47770]
[LE:<1] [RE:>3171] [DI:direct]

| ORF Name | NT ID | AA ID | NT LN | AA LN | Score | P-Value |
|---|---|---|---|---|---|---|
| AI7503000987__24648937_c3__924 | 1545 | 5317 | 657 | 218 | 626 | 3.4e−61 |

Description
sp:[LN:UNG__BACSU] [AC:P39615] [GN:UNG:IPA-57D] [OR:*BACILLUS SUBTILIS*]
[EC:3.2.2.-] [DE:URACIL-DNA GLYCOSYLASE, (UDG)] [SP:P39615] [DB:swissprot]
>pir:[LN:S39712] [AC:S39712:H69728] [PN:uracil-DNA glycosylase, ung]
[GN:ung] [CL:uracil-DNA glycosylase] [OR:*Bacillus subtilis*] [EC:3.2.-]
[DB:pir2] >gp:[GI:g580875] [LN:BSGENR] [AC:X73124] [GN:ipa-57d] [OR:*Bacillus
subtilis*] [DB:genpept-bct1] [DE:*B.subtilis* genomic region (325 to 333).]
[SP:P39615] [LE:59206] [RE:59883] [DI:direct] >gp:[GI:e1186296:g2636332]
[LN:BSUB0020] [AC:Z99123:AL009126] [PN:uracil-DNA glycosylase] [GN:ung]
[OR:*Bacillus subtilis*] [DB:genpept-bct1] [EC:3.2.2.-] [DE:*Bacillus subtilis*
complete genome (section 20 of 21): from 3798401to 4010550.] [NT:alternate
gene name: ipa-57d, ywdG] [SP:P39615] [LE:98079] [RE:98756] [DI:complement]

| ORF Name | NT ID | AA ID | NT LN | AA LN | Score | P-Value |
|---|---|---|---|---|---|---|
| AI7503000987__24650332_c3__962 | 1546 | 5318 | 228 | 75 | | |

Description
NO-HIT

| ORF Name | NT ID | AA ID | NT LN | AA LN | Score | P-Value |
|---|---|---|---|---|---|---|
| AI7503000987__24650468_f3__522 | 1547 | 5319 | 1383 | 460 | 711 | 3.4e−70 |

Description
gp:[GI:d1037645:g4126638] [LN:AB016282] [AC:AB016282] [PN:site-specific
recombinase for integration and] [OR:*bacteriophage phi*-105]
[SR:*bacteriophage phi*-105 DNA] [DB:genpept-phg] [DE:*Bacteriophage phi*-105
DNA, complete sequence.] [NT:ORF3] [LE:25528] [RE:26952] [DI:complement]

| ORF Name | NT ID | AA ID | NT LN | AA LN | Score | P-Value |
|---|---|---|---|---|---|---|
| AI7503000987__24656552_c2__772 | 1548 | 5320 | 150 | 49 | 149 | 1.2e−10 |

Description
sp:[LN:RL33__THEMA] [AC:P35873] [GN:RPMG] [OR:*THERMOTOGA MARITIMA*] [DE:50S
RIBOSOMAL PROTEIN L33] [SP:P35873] [DB:swissprot] >gp:[GI:g407022]
[LN:TMNUSGGE] [AC:Z11839] [PN:RIBOSOMAL PROTEIN L33] [OR:*Thermotoga
maritima*] [DB:genpept-bct1] [DE:*T.maritima* nusG gene and genes for ribosomal
proteins.] [SP:P35873] [LE:579] [RE:728] [DI:direct] >gp:[GI:g4980957]
[LN:AE001723] [AC:AE001723:AE000512] [PN:ribosomal protein L33] [GN:TM0451]
[OR:*Thermotoga maritima*] [DB:genpept-bct2] [DE:*Thermotoga maritima* section
35 of 136 of the complete genome.] [NT:similar to SP:P35873 GB:Z11839
PID:407022] [LE:5319] [RE:5468] [DI:direct]

-continued

| ORF Name | NT ID | AA ID | NT LN | AA LN | Score | P-Value |
|---|---|---|---|---|---|---|
| AI7503000987_24667192_f2_350 | 1549 | 5321 | 183 | 60 | 201 | 1.7e−15 |

Description
sp:[LN:ARSB_STAAU] [AC:P30329] [GN:ARSB] [OR:*STAPHYLOCOCCUS AUREUS*]
[DE:ARSENICAL PUMP MEMBRANE PROTEIN] [SP:P30329] [DB:swissprot]
>pir:[LN:C41903] [AC:C41903] [PN:arsenical pump membrane protein] [GN:arsB]
[CL:arsenical pump membrane protein] [OR:*Staphylococcus aureus*] [DB:pir1]
>gp:[GI:g150728] [LN:PI2ARSRBC] [AC:M86824] [PN:arsenic efflux pump protein]
[GN:arsB] [FN:arsenic efflux pump component (membrane)] [OR:Plasmid pI258]
[SR:Plasmid pI258 DNA] [DB:genpept-bct1] [DE:Plasmid pI258 arsenic
resistance operon (arsRBC) genes, completecds.] [LE:587] [RE:1876]
[DI:direct]

| ORF Name | NT ID | AA ID | NT LN | AA LN | Score | P-Value |
|---|---|---|---|---|---|---|
| AI7503000987_24803462_f1_9 | 1550 | 5322 | 861 | 286 | 463 | 6.4e−44 |

Description
sp:[LN:YH17_SYNY3] [AC:P73846] [GN:SLR1717] [OR:*SYNECHOCYSTIS* SP] [SR:PCC
6803,] [DE:HYPOTHETICAL 30.2 KD PROTEIN SLR1717] [SP:P73846] [DB:swissprot]
>pir:[LN:S75043] [AC:S75043] [PN:hypothetical protein slr1717]
[OR:*Synechocystis* sp.] [SR:PCC 6803, , PCC 6803] [SR:PCC 6803,] [DB:pir2]
>gp:[GI:d1018638:g1652988] [LN:D90910] [AC:D90910:AB001339] [PN:hypothetical
protein] [OR:*Synechocystis* sp.] [SR:*Synechocystis* sp. (strain:PCC6803) DNA]
[DB:genpept-bct1] [DE:*Synechocystis* sp. PCC6803 complete genome, 12/27,
1430419–1576592.] [NT:ORF_ID:slr1717] [LE:37735] [RE:38541] [DI:direct]

| ORF Name | NT ID | AA ID | NT LN | AA LN | Score | P-Value |
|---|---|---|---|---|---|---|
| AI7503000987_24823437_f3_521 | 1551 | 5323 | 495 | 164 | 71 | 0.044 |

Description
gp:[GI:g46550] [LN:SACP221] [AC:X02166] [OR:*Staphylococcus aureus*]
[DB:genpept-bct1] [DE:*Staphylococcus* plasmid pC221.] [NT:pot. reading-frame
C (aa 1–90) (4555 is 2nd base in] [SP:P03866] [LE:4287] [RE:>4555]
[DI:direct] >gp:[GI:e190060:g1333818] [LN:SAPC221] [AC:X02529]
[OR:*Staphylococcus aureus*] [DB:genpept-bct1] [DE:*Staphylococcus aureus*
plasmid pC221 complete DNA sequence.] [NT:pot. orfB (aa 1–92) (4557 is 2nd
base in codon)] [SP:P03866] [LE:4289] [RE:>4557] [DI:direct]

| ORF Name | NT ID | AA ID | NT LN | AA LN | Score | P-Value |
|---|---|---|---|---|---|---|
| AI7503000987_24854637_c2_804 | 1552 | 5324 | 903 | 300 | 404 | 1.1e−37 |

Description
pir:[LN:C70070] [AC:C70070] [PN:conserved hypothetical protein ywtE]
[GN:ywtE] [CL:hypothetical protein ywpJ] [OR:*Bacillus subtilis*] [DB:pir2]
>gp:[GI:e1184491:g2636110] [LN:BSUB0019] [AC:Z99122:AL009126] [GN:ywtE]
[FN:unknown] [OR:*Bacillus subtilis*] [DB:genpept-bct1] [DE:*Bacillus subtilis*
complete genome (section 19 of 21): from 3597091to 3809700.] [NT:similar to
hypothetical proteins] [LE:97330] [RE:98190] [DI:direct]
>gp:[GI:e308093:g1894770] [LN:BSZ92954] [AC:Z92954] [GN:ywtE] [OR:*Bacillus
subtilis*] [DB:genpept-bct1] [DE:*B.subtilis* yws[A,B,C,D,E,F,G] and gerBC
genes.] [NT:product similar to *Bacillus subtilis* YxeH and YcsE] [LE:4292]
[RE:5152] [DI:complement] >gp:[GI:e1184491:g2636110] [LN:BSUB0019]
[AC:Z99122:AL009126] [GN:ywtE] [FN:unknown] [OR:*Bacillus subtilis*]
[DB:genpept] [DE:*Bacillus subtilis* complete genome (section 19 of 21): from
3597091to 3809700.] [NT:similar to hypothetical proteins] [LE:97330]
[RE:98190] [DI:direct]

| ORF Name | NT ID | AA ID | NT LN | AA LN | Score | P-Value |
|---|---|---|---|---|---|---|
| AI7503000987_24855325_c3_936 | 1553 | 5325 | 129 | 42 | | |

Description
NO-HIT

| ORF Name | NT ID | AA ID | NT LN | AA LN | Score | P-Value |
|---|---|---|---|---|---|---|
| AI7503000987_25398262_f3_622 | 1554 | 5326 | 132 | 43 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987__25478801__f3__446 | 1555 | 5327 | 147 | 48 | | |

Description
NO-HIT

| ORF Name | NT ID | AA ID | NT LN | AA LN | Score | P-Value |
|---|---|---|---|---|---|---|
| AI7503000987__25509692__c3__972 | 1556 | 5328 | 498 | 165 | 151 | 7.4e−11 |

Description
gp:[GI:e244846:g2764870] [LN:BSPP1GENM] [AC:X97918] [OR:*Bacteriophage* SPP1] [DB:genpept-phg] [DE:*Bacteriophage* SPP1 complete nucleotide sequence.] [NT:gene 17.5] [LE:11342] [RE:11881] [DI:direct]

| ORF Name | NT ID | AA ID | NT LN | AA LN | Score | P-Value |
|---|---|---|---|---|---|---|
| AI7503000987__25578827__c3__897 | 1557 | 5329 | 261 | 86 | 334 | 3.0e−30 |

Description
sp:[LN:YBXF__STAAU] [AC:Q53602] [OR:*STAPHYLOCOCCUS AUREUS*] [DE:PROBABLE RIBOSOMAL PROTEIN IN RPSL 5'REGION (FRAGMENT)] [SP:Q53602] [DB:swissprot] >gp:[GI:g706920] [LN:SAU20869] [AC:U20869] [PN:unknown] [FN:unknown] [OR:*Staphylococcus aureus*] [DB:genpept-bct2] [DE:*Staphylococcus aureus* ribosomal protein S12 (rpsL) gene, completecds, ribosomal protein S7 (rpsG) and ORF 1 genes, partial cds.] [NT:ORF 1] [LE:<1] [RE:320] [DI:direct]

| ORF Name | NT ID | AA ID | NT LN | AA LN | Score | P-Value |
|---|---|---|---|---|---|---|
| AI7503000987__25579662__f3__575 | 1558 | 5330 | 1221 | 406 | 849 | 8.0e−85 |

Description
pir:[LN:H69817] [AC:H69817] [PN:aminoacylase homolog yhaA] [GN:yhaA] [CL:*hippurate hydrolase*] [OR:*Bacillus subtilis*] [DB:pir2] >gp:[GI:e1183009:g2633343] [LN:BSUB0006] [AC:Z99109:AL009126] [GN:yhaA] [FN:unknown] [OR:*Bacillus subtilis*] [DB:genpept-bct1] [DE:*Bacillus subtilis* complete genome (section 6 of 21): from 999501 to1209940.] [NT:similar to aminoacylase] [LE:80123] [RE:81313] [DI:complement]

| ORF Name | NT ID | AA ID | NT LN | AA LN | Score | P-Value |
|---|---|---|---|---|---|---|
| AI7503000987__25660937__c3__990 | 1559 | 5331 | 498 | 165 | 175 | 3.5e−13 |

Description
sp:[LN:OPUC__BACSU] [AC:P46922] [GN:OPUAC] [OR:*BACILLUS SUBTILIS*] [DE:GLYCINE BETAINE-BINDING PROTEIN PRECURSOR] [SP:P46922] [DB:swissprot] >pir:[LN:I40537] [AC:I40537:F69669] [PN:glycine betaine ABC transporter (glycine betaine-binding protein) opuAC precursor] [GN:opuAC] [OR:*Bacillus subtilis*] [DB:pir2] >gp:[GI:e1182252:g2632586] [LN:BSUB0002] [AC:Z99105:AL009126] [PN:glycine betaine ABC transporter (glycine] [GN:opuAC] [FN:glycine betaine transport (osmoprotection)] [OR:*Bacillus subtilis*] [DB:genpept-bct1] [DE:*Bacillus subtilis* complete genome (section 2 of 21): from 194651 to415810.] [SP:P46922] [LE:128023] [RE:128904] [DI:direct] >gp:[GI:d1009569:g1805372] [LN:D50453] [AC:D50453] [PN:glycine betain-binding protein precursor] [GN:opuAC] [OR:*Bacillus subtilis*] [SR:*Bacillus subtilis* (strain:168 trpC2) DNA] [DB:genpept-bct1] [DE:*Bacillus subtilis* DNA for 25–36 degree region containing theamyE-srfA region, complete cds.] [LE:2326] [RE:3207] [DI:direct] >gp:[GI:g984805] [LN:BSU17292] [AC:U17292] [PN:glycine betaine-binding protein precursor] [GN:opuAC] [OR:*Bacillus subtilis*] [DB:genpept-bct2] [DE:*Bacillus subtilis* ATPase (opuAA), transmembrane protein (opuAB) andglycine betaine-binding protein precursor (opuAC) genes, completecds.] [LE:2332] [RE:3213] [DI:direct]

| ORF Name | NT ID | AA ID | NT LN | AA LN | Score | P-Value |
|---|---|---|---|---|---|---|
| AI7503000987__25667753__c2__773 | 1560 | 5332 | 564 | 187 | 906 | 7.3e−91 |

Description
sp:[LN:NUSG__STACA] [AC:P36264] [GN:NUSG] [OR:*STAPHYLOCOCCUS CARNOSUS*] [DE:TRANSCRIPTION ANTITERMINATION PROTEIN NUSG] [SP:P36264] [DB:swissprot] >pir:[LN:S38870] [AC:S38870] [PN:transcription antitermination factor nusG] [GN:nusG] [CL:transcription antitermination factor nusG] [OR:*Staphylococcus carnosus*] [DB:pir2] >gp:[GI:g426473] [LN:SCSECE] [AC:X76134] [GN:nusG] [OR:*Staphylococcus carnosus*] [DB:genpept-bct1] [DE:*S.carnosus* secE, nusG and rplK genes.] [SP:P36264] [LE:331] [RE:879] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987__25972086_f1__108 | 1561 | 5333 | 135 | 44 | | |

Description
NO-HIT

| ORF Name | NT ID | AA ID | NT LN | AA LN | Score | P-Value |
|---|---|---|---|---|---|---|
| AI7503000987__26173287_c3__970 | 1562 | 5334 | 363 | 120 | 103 | 9.0e−06 |

Description
gp:[GI:e244712:g2764863] [LN:BSPP1GENM] [AC:X97918] [OR:*Bacteriophage* SPP1]
[DB:genpept-phg] [DE:*Bacteriophage* SPP1 complete nucleotide sequence.]
[NT:gene 16] [LE:9322] [RE:9651] [DI:direct]

| ORF Name | NT ID | AA ID | NT LN | AA LN | Score | P-Value |
|---|---|---|---|---|---|---|
| AI7503000987__26206687_c1__642 | 1563 | 5335 | 210 | 69 | 278 | 2.6e−24 |

Description
sp:[LN:SECE__STAAU] [AC:O06442] [GN:SECE] [OR:*STAPHYLOCOCCUS AUREUS*]
[DE:PREPROTEIN TRANSLOCASE SECE SUBUNIT] [SP:O06442] [DB:swissprot]
>gp:[GI:g2078376] [LN:SAU96619] [AC:U96619] [PN:SecE] [GN:secE]
[OR:*Staphylococcus aureus*] [DB:genpept-bct1] [DE:*Staphylococcus aureus* NCTC
8325 SecE (secE), NusG (nusG) and RplK(rplK) genes, complete cds.] [LE:31]
[RE:213] [DI:direct]

| ORF Name | NT ID | AA ID | NT LN | AA LN | Score | P-Value |
|---|---|---|---|---|---|---|
| AI7503000987__26290912_f3__547 | 1564 | 5336 | 882 | 293 | 665 | 2.5e−65 |

Description
pir:[LN:H69759] [AC:H69759] [PN:conserved hypothetical protein yciA]
[GN:yciA] [OR:*Bacillus subtilis*] [DB:pir2] >gp:[GI:e1182286:g2632620]
[LN:BSUB0002] [AC:Z99105:AL009126] [GN:yciA] [FN:unknown] [OR:*Bacillus
subtilis*] [DB:genpept-bct1] [DE:*Bacillus subtilis* complete genome (section 2
of 21): from 194651 to415810.] [NT:similar to hypothetical proteins]
[LE:169177] [RE:170094] [DI:direct] >gp:[GI:d1009603:g1805406] [LN:D50453]
[AC:D50453] [GN:yciA] [OR:*Bacillus subtilis*] [SR:*Bacillus subtilis*
(strain:168 trpC2) DNA] [DB:genpept-bct1] [DE:*Bacillus subtilis* DNA for
25–36 degree region containing theamyE-srfA region, complete cds.]
[LE:43480] [RE:44397] [DI:direct]

| ORF Name | NT ID | AA ID | NT LN | AA LN | Score | P-Value |
|---|---|---|---|---|---|---|
| AI7503000987__26306568_c1__724 | 1565 | 5337 | 330 | 109 | 83 | 0.019 |

Description
gp:[GI:g4894306] [LN:AF065404] [AC:AF065404] [PN:pXO1-90] [OR:*Bacillus
anthracis*] [DB:genpept-bct2] [DE:*Bacillus anthracis* virulence plasmid PX01,
complete sequence.] [LE:106772] [RE:108730] [DI:direct]

| ORF Name | NT ID | AA ID | NT LN | AA LN | Score | P-Value |
|---|---|---|---|---|---|---|
| AI7503000987__26350125_c2__834 | 1566 | 5338 | 252 | 83 | 79 | 0.041 |

Description
pir:[LN:C69161] [AC:C69161] [PN:sensory transduction histidine kinase]
[GN:MTH468] [OR:*Methanobacterium thermoautotrophicum*] [DB:pir2]
>gp:[GI:g2621537] [LN:AE000831] [AC:AE000831:AE000666] [PN:sensory
transduction histidine kinase] [GN:MTH468] [OR:*Methanobacterium
thermoautotrophicum*] [DB:genpept-bct1] [DE:*Methanobacterium
thermoautotrophicum* from bases 404817 to 415582(section 37 of 148) of the
complete genome.] [NT:Function Code:12.12 - Cell Processes, Broad] [LE:3329]
[RE:4993] [DI:complement]

| ORF Name | NT ID | AA ID | NT LN | AA LN | Score | P-Value |
|---|---|---|---|---|---|---|
| AI7503000987__26360327_c1__725 | 1567 | 5339 | 552 | 183 | 515 | 2.0e−49 |

Description
pir:[LN:T00186] [AC:T00186] [PN:dUTP pyrophosphatase,] [OR:*Staphylococcus
aureus phage phi* PVL] [EC:3.6.1.23] [DB:pir3] >gp:[GI:d1032887:g3341960]
[LN:AB009866] [AC:AB009866] [PN:dUTPase] [OR:*bacteriophage phi* PVL]
[SR:*bacteriophage phi* PVL (specific_host:*Staphylococcus aureus* ATC]
[DB:genpept-phg] [DE:*Bacteriophage phi* PVL proviral DNA, complete sequence.]
[NT:orf 53] [LE:37579] [RE:38106] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987_26369082_c2_837 | 1568 | 5340 | 252 | 83 | | |

Description
NO-HIT

| ORF Name | NT ID | AA ID | NT LN | AA LN | Score | P-Value |
|---|---|---|---|---|---|---|
| AI7503000987_26375952_c1_714 | 1569 | 5341 | 627 | 208 | 223 | 1.7e−18 |

Description
gp:[GI:e1254413:g2924242] [LN:BTP901456] [AC:Y14232] [PN:hypothetical protein] [OR:*Bacteriophage* TP901-1] [DB:genpept-phg] [DE:*Bacteriophage* TP901-1 ORFs 1–12.] [NT:ORF11] [LE:5545] [RE:6168] [DI:direct]

| ORF Name | NT ID | AA ID | NT LN | AA LN | Score | P-Value |
|---|---|---|---|---|---|---|
| AI7503000987_26569377_c2_810 | 1570 | 5342 | 639 | 212 | 625 | 4.4e−61 |

Description
sp:[LN:HUMS_BACSU] [AC:P42405:O31477] [GN:YCKG] [OR:*BACILLUS SUBTILIS*]
[EC:4.1.2.-] [DE:3-HEXULOSE 6-PHOSPHATE FORMALDEHYDE LYASE)]
[SP:P42405:O31477] [DB:swissprot] >pir:[LN:A69761] [AC:A69761]
[PN:D-arabino 3-hexulose 6-phosphate formaldeh homolog yckG] [GN:yckG]
[OR:*Bacillus subtilis*] [DB:pir2] >gp:[GI:e1182298:g2632632] [LN:BSUB0002]
[AC:Z99105:AL009126] [GN:yckG] [FN:unknown] [OR:*Bacillus subtilis*]
[DB:genpept-bct1] [DE:*Bacillus subtilis* complete genome (section 2 of 21):
from 194651 to415810.] [NT:similar to D-arabino 3-hexulose 6-phosphate]
[SP:P42405] [LE:180087] [RE:180719] [DI:complement]

| ORF Name | NT ID | AA ID | NT LN | AA LN | Score | P-Value |
|---|---|---|---|---|---|---|
| AI7503000987_26734625_f1_89 | 1571 | 5343 | 351 | 116 | 210 | 4.1e−17 |

Description
gp:[GI:e308969:g2292761] [LN:BSFI21LYS] [AC:X95646] [PN:cI-like repressor]
[GN:orf127] [OR:*Streptococcus thermophilus bacteriophage* Sfi21]
[DB:genpept-phg] [DE:*Streptococcus thermophilus bacteriophage* Sfi21 DNA;
lysogenymodule, 8141 bp.] [NT:putative] [LE:5693] [RE:6076] [DI:complement]

| ORF Name | NT ID | AA ID | NT LN | AA LN | Score | P-Value |
|---|---|---|---|---|---|---|
| AI7503000987_26772801_f1_91 | 1572 | 5344 | 504 | 167 | 168 | 6.1e−12 |

Description
pir:[LN:A71608] [AC:A71608] [PN:probable integral membrane protein
PFB0710c] [GN:PFB0710c] [OR:*Plasmodium falciparum*] [DB:pir2]
>gp:[GI:g3845257] [LN:AE001413] [AC:AE001413:AE001362] [PN:predicted
integral membrane protein] [GN:PFB0710c] [OR:*Plasmodium falciparum*]
[SR:malaria parasite *P. falciparum*] [DB:genpept-inv2] [DE:*Plasmodium
falciparum* chromosome 2, section 50 of 73 of thecomplete sequence.]
[NT:predicted by GlimmerM] [LE:4351] [RE:5562] [DI:complement]

| ORF Name | NT ID | AA ID | NT LN | AA LN | Score | P-Value |
|---|---|---|---|---|---|---|
| AI7503000987_26839638_c1_750 | 1573 | 5345 | 1314 | 437 | 1429 | 2.8e−146 |

Description
sp:[LN:YWFO_BACSU] [AC:P39651] [GN:YWFO:IPA-93D] [OR:*BACILLUS SUBTILIS*]
[DE:HYPOTHETICAL 51.0 KD PROTEIN IN PTA 3'REGION] [SP:P39651] [DB:swissprot]
>pir:[LN:G70056] [AC:G70056:S39748] [PN:ywfO protein:hypothetical protein
ipa-93d] [GN:ywfO] [OR:*Bacillus subtilis*] [DB:pir2]
>gp:[GI:e1186260:g2636296] [LN:BSUB0020] [AC:Z99123:AL009126] [GN:ywfO]
[FN:unknown] [OR:*Bacillus subtilis*] [DB:genpept-bct1] [DE:*Bacillus subtilis*
complete genome (section 20 of 21): from 3798401to 4010550.] [NT:alternate
gene name: ipa-93d; similar to] [SP:P39651] [LE:59934] [RE:61235]
[DI:complement] >gp:[GI:e267329:g1561567] [LN:BSUWFO] [AC:Z80355]
[PN:Unknown] [GN:ywfO] [OR:*Bacillus subtilis*] [DB:genpept-bct1]
[DE:*B.subtilis* ywfO, ywgA and ywgB genes.] [SP:P39651] [LE:267] [RE:1568]
[DI:direct]

| ORF Name | NT ID | AA ID | NT LN | AA LN | Score | P-Value |
|---|---|---|---|---|---|---|
| AI7503000987_26854757_c3_886 | 1574 | 5346 | 660 | 219 | 975 | 3.6e−98 |

Description
sp:[LN:CYSE_STAXY] [AC:P77985] [GN:CYSE] [OR:*STAPHYLOCOCCUS XYLOSUS*]
[EC:2.3.1.30] [DE:*SERINE ACETYLTRANSFERASE*, (SAT)] [SP:P77985]
[DB:swissprot] >gp:[GI:e261410:g1514656] [LN:SXCYSEREG] [AC:Y07614]
[PN:serine O-acetyltransferase] [GN:cysE] [OR:*Staphylococcus xylosus*]

-continued

[DB:genpept-bct1] [EC:2.3.1.30] [DE:*S.xylosus* cysE gene, genomic region.]
[SP:P77985] [LE:707] [RE:1357] [DI:direct]

| ORF Name | NT ID | AA ID | NT LN | AA LN | Score | P-Value |
|---|---|---|---|---|---|---|
| AI7503000987_27318_c2_877 | 1575 | 5347 | 1035 | 344 | 1198 | 8.3e−122 |

Description
sp:[LN:ADH1_ZYMMO] [AC:P20368] [GN:ADHA] [OR:*ZYMOMONAS MOBILIS*] [EC:1.1.1.1]
[DE:ALCOHOL DEHYDROGENASE I, (ADH I)] [SP:P20368] [DB:swissprot]
>pir:[LN:A35260] [AC:A35260:E40649:A24801] [PN:alcohol dehydrogenase, 1]
[GN:adhA] [CL:alcohol dehydrogenase:long-chain alcohol dehydrogenase
homology] [OR:*Zymomonas mobilis*] [EC:1.1.1.1] [DB:pir1] >gp:[GI:g155571]
[LN:ZMOADHA] [AC:M32100] [OR:*Zymomonas mobilis*] [SR:*Z.mobilis* (strain CP4)
DNA] [DB:genpept-bct1] [DE:*Z.mobilis* alcohol dehydrogenase I (adhA) gene,
complete cds.] [NT:alcohol dehydrogenase I (adhA) (EC 1.1.1.1)] [LE:218]
[RE:1231] [DI:direct]

| ORF Name | NT ID | AA ID | NT LN | AA LN | Score | P-Value |
|---|---|---|---|---|---|---|
| AI7503000987_276590_c2_821 | 1576 | 5348 | 375 | 124 | 279 | 2.0e−24 |

Description
pir:[LN:H70070] [AC:H70070] [PN:hypothetical protein ywzC] [GN:ywzC]
[OR:*Bacillus subtilis*] [DB:pir2] >gp:[GI:e1186261:g2636297] [LN:BSUB0020]
[AC:Z99123:AL009126] [GN:ywzC] [FN:unknown] [OR:*Bacillus subtilis*]
[DB:genpept-bct1] [DE:*Bacillus subtilis* complete genome (section 20 of 21):
from 3798401to 4010550.] [LE:61397] [RE:61621] [DI:complement]

| ORF Name | NT ID | AA ID | NT LN | AA LN | Score | P-Value |
|---|---|---|---|---|---|---|
| AI7503000987_2847887_f2_351 | 1577 | 5349 | 576 | 191 | 797 | 2.6e−79 |

Description
sp:[LN:ARSB_STAAU] [AC:P30329] [GN:ARSB] [OR:*STAPHYLOCOCCUS AUREUS*]
[DE:ARSENICAL PUMP MEMBRANE PROTEIN] [SP:P30329] [DB:swissprot]
>pir:[LN:C41903] [AC:C41903] [PN:arsenical pump membrane protein] [GN:arsB]
[CL:arsenical pump membrane protein] [OR:*Staphylococcus aureus*] [DB:pir1]
>gp:[GI:g150728] [LN:PI2ARSRBC] [AC:M86824] [PN:arsenic efflux pump protein]
[GN:arsB] [FN:arsenic efflux pump component (membrane) [OR:Plasmid pI258]
[SR:Plasmid pI258 DNA] [DB:genpept-bct1] [DE:Plasmid pI258 arsenic
resistance operon (arsRBC) genes, completecds.] [LE:587] [RE:1876]
[DI:direct]

| ORF Name | NT ID | AA ID | NT LN | AA LN | Score | P-Value |
|---|---|---|---|---|---|---|
| AI7503000987_29320127_f3_442 | 1578 | 5350 | 135 | 44 | | |

Description
NO-HIT

| ORF Name | NT ID | AA ID | NT LN | AA LN | Score | P-Value |
|---|---|---|---|---|---|---|
| AI7503000987_29694425_f1_142 | 1579 | 5351 | 852 | 283 | 418 | 3.8e−39 |

Description
gp:[GI:g1502421] [LN:BSU59433] [AC:U59433] [PN:3-ketoacyl-acyl carrier
protein reductase] [GN:fabG] [OR:*Bacillus subtilis*] [DB:genpept-bct2]
[DE:*Bacillus subtilis* PlsX (plsX), malonyl-CoA:Acyl carrier
proteintransacylase (fabD) and 3-ketoacyl-acyl carrier protein
reductase(fabG) genes, complete cds, and acyl carrier protein (acpP)
gene,partial cds.] [NT:also called 3-oxoacyl-acyl carrier protein] [LE:1813]
[RE:2553] [DI:direct]

| ORF Name | NT ID | AA ID | NT LN | AA LN | Score | P-Value |
|---|---|---|---|---|---|---|
| AI7503000987_30178137_c1_706 | 1580 | 5352 | 132 | 43 | | |

Description
NO-HIT

| ORF Name | NT ID | AA ID | NT LN | AA LN | Score | P-Value |
|---|---|---|---|---|---|---|
| AI7503000987_30267937_f3_532 | 1581 | 5353 | 123 | 40 | | |

Description
NO-HIT

-continued

| ORF Name | NT ID | AA ID | NT LN | AA LN | Score | P-Value |
|---|---|---|---|---|---|---|
| AI7503000987_30742332_c2_841 | 1582 | 5354 | 228 | 75 | 76 | 0.012 |

Description
pir:[LN:D71169] [AC:D71169] [PN:hypothetical protein PH0552] [GN:PH0552] [OR:*Pyrococcus horikoshii*] [DB:pir2] >gp:[GI:d1030584:g3256958] [LN:AP000002] [AC:AP000002:AB009475:AB009476:AB009477:AB009478:AB009479:AB009480] [PN:163aa long hypothetical protein] [GN:PH0552] [OR:*Pyrococcus horikoshii*] [SR:*Pyrococcus horikoshii* (strain:OT3) DNA] [DB:genpept-bct1] [DE:*Pyrococcus horikoshii* OT3 genomic DNA, 287001–544000 nt. position(2/7).] [NT:similar to PIR:F64411 percent identity:33.898 in] [LE:205880] [RE:206371] [DI:direct]

| ORF Name | NT ID | AA ID | NT LN | AA LN | Score | P-Value |
|---|---|---|---|---|---|---|
| AI7503000987_31256916_c2_774 | 1583 | 5355 | 507 | 168 | 681 | 5.1e−67 |

Description
pir:[LN:S38871] [AC:S38871] [PN:ribosomal protein L11] [GN:rplK] [CL:*Escherichia coli* ribosomal protein L11] [OR:*Staphylococcus carnosus*] [DB:pir2] >gp:[GI:g581638] [LN:SCSECE] [AC:X76134] [PN:L11 protein] [GN:rplK] [OR:*Staphylococcus carnosus*] [DB:genpept-bct1] [DE:*S.carnosus* secE, nusG and rplK genes.] [SP:P36254] [LE:1061] [RE:1483] [DI:direct]

| ORF Name | NT ID | AA ID | NT LN | AA LN | Score | P-Value |
|---|---|---|---|---|---|---|
| AI7503000987_31334838_c3_993 | 1584 | 5356 | 519 | 172 | 544 | 1.7e−52 |

Description
pir:[LN:E70057] [AC:E70057] [PN:hypothetical protein ywhD] [GN:ywhD] [OR:*Bacillus subtilis*] [DB:pir2] >gp:[GI:e267625:g1565239] [LN:BSTHRZ] [AC:Z80360] [PN:Unknown] [GN:ywhD] [OR:*Bacillus subtilis*] [DB:genpept-bct1] [DE:*B.subtilis* thrZ downstream chromosomal region.] [LE:3358] [RE:3876] [DI:direct] >gp:[GI:e1186252:g2636288] [LN:BSUB0020] [AC:Z99123:AL009126] [GN:ywhD] [FN:unknown] [OR:*Bacillus subtilis*] [DB:genpept-bct1] [DE:*Bacillus subtilis* complete genome (section 20 of 21): from 3798401to 4010550.] [LE:52838] [RE:53356] [DI:complement]

| ORF Name | NT ID | AA ID | NT LN | AA LN | Score | P-Value |
|---|---|---|---|---|---|---|
| AI7503000987_3134386_f3_616 | 1585 | 5357 | 228 | 75 | | |

Description
NO-HIT

| ORF Name | NT ID | AA ID | NT LN | AA LN | Score | P-Value |
|---|---|---|---|---|---|---|
| AI7503000987_31353377_c2_785 | 1586 | 5358 | 474 | 157 | 703 | 2.4e−69 |

Description
gp:[GI:d1039003:g4512400] [LN:AB017508] [AC:AB017508] [GN:rpsG] [OR:*Bacillus halodurans*] [SR:*Bacillus halodurans* (strain:C-125) DNA] [DB:genpept-bct1] [DE:*Bacillus halodurans* C-125 genomic DNA, 32 kb fragment, completecds.] [NT:rpsG homologue (identity of 84% to *B. subtilis*)] [LE:8367] [RE:8837] [DI:direct]

| ORF Name | NT ID | AA ID | NT LN | AA LN | Score | P-Value |
|---|---|---|---|---|---|---|
| AI7503000987_31562_f2_326 | 1587 | 5359 | 123 | 40 | | |

Description
NO-HIT

| ORF Name | NT ID | AA ID | NT LN | AA LN | Score | P-Value |
|---|---|---|---|---|---|---|
| AI7503000987_32031437_c1_736 | 1588 | 5360 | 2706 | 901 | 1163 | 4.3e−118 |

Description
sp:[LN:VG12_BPPZA] [AC:P07537] [GN:12] [OR:*BACTERIOPHAGE* PZA] [DE:PRE-NECK APPENDAGE PROTEIN (LATE PROTEIN GP12)] [SP:P07537] [DB:swissprot] >pir:[LN:WMBP12] [AC:G24831] [PN:gene 12 protein] [GN:12] [CL:phage PZA gene 12 protein] [OR:phage PZA] [DB:pir1] >gp:[GI:g216061] [LN:PZACG] [AC:M11813:M13904:M13905] [PN:pre-neck appendage protein] [OR:*Bacteriophage* PZA] [SR:*Bacteriophage* PZA DNA] [DB:genpept-phg] [DE:*Bacteriophage* PZA (from *B.subtilis*), complete genome.] [LE:11428] [RE:13992] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000987_32251_f1_98 | 1589 | 5361 | 129 | 42 | | |

Description
NO-HIT

| ORF Name | NT ID | AA ID | NT LN | AA LN | Score | P-Value |
|---|---|---|---|---|---|---|
| AI7503000987_32315907_f3_595 | 1590 | 5362 | 126 | 41 | | |

Description
NO-HIT

| ORF Name | NT ID | AA ID | NT LN | AA LN | Score | P-Value |
|---|---|---|---|---|---|---|
| AI7503000987_32595152_c1_739 | 1591 | 5363 | 402 | 133 | | |

Description
NO-HIT

| ORF Name | NT ID | AA ID | NT LN | AA LN | Score | P-Value |
|---|---|---|---|---|---|---|
| AI7503000987_3306563_c1_688 | 1592 | 5364 | 366 | 121 | | |

Description
NO-HIT

| ORF Name | NT ID | AA ID | NT LN | AA LN | Score | P-Value |
|---|---|---|---|---|---|---|
| AI7503000987_33235050_f2_235 | 1593 | 5365 | 507 | 168 | 92 | 0.0014 |

Description
pir:[LN:D70063] [AC:D70063] [PN:hypothetical protein ywnA] [GN:ywnA]
[OR:*Bacillus subtilis*] [DB:pir2] >gp:[GI:e1184569:g2636188] [LN:BSUB0019]
[AC:Z99122:AL009126] [GN:ywnA] [FN:unknown] [OR:*Bacillus subtilis*]
[DB:genpept-bct1] [DE:*Bacillus subtilis* complete genome (section 19 of 21):
from 3597091to 3809700.] [LE:168142] [RE:168543] [DI:complement]
>gp:[GI:e269486:g1592697] [LN:BSUEROP] [AC:Y08559] [PN:Unknown] [GN:ywnA]
[OR:*Bacillus subtilis*] [DB:genpept-bct1] [DE:*B.subtilis* urease operon and
downstream DNA.] [LE:2688] [RE:3089] [DI:direct] >gp:[GI:e1184569:g2636188]
[LN:BSUB0019] [AC:Z99122:AL009126] [GN:ywnA] [FN:unknown] [OR:*Bacillus
subtilis*] [DB:genpept] [DE:*Bacillus subtilis* complete genome (section 19 of
21): from 3597091to 3809700.] [LE:168142] [RE:168543] [DI:complement]

| ORF Name | NT ID | AA ID | NT LN | AA LN | Score | P-Value |
|---|---|---|---|---|---|---|
| AI7503000987_33394062_f1_179 | 1594 | 5366 | 129 | 42 | | |

Description
NO-HIT

| ORF Name | NT ID | AA ID | NT LN | AA LN | Score | P-Value |
|---|---|---|---|---|---|---|
| AI7503000987_33414693_c2_820 | 1595 | 5367 | 1089 | 362 | 150 | 6.9e−16 |

Description
sp:[LN:KIME_METJA] [AC:Q58487] [GN:MJ1087] [OR:*METHANOCOCCUS JANNASCHII*]
[EC:2.7.1.36] [DE:*MEVALONATE KINASE*, (MK)] [SP:Q58487] [DB:swissprot]
>pir:[LN:F64435] [AC:F64435] [PN:mevalonate kinase,] [OR:*Methanococcus
jannaschii*] [EC:2.7.1.36] [DB:pir2] [MP:FOR1026197-1027135]
>gp:[GI:g1591731] [LN:U67551] [AC:U67551:L77117] [PN:*mevalonate kinase*]
[GN:MJ1087] [OR:*Methanococcus jannaschii*] [DB:genpept-bct2]
[DE:*Methanococcus jannaschii* section 93 of 150 of the complete genome.]
[NT:similar to PID:1184118 SP:Q50559 GB:AE000666] [LE:5625] [RE:6563]
[DI:direct]

| ORF Name | NT ID | AA ID | NT LN | AA LN | Score | P-Value |
|---|---|---|---|---|---|---|
| AI7503000987_33600035_c1_653 | 1596 | 5368 | 2118 | 705 | 3427 | 0.0 |

Description
gp:[GI:e1422302:g4582216] [LN:SAU237696] [AC:AJ237696] [PN:elongation factor
G (EF-G)] [GN:fus] [FN:translation elongation factor] [OR:*Staphylococcus
aureus*] [DB:genpept-bct1] [DE:*Staphylococcus aureus fus* gene.] [LE:83]
[RE:2164] [DI:direct]

| ORF Name | NT ID | AA ID | NT LN | AA LN | Score | P-Value |
|---|---|---|---|---|---|---|
| AI7503000987_33756503_c2_830 | 1597 | 5369 | 273 | 90 | 265 | 6.2e−23 |

-continued

Description
gp:[GI:e1285113:g3005826] [LN:BPA2INT] [AC:Y12813] [PN:hypothetical protein]
[GN:orfB] [OR:*Lactobacillus casei bacteriophage* A2] [DB:genpept-phg]
[DE:*Bacteriophage* A2 rep, xis and int genes.] [LE:852] [RE:1097]
[DI:complement]

| ORF Name | NT ID | AA ID | NT LN | AA LN | Score | P-Value |
|---|---|---|---|---|---|---|
| AI7503000987_33786251_c2_865 | 1598 | 5370 | 246 | 81 | | |

Description
NO-HIT

| ORF Name | NT ID | AA ID | NT LN | AA LN | Score | P-Value |
|---|---|---|---|---|---|---|
| AI7503000987_33869193_c1_726 | 1599 | 5371 | 183 | 60 | 130 | 1.2e−08 |

Description
sp:[LN:RINB_BPPHA] [AC:Q03183] [GN:RINB] [OR:*BACTERIOPHAGE PHI*-11]
[DE:TRANSCRIPTIONAL ACTIVATOR RINB] [SP:Q03183] [DB:swissprot]
>pir:[LN:A49703] [AC:A49703] [PN:int gene activator RinB] [OR:phage phi-11]
[DB:pir2] >gp:[GI:g166161] [LN:BPHRINAB] [AC:L07580] [PN:*Bacteriophage
phi*-11 int gene activator] [GN:rinB] [FN:Activate *bacteriophage phi*-11 int
gene] [OR:*Staphylococcus bacteriophage phi* 11] [SR:*Bacteriophage phi*-11 DNA]
[DB:genpept-phg] [DE:*Bacteriophage phi*-11 rinA and rin B genes, required for
theactivation of *Staphylococcal phage phi*-11 int expression.] [LE:60]
[RE:248] [DI:direct]

| ORF Name | NT ID | AA ID | NT LN | AA LN | Score | P-Value |
|---|---|---|---|---|---|---|
| AI7503000987_34025066_c2_856 | 1600 | 5372 | 642 | 213 | 89 | 8.2e−07 |

Description
gp:[GI:e247172:g1926370] [LN:LBPHIG1E] [AC:X98106] [GN:Rorf232]
[OR:*Bacteriophage phigle*] [DB:genpept-phg] [DE:*Lactobacillus bacteriophage
phigle* complete genomic DNA.] [LE:4579] [RE:5277] [DI:complement]

| ORF Name | NT ID | AA ID | NT LN | AA LN | Score | P-Value |
|---|---|---|---|---|---|---|
| AI7503000987_34242202_c3_956 | 1601 | 5373 | 270 | 89 | 78 | 0.017 |

Description
sp:[LN:VP8_VARV] [AC:P33039] [GN:L4R:M4R] [OR:*VARIOLA* VIRUS] [DE:STRUCTURAL
PROTEIN VP8 PRECURSOR (25 KD MAJOR CORE PROTEIN) (P25K)] [SP:P33039]
[DB:swissprot] >pir:[LN:A36845] [AC:A36845:533090] [PN:M4R protein:structural protein VP8] [CL:vaccinia virus 28K protein] [OR:variola virus] [DB:pir2] >gp:[GI:g262435] [LN:S55844] [AC:S55844] [PN:glycoprotein VP8] [GN:L4R] [OR:*Variola major* virus] [SR:*Variola major* virus India-1967] [DB:genpept-vr1] [DE:G9R . . . H7R [*variola major* virus, India-1967, Genomic, 19 genes,18029 nt].] [NT:This sequence comes from FIG. 2.] [LE:3187] [RE:3942] [DI:direct] >gp:[GI:g438994] [LN:VARCG] [AC:L22579] [OR:*Variola major* virus] [SR:*Variola major* virus (strain Bangladesh-1975) DNA] [DB:genpept-vr1] [DE:*Variola major* virus (strain Bangladesh-1975) complete genome.] [NT:homolog of vaccinia virus CDS L4R (structural] [LE:70583] [RE:71338] [DI:direct] >gp:[GI:g297256] [LN:VVCGAA] [AC:X69198] [GN:M4R] [OR:*Variola* virus] [DB:genpept-vr1] [DE:*Variola* virus DNA complete genome.] [SP:P33039] [LE:69950] [RE:70705] [DI:direct] >gp:[GI:g62352] [LN:VVHINDQKH] [AC:X67119] [PN:structural protein VP8] [GN:L4R COP] [OR:*Variola* virus] [DB:genpept-vr1] [DE:*Variola* virus (HindIII-Q,K,H,M,L,I,F genome fragment) genes.] [SP:P33039] [LE:19835] [RE:20590] [DI:direct]

| ORF Name | NT ID | AA ID | NT LN | AA LN | Score | P-Value |
|---|---|---|---|---|---|---|
| AI7503000987__34242202__f1__156 | 1602 | 5374 | 210 | 69 | 69 | 0.047 |

Description
sp:[LN:Y076__MYCPN] [AC:P75555] [OR:*MYCOPLASMA PNEUMONIAE*] [DE:HYPOTHETICAL PROTEIN MG076 HOMOLOG] [SP:P75555] [DB:swissprot] >pir:[LN:S73943] [AC:S73943] [PN:MG076 homolog G07__orf138] [OR:*Mycoplasma pneumoniae*] [SR:ATCC 29342, , ATCC 29342] [SR:ATCC 29342,] [DB:pir2] >gp:[GI:g1674320] [LN:MPAE000059] [AC:AE000059:U00089] [GN:G07__orf138] [OR:*Mycoplasma pneumoniae*] [DB:genpept-bct2] [DE:*Mycoplasma pneumoniae* section 59 of 63 of the complete genome.] [NT:MG076 homolog, from *M. genitalium*] [LE:168] [RE:584] [DI:direct]

| ORF Name | NT ID | AA ID | NT LN | AA LN | Score | P-Value |
|---|---|---|---|---|---|---|
| AI7503000987__34407053__f3__433 | 1603 | 5375 | 783 | 260 | 564 | 1.3e−54 |

-continued

Description
pir:[LN:S76797] [AC:S76797] [PN:hypothetical protein] [CL:conserved
hypothetical protein MJ0165: phosphoribosylaminoimidazole carboxylase
catalytic chain homology] [OR:*Synechocystis* sp.] [SR:PCC 6803, , PCC 6803]
[SR:PCC 6803,] [DB:pir2] >gp:[GI:d1019442:g1653798] [LN:D90916]
[AC:D90916:AB001339] [PN:hypothetical protein] [OR:*Synechocystis* sp.]
[SR:*Synechocystis* sp. (strain:PCC6803) DNA] [DB:genpept-bct1]
[DE:*Synechocystis* sp. PCC6803 complete genome, 26/27, 3270710–3418851.]
[NT:ORF_ID:s111489] [LE:107538] [RE:108377] [DI:complement]

| ORF Name | NT ID | AA ID | NT LN | AA LN | Score | P-Value |
|---|---|---|---|---|---|---|
| AI7503000987_34609703_c3_963 | 1604 | 5376 | 198 | 65 | 110 | 1.6e−06 |

Description
pir:[LN:T00185] [AC:T00185] [PN:hypothetical protein 52] [OR:*Staphylococcus
aureus phage phi* PVL] [DB:pir3] >gp:[GI:d1032886:g3341959] [LN:AB009866]
[AC:AB009866] [OR:*bacteriophage phi* PVL] [SR:*bacteriophage phi* PVL
(specific_host:*Staphylococcus aureus* ATC] [DB:genpept-phg] [DE:*Bacteriophage
phi* PVL proviral DNA, complete sequence.] [NT:orf 52] [LE:37356] [RE:37604]
[DI:direct]

| ORF Name | NT ID | AA ID | NT LN | AA LN | Score | P-Value |
|---|---|---|---|---|---|---|
| AI7503000987_34651555_c1_734 | 1605 | 5377 | 3123 | 1040 | 267 | 2.8e−24 |

Description
gp:[GI:e244718:g2764872] [LN:BSPP1GENM] [AC:X97918] [OR:*Bacteriophage* SPP1]
[DB:genpept-phg] [DE:*Bacteriophage* SPP1 complete nucleotide sequence.]
[NT:gene 18] [LE:12264] [RE:13373] [DI:direct]

| ORF Name | NT ID | AA ID | NT LN | AA LN | Score | P-Value |
|---|---|---|---|---|---|---|
| AI7503000987_35162800_c3_885 | 1606 | 5378 | 1506 | 501 | 1701 | 4.2e−175 |

Description
sp:[LN:SYE_BACSU] [AC:P22250] [GN:GLTX] [OR:*BACILLUS SUBTILIS*] [EC:6.1.1.17]
[DE:(GLURS)] [SP:P22250] [DB:swissprot] >pir:[LN:SYBSET]
[AC:A36090:S66121:E69635] [PN:glutamate--tRNA ligase, gltX:glutamyl-tRNA
synthetase gltX] [GN:gltX] [CL:glutamate--tRNA ligase:glutamine--tRNA
ligase homology] [OR:*Bacillus subtilis*] [EC:6.1.1.17] [DB:pir1]
>gp:[GI:d1005868:g467480] [LN:BAC180K] [AC:D26185] [PN:glutamyl-tRNA
synthetase] [GN:gltX] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:174646] [RE:176097]
[DI:direct] >gp:[GI:g143006] [LN:BACGLTXA] [AC:M55073:J05647] [PN:transfer
RNA-Gln synthetase] [GN:gltX] [OR:*Bacillus subtilis*] [SR:*Bacillus subtilis*
168T DNA] [DB:genpept-bct1] [EC:6.1.1.17] [DE:*Bacillus subtilis*
glutamyl-tRNA synthetase gene, complete cds.] [LE:1] [RE:1452] [DI:direct]
>gp:[GI:g289282] [LN:BACGLUSYN] [AC:L14580] [PN:glutamyl-tRNA synthetase]
[GN:gltX] [OR:*Bacillus subtilis*] [SR:*Bacillus subtilis* (strain 168T) DNA]
[DB:genpept-bct1] [DE:*Bacillus subtilis* glutamyl-tRNA transferase (gltX),
serineacetyltransferase (cysE), and cysteinyl-tRNA synthetase (cysS)genes,
complete cds's.] [LE:1706] [RE:3157] [DI:direct] >gp:[GI:e1182025:g2632359]
[LN:BSUB0001] [AC:Z99104:AL009126] [PN:glutamyl-tRNA synthetase] [GN:gltX]
[OR:*Bacillus subtilis*] [DB:genpept-bct1] [EC:6.1.1.17] [DE:*Bacillus subtilis*
complete genome (section 1 of 21): from 1 to213080.] [SP:P22250] [LE:111044]
[RE:112495] [DI:direct] >gp:[GI:g2653659] [LN:U49789] [AC:U49789]
[PN:glutamyl-tRNA synthetase] [OR:*Bacillus subtilis*] [DB:genpept-bct2]
[DE:*Bacillus subtilis* glutamyl-tRNA synthetase gene, complete cds.] [LE:1]
[RE:1452] [DI:direct]

| ORF Name | NT ID | AA ID | NT LN | AA LN | Score | P-Value |
|---|---|---|---|---|---|---|
| AI7503000987_35350062_f2_317 | 1607 | 5379 | 141 | 46 | | |

Description
NO-HIT

| ORF Name | NT ID | AA ID | NT LN | AA LN | Score | P-Value |
|---|---|---|---|---|---|---|
| AI7503000987_35445875_c1_728 | 1608 | 5380 | 159 | 52 | 53 | 0.016 |

Description
pir:[LN:C70306] [AC:C70306] [PN:conserved hypothetical protein aq_064c]
[GN:aq_064c] [CL:conserved hypothetical secreted protein HP0320]
[OR:*Aquifex aeolicus*] [DB:pir2] >gp:[GI:g2982828] [LN:AE000672]
[AC:AE000672:AE000657] [PN:hypothetical protein] [GN:aq_064c] [OR:*Aquifex
aeolicus*] [DB:genpept-bct2] [DE:*Aquifex aeolicus* section 4 of 109 of the -continued

| ORF Name | NT ID | AA ID | NT LN | AA LN | Score | P-Value |
|---|---|---|---|---|---|---|
| AI7503000987_36054813_c2_833 | 1609 | 5381 | 387 | 128 | 79 | 0.034 |

Description
pir:[LN:S41186] [AC:S43812:S41186] [PN:gene 39 protein] [OR:phage SPP1]
[DB:pir2] >gp:[GI:e244746:g2764918] [LN:BSPP1GENM] [AC:X97918]
[OR:*Bacteriophage* SPP1] [DB:genpept-phg] [DE:*Bacteriophage* SPP1 complete
nucleotide sequence.] [NT:gene 39] [LE:36342] [RE:36722] [DI:direct]
>gp:[GI:g439643] [LN:BSSPP1] [AC:X67865] [GN:39] [OR:*Bacteriophage* SPP1]
[DB:genpept-phg] [DE:*B.subtilis* phage SPP1 DNA sequence coding for products
required forreplication initiation.] [LE:6073] [RE:6453] [DI:direct]

| ORF Name | NT ID | AA ID | NT LN | AA LN | Score | P-Value |
|---|---|---|---|---|---|---|
| AI7503000987_36134715_c3_887 | 1610 | 5382 | 771 | 256 | 666 | 2.0e−65 |

Description
sp:[LN:YACO_BACSU] [AC:Q06753] [GN:YACO] [OR:*BACILLUS SUBTILIS*] [EC:2.1.1.-]
[DE:HYPOTHETICAL TRNA/RRNA METHYLTRANSFERASE YACO,] [SP:Q06753]
[DB:swissprot] >pir:[LN:S66124] [AC:S66124:G69741:I40000] [PN:conserved
hypothetical protein yacO] [GN:yacO] [CL:conserved hypothetical protein
HI0860] [OR:*Bacillus subtilis*] [DB:pir2] >gp:[GI:d1005871:g467483]
[LN:BAC180K] [AC:D26185] [PN:unknown] [OR:*Bacillus subtilis*] [SR:*Bacillus
subtilis* (sub_species:Marburg, strain:168) DNA] [DB:genpept-bct1] [DE:*B.
subtilis* DNA, 180 kilobase region of replication origin.] [LE:178868]
[RE:179617] [DI:direct] >gp:[GI:e1182029:g2632363] [LN:BSUB0001]
[AC:Z99104:AL009126] [GN:yacO] [FN:unknown] [OR:*Bacillus subtilis*]
[DB:genpept-bct1] [DE:*Bacillus subtilis* complete genome (section 1 of 21):
from 1 to213080.] [NT:similar to hypothetical proteins] [SP:Q06753]
[LE:115266] [RE:116015] [DI:direct]

| ORF Name | NT ID | AA ID | NT LN | AA LN | Score | P-Value |
|---|---|---|---|---|---|---|
| AI7503000987_36228563_c3_960 | 1611 | 5383 | 699 | 232 | 110 | 0.00063 |

Description
gp:[GI:g2865254] [LN:AF008237] [AC:AF008237:L28928:L28929:L28930:L28931]
[PN:unknown] [OR:*Mitochondrion Chlamydomonas eugametos*] [SR:*Chlamydomonas
eugametos*] [DB:genpept-pln2] [DE:*Chlamydomonas eugametos* mitochondrion,
complete genome.] [NT:orf306; intronic ORF; formerly i3; in frame with]
[LE:<8260] [RE:9180] [DI:direct]

| ORF Name | NT ID | AA ID | NT LN | AA LN | Score | P-Value |
|---|---|---|---|---|---|---|
| AI7503000987_36521067_f3_540 | 1612 | 5384 | 204 | 67 | | |

Description
NO-HIT

| ORF Name | NT ID | AA ID | NT LN | AA LN | Score | P-Value |
|---|---|---|---|---|---|---|
| AI7503000987_3908462_c1_703 | 1613 | 5385 | 144 | 47 | | |

Description
NO-HIT

| ORF Name | NT ID | AA ID | NT LN | AA LN | Score | P-Value |
|---|---|---|---|---|---|---|
| AI7503000987_3909643_f2_217 | 1614 | 5386 | 1197 | 398 | 719 | 4.8e−71 |

Description
gp:[GI:g4981502] [LN:AE001759] [AC:AE001759:AE000512] [PN:conserved
hypothetical protein] [GN:TM0964] [OR:*Thermotoga maritima*] [DB:genpept-bct2]
[DE:*Thermotoga maritima* section 71 of 136 of the complete genome.]
[NT:similar to GP:2622211 percent identity: 60.38;] [LE:5733] [RE:6941]
[DI:direct]

| ORF Name | NT ID | AA ID | NT LN | AA LN | Score | P-Value |
|---|---|---|---|---|---|---|
| AI7503000987_3912503_c1_698 | 1615 | 5387 | 1500 | 499 | 331 | 1.5e−28 |

Description
pir:[LN:E69825] [AC:E69825] [PN:amino acid transporter homolog yhdG]
[GN:yhdG] [CL:*arginine permease*] [OR:*Bacillus subtilis*] [DB:pir2]
>gp:[GI:e1182947:g2633281] [LN:BSUB0006] [AC:Z99109:AL009126] [GN:yhdG]
[FN:unknown] [OR:*Bacillus subtilis*] [DB:genpept-bct1] [DE:*Bacillus subtilis*

-continued complete genome (section 6 of 21): from 999501 to1209940.] [NT:similar to amino acid transporter] [LE:23330] [RE:24727] [DI:direct] >gp:[GI:e325026:g2226202] [LN:BSY14082] [AC:Y14082] [PN:hypothetical protein] [GN:yhdG] [OR:*Bacillus subtilis*] [DB:genpept-bct1] [DE:*Bacillus subtilis* chromosomal DNA, region 72 to 75 degrees: spoVRto sspB.] [NT:Similarity to human retroviral receptor (PIR) [LE:9978] [RE:11375] [DI:direct]

| ORF Name | NT ID | AA ID | NT LN | AA LN | Score | P-Value |
|---|---|---|---|---|---|---|
| AI7503000987__3945333__c2__782 | 1616 | 5388 | 168 | 55 | | |

Description
NO-HIT

| ORF Name | NT ID | AA ID | NT LN | AA LN | Score | P-Value |
|---|---|---|---|---|---|---|
| AI7503000987__3961590__c3__922 | 1617 | 5389 | 1164 | 387 | 669 | 9.5e−66 |

Description
pir:[LN:H69831] [AC:H69831] [PN:acetyl-CoA C-acetyltransferase homolog yhfS] [GN:yhfS] [OR:*Bacillus subtilis*] [DB:pir2] >gp:[GI:e1183037:g2633371] [LN:BSUB0006] [AC:Z99109:AL009126] [GN:yhfS] [FN:unknown] [OR:*Bacillus subtilis*] [DB:genpept-bct1] [DE:*Bacillus subtilis* complete genome (section 6 of 21): from 999501 to1209940.] [NT:similar to acetyl-CoA C-acetyltransferase] [LE:109360] [RE:110454] [DI:complement] >gp:[GI:e324998:g2226255] [LN:BSY14084] [AC:Y14084] [PN:hypothetical protein] [GN:yhfS] [OR:*Bacillus subtilis*] [DB:genpept-bct1] [DE:*B.subtilis* chromosomal DNA, region 78–80 degrees: aprE to comK.] [NT:similarity to acetyl-CoAuacetyltransferases (ThiL,] [LE:3788] [RE:4882] [DI:complement]

| ORF Name | NT ID | AA ID | NT LN | AA LN | Score | P-Value |
|---|---|---|---|---|---|---|
| AI7503000987__39635__f2__316 | 1618 | 5390 | 1245 | 414 | 972 | 7.4e−98 |

Description
sp:[LN:YKGC_ECOLI] [AC:P77212] [GN:YKGC] [OR:*ESCHERICHIA COLI*] [DE:INTERGENIC REGION] [SP:P77212] [DB:swissprot] >pir:[LN:H64756] [AC:H64756] [PN:probable mercury(II) reductase,;ykgC protein] [GN:ykgC] [OR:*Escherichia coli*] [EC:1.16.1.1] [DB:pir2] >gp:[GI:g1657503] [LN:ECU73857] [AC:U73857] [OR:*Escherichia coli*] [DB:genpept-bct1] [DE:*Escherichia coli* chromosome minutes 6–8.] [NT:similar to *S. aureus* mercury(II) reductase] [LE:26473] [RE:27825] [DI:complement] >gp:[GI:g1786495] [LN:AE000137] [AC:AE000137:U00096] [PN:putative oxidoreductase] [GN:ykgC] [FN:putative enzyme; Not classified] [OR:*Escherichia coli*] [DB:genpept-bct2] [DE:*Escherichia coli* K-12 MG1655 section 27 of 400 of the completegenome.] [NT:f450; 35 pct identical (29 gaps) to 430 residues of] [LE:6292] [RE:7644] [DI:complement]

| ORF Name | NT ID | AA ID | NT LN | AA LN | Score | P-Value |
|---|---|---|---|---|---|---|
| AI7503000987__4031952__c2__775 | 1619 | 5391 | 501 | 166 | 545 | 1.3e−52 |

Description
pir:[LN:D69695] [AC:D69695] [PN:ribosomal protein L10 (BL5) rplJ] [GN:rplJ] [CL:*Escherichia coli* ribosomal protein L10] [OR:*Bacillus subtilis*] [DB:pir2] >gp:[GI:d1009473:g786163] [LN:BACRPL2] [AC:D50303] [PN:Ribosomal Protein L10] [GN:rplJ] [OR:*Bacillus subtilis*] [SR:*Bacillus subtilis* (strain:168) DNA] [DB:genpept-bct1] [DE:*Bacillus subtilis* genes for ribosomal proteins L1, L10 and L12,partial and complete cds.] [LE:347] [RE:847] [DI:direct] >gp:[GI:e1182037:g2632371] [LN:BSUB0001] [AC:Z99104:AL009126] [PN:ribosomal protein L10 (BL5)] [GN:rplJ] [OR:*Bacillus subtilis*] [DB:genpept-bct1] [DE:*Bacillus subtilis* complete genome (section 1 of 21): from 1 to213080.] [SP:P42923] [LE:120057] [RE:120557] [DI:direct]

| ORF Name | NT ID | AA ID | NT LN | AA LN | Score | P-Value |
|---|---|---|---|---|---|---|
| AI7503000987__40676__c1__644 | 1620 | 5392 | 183 | 60 | | |

Description
NO-HIT

| ORF Name | NT ID | AA ID | NT LN | AA LN | Score | P-Value |
|---|---|---|---|---|---|---|
| AI7503000987__4078305__c3__927 | 1621 | 5393 | 126 | 41 | | |

Description
NO-HIT

| ORF Name | NT ID | AA ID | NT LN | AA LN | Score | P-Value |
|---|---|---|---|---|---|---|
| AI7503000987_4078375_f1_6 | 1622 | 5394 | 129 | 42 | | |

Description
NO-HIT

| ORF Name | NT ID | AA ID | NT LN | AA LN | Score | P-Value |
|---|---|---|---|---|---|---|
| AI7503000987_4078518_f1_143 | 1623 | 5395 | 843 | 280 | 521 | 4.6e−50 |

Description
sp:[LN:YXEK_BACSU] [AC:P54950] [GN:YXEK:LP9C] [OR:*BACILLUS SUBTILIS*]
[DE:HYPOTHETICAL 49.3 KD PROTEIN IN IDH-DEOR INTERGENIC REGION] [SP:P54950]
[DB:swissprot] >pir:[LN:E70075] [AC:E70075] [PN:monooxygenase homolog yxeK]
[GN:yxeK] [CL:nitrilotriacetate monooxygenase] [OR:*Bacillus subtilis*]
[DB:pir2] >gp:[GI:e1184677:g2636498] [LN:BSUB0021] [AC:Z99124:AL009126]
[GN:yxeK] [FN:unknown] [OR:*Bacillus subtilis*] [DB:genpept-bct1] [DE:*Bacillus
subtilis* complete genome (section 21 of 21): from 3999281to 4214814.]
[NT:similar to monooxygenase] [SP:P54950] [LE:60328] [RE:61653]
[DI:complement] >gp:[GI:d1008923:g1408496] [LN:D45912] [AC:D45912] [GN:yxeK]
[OR:*Bacillus subtilis*] [SR:*Bacillus subtilis* (strain:BGSC 1A1 (Marburg 168;
trpC2)) DNA] [DB:genpept-bct1] [DE:*Bacillus subtilis* genome sequence between
the iol and hut operon,partial and complete cds.] [NT:homologous to dszA
gene product of *Rhodococcus* sp.] [LE:9823] [RE:11148] [DI:direct]

| ORF Name | NT ID | AA ID | NT LN | AA LN | Score | P-Value |
|---|---|---|---|---|---|---|
| AI7503000987_4181527_c1_720 | 1624 | 5396 | 447 | 148 | 93 | 0.0045 |

Description
sp:[LN:V17_BPT7] [AC:P03781] [GN:1.7] [OR:*BACTERIOPHAGE* T7] [DE:GENE 1.7
PROTEIN] [SP:P03781] [DB:swissprot] >pir:[LN:W1BP77]
[AC:G43002:G43004:S42296:A04406] [PN:gene 1.7 protein] [GN:1.7] [CL:phage
T7 gene 1.7 protein] [OR:phage T7] [DB:pir1] [MP:20.42−21.89]
>gp:[GI:g15512] [LN:PET7XX] [AC:V01127] [OR:*Bacteriophage* T7]
[DB:genpept-phg] [DE:Left end of *bacteriophage* T7 genome. Includes the
reading frames ofthe genes 0.3, 0.4, 0.5, 0.6, 0.65, 0.7, 1, 1.1, 1.2, 1.3
(earlyproteins) and 1.4, 1.5, 1.6, 1.7, 2, 2.5, 2.8, 3, 3.5, 4A and 4B(late
proteins). Gene 1 is the T7 RNA polymerase.] [NT:1.7 protein] [SP:P03781]
[LE:8166] [RE:8756] [DI:direct] >gp:[GI:g15576] [LN:T7CG]
[AC:V01146:J02518:X00411] [OR:*Bacteriophage* T7] [DB:genpept-phg] [DE:Genome
of *bacteriophage* T7.] [NT:gene 1.7] [SP:P03781] [LE:8166] [RE:8756]
[DI:direct]

| ORF Name | NT ID | AA ID | NT LN | AA LN | Score | P-Value |
|---|---|---|---|---|---|---|
| AI7503000987_4181577_c3_955 | 1625 | 5397 | 1251 | 416 | 465 | 3.9e−44 |

Description
pir:[LN:H70427] [AC:H70427] [PN:replicative DNA helicase] [GN:dnaB]
[CL:phage P22 gene 12 protein] [OR:*Aquifex aeolicus*] [DB:pir2]
>gp:[GI:g2983861] [LN:AE000742] [AC:AE000742:AE000657] [PN:replicative DNA
helicase] [GN:dnaB] [OR:*Aquifex aeolicus*] [DB:genpept-bct2] [DE:*Aquifex
aeolicus* section 74 of 109 of the complete genome.] [LE:2249] [RE:3655]
[DI:direct]

| ORF Name | NT ID | AA ID | NT LN | AA LN | Score | P-Value |
|---|---|---|---|---|---|---|
| AI7503000987_4329063_c3_900 | 1626 | 5398 | 1245 | 414 | 1786 | 4.1e−184 |

Description
gp:[GI:d1039005:g4512402] [LN:AB017508] [AC:AB017508] [GN:tufA] [OR:*Bacillus
halodurans*] [SR:*Bacillus halodurans* (strain:C-125) DNA] [DB:genpept-bct1]
[DE:*Bacillus halodurans* C-125 genomic DNA, 32 kb fragment, completecds.]
[NT:tufA homologue (identity of 91% to *B. subtilis*)] [LE:11150] [RE:12340]
[DI:direct]

| ORF Name | NT ID | AA ID | NT LN | AA LN | Score | P-Value |
|---|---|---|---|---|---|---|
| AI7503000987_4334510_c2_822 | 1627 | 5399 | 135 | 44 | | |

Description
NO-HIT

| ORF Name | NT ID | AA ID | NT LN | AA LN | Score | P-Value |
|---|---|---|---|---|---|---|
| AI7503000987_4398453_f3_561 | 1628 | 5400 | 477 | 158 | 279 | 4.5e−24 |

-continued

Description
sp:[LN:NTAA_CHEHE] [AC:P54989] [GN:NTAA:NMOA] [OR:*CHELATOBACTER HEINTZII*]
[EC:1.14.13.-] [DE:MONOOXYGENASE COMPONENT A) (NTA-MO A)] [SP:P54989]
[DB:swissprot] >gp:[GI:g1119211] [LN:CBYNMOB] [AC:L49438] [GN:nmoA]
[FN:component A of NTA monooxygenase] [OR:*Chelatobacter heintzii*]
[DB:genpept-bct1] [DE:*Chelatobacter heintzii* NTA monooxygenase component B
(nmoB), NTAmonooxygenase component A (nmoA), regulatory protein (nmoR)
andtransposase (nmoT) genes, complete cds.] [LE:1323] [RE:2684] [DI:direct]
>gp:[GI:g1480205] [LN:CHU39411] [AC:U39411] [PN:NTA monooxygenase component
A] [GN:ntaA] [OR:*Chelatobacter heintzii*] [SR:*Chelatobacter heintzii*
strain=ATCC 29600] [DB:genpept-bct1] [DE:*Chelatobacter heintzii*
nitrilotriacetate monooxygenase genes,putative regulatory protein (ntaR),
NTA monooxygenase component A(ntaA) and component B (ntaB) genes, complete
cds.] [LE:1123] [RE:2484] [DI:complement]

| ORF Name | NT ID | AA ID | NT LN | AA LN | Score | P-Value |
|---|---|---|---|---|---|---|
| AI7503000987_446062_c1_748 | 1629 | 5401 | 690 | 229 | 1165 | 2.6e−118 |

Description
sp:[LN:TRA2_STAAU] [AC:P19380] [OR:*STAPHYLOCOCCUS AUREUS*] [DE:TRANSPOSASE
FOR INSERTION SEQUENCE-LIKE ELEMENT IS431MEC] [SP:P19380] [DB:swissprot]
>pir:[LN:S12093] [AC:S12093:JU0116] [PN:probable transposase]
[OR:*Staphylococcus aureus*] [DB:pir2] >gp:[GI:g46602] [LN:SAIS431M]
[AC:X53818:M18438] [OR:*Staphylococcus aureus*] [DB:genpept-bct1] [DE:*S.
aureus* IS431mec gene associated with methicillin resistance.] [NT:putative
transposase (AA 1–224)] [SP:P19380] [LE:272] [RE:946] [DI:direct]
>gp:[GI:e1237900:g2791991] [LN:SAMECAR1I] [AC:Y14051] [PN:putative
transposase] [OR:*Staphylococcus aureus*] [DB:genpept-bct1] [DE:*Staphylococcus
aureus* mecA, mecR1, mecI genes and ORF168, ORF142,ORF44, ORF145 and ORF224.]
[NT:ORF224] [LE:8096] [RE:8770] [DI:direct] >gp:[GI:d1046034:g5360858]
[LN:D86934] [AC:D86934] [PN:transposase for insertion sequence-like element]
[OR:*Staphylococcus aureus*] [SR:*Staphylococcus aureus* (strain:N315) DNA,
clone_lib:library of N31] [DB:genpept] [DE:*Staphylococcus aureus* genes, mec
region, partial and complete cds.] [NT:ORF N062] [LE:48054] [RE:48728]
[DI:direct] >gp:[GI:d1046044:g5360868] [LN:D86934] [AC:D86934]
[PN:transposase for insertion sequence-like element] [OR:*Staphylococcus
aureus*] [SR:*Staphylococcus aureus* (strain:N315) DNA, clone_lib:library of
N31] [DB:genpept] [DE:*Staphylococcus aureus* genes, mec region, partial and
complete cds.] [NT:ORF N070] [LE:53400] [RE:54074] [DI:direct]

| ORF Name | NT ID | AA ID | NT LN | AA LN | Score | P-Value |
|---|---|---|---|---|---|---|
| AI7503000987_4725006_c3_981 | 1630 | 5402 | 537 | 178 | | |

Description
NO-HIT

| ORF Name | NT ID | AA ID | NT LN | AA LN | Score | P-Value |
|---|---|---|---|---|---|---|
| AI7503000987_4727203_c3_925 | 1631 | 5403 | 369 | 122 | 86 | 0.032 |

Description
gp:[GI:d1004088:g505029] [LN:MUSMNS1] [AC:D14849] [PN:meiosis-specific
nuclear structural protein 1] [OR:*Mus musculus*] [SR:*Mus mucsulus* (strain
ddY) testis pachytene spermatocyte cDNA t] [DB:genpept-rod] [DE:Mouse mRNA
for meiosis-specific nuclear structural protein 1(MNS1), complete cds.]
[LE:180] [RE:1655] [DI:direct]

| ORF Name | NT ID | AA ID | NT LN | AA LN | Score | P-Value |
|---|---|---|---|---|---|---|
| AI7503000987_4735833_f2_359 | 1632 | 5404 | 711 | 236 | 464 | 5.0e−44 |

Description
sp:[LN:YAAG_BACSU] [AC:P37530] [GN:YAAG] [OR:*BACILLUS SUBTILIS*]
[DE:HYPOTHETICAL 24.1 KD PROTEIN IN SERS-DNAZ INTERGENIC REGION] [SP:P37530]
[DB:swissprot] >pir:[LN:S66045] [AC:S66045:G69736] [PN:deoxypurine kinase
subunit homolog yaaG] [GN:yaaG] [CL:*Lactobacillus acidophilus*
deoxyadenosine kinase] [OR:*Bacillus subtilis*] [DB:pir2]
>gp:[GI:d1005793:g467405] [LN:BAC180K] [AC:D26185] [PN:unknown] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:86746] [RE:87369] [DI:complement] >gp:[GI:e1181948:g2632282]
[LN:BSUB0001] [AC:Z99104:AL009126] [GN:yaaG] [FN:unknown] [OR:*Bacillus
subtilis*] [DB:genpept-bct1] [DE:*Bacillus subtilis* complete genome (section 1
of 21): from 1 to213080.] [NT:similar to deoxypurine kinase subunit]
[SP:P37530] [LE:23144] [RE:23767] [DI:complement]

| ORF Name | NT ID | AA ID | NT LN | AA LN | Score | P-Value |
|---|---|---|---|---|---|---|
| AI7503000987_4741068_c3_967 | 1633 | 5405 | 609 | 202 | 210 | 4.1e−17 |

Description
gp:[GI:e247154:g1926352] [LN:LBPHIG1E] [AC:X98106] [PN:minor capsid protein] [GN:Rorf204] [OR:*Bacteriophage phigle*] [DB:genpept-phg] [DE:*Lactobacillus bacteriophage phigle* complete genomic DNA.] [LE:24554] [RE:25168] [DI:complement]

| ORF Name | NT ID | AA ID | NT LN | AA LN | Score | P-Value |
|---|---|---|---|---|---|---|
| AI7503000987_4741077_c3_952 | 1634 | 5406 | 687 | 228 | 238 | 4.5e−20 |

Description
gp:[GI:e247139:g1926334] [LN:LBPHIG1E] [AC:X98106] [GN:Rorf242] [OR:*Bacteriophage phigle*] [DB:genpept-phg] [DE:*Lactobacillus bacteriophage phigle* complete genomic DNA.] [LE:37600] [RE:38328] [DI:complement]

| ORF Name | NT ID | AA ID | NT LN | AA LN | Score | P-Value |
|---|---|---|---|---|---|---|
| AI7503000987_4876967_c3_913 | 1635 | 5407 | 579 | 192 | 168 | 1.2e−12 |

Description
pir:[LN:G69824] [AC:G69824] [PN:conserved hypothetical protein yhdA] [GN:yhdA] [OR:*Bacillus subtilis*] [DB:pir2] >gp:[GI:e1182923:g2633257] [LN:BSUB0005] [AC:Z99108:AL009126] [GN:yhdA] [FN:unknown] [OR:*Bacillus subtilis*] [DB:genpept-bct1] [DE:*Bacillus subtilis* complete genome (section 5 of 21): from 802821 to1011250.] [NT:similar to hypothetical proteins] [LE:207082] [RE:207606] [DI:direct] >gp:[GI:e1182935:g2633269] [LN:BSUB0006] [AC:Z99109:AL009126] [GN:yhdA] [FN:unknown] [OR:*Bacillus subtilis*] [DB:genpept-bct1] [DE:*Bacillus subtilis* complete genome (section 6 of 21): from 999501 to1209940.] [NT:similar to hypothetical proteins] [LE:10402] [RE:10926] [DI:direct] >gp:[GI:e324946:g2226142] [LN:BSY14079] [AC:Y14079] [PN:hypothetical protein] [GN:yhdA] [OR:*Bacillus subtilis*] [DB:genpept-bct1] [DE:*Bacillus subtilis* chromosomal DNA, region 75 degrees: glpPFKDoperon and downstream.] [NT:similarity to the hypothetical protein YIEF from] [LE:10050] [RE:10574] [DI:direct]

| ORF Name | NT ID | AA ID | NT LN | AA LN | Score | P-Value |
|---|---|---|---|---|---|---|
| AI7503000987_4882760_c3_1001 | 1636 | 5408 | 183 | 60 | | |

Description
NO-HIT

| ORF Name | NT ID | AA ID | NT LN | AA LN | Score | P-Value |
|---|---|---|---|---|---|---|
| AI7503000987_4886075_f3_559 | 1637 | 5409 | 678 | 225 | 794 | 5.4e−79 |

Description
sp:[LN:YAAF_BACSU] [AC:P37529] [GN:YAAF] [OR:*BACILLUS SUBTILIS*] [DE:HYPOTHETICAL 25.4 KD PROTEIN IN SERS-DNAZ INTERGENIC REGION] [SP:P37529] [DB:swissprot] >pir:[LN:S66044] [AC:S66044:F69736] [PN:deoxypurine kinase subunit homolog yaaF] [GN:yaaF] [CL:*Lactobacillus acidophilus* deoxyadenosine kinase] [OR:*Bacillus subtilis*] [DB:pir2] >gp:[GI:d1005792:g467404] [LN:BAC180K] [AC:D26185] [PN:unknown] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:86096] [RE:86749] [DI:complement] >gp:[GI:e1181947:g2632281] [LN:BSUB0001] [AC:Z99104:AL009126] [GN:yaaF] [FN:unknown] [OR:*Bacillus subtilis*] [DB:genpept-bct1] [DE:*Bacillus subtilis* complete genome (section 1 of 21): from 1 to213080.] [NT:similar to deoxypurine kinase subunit] [SP:P37529] [LE:22494] [RE:23147] [DI:complement]

| ORF Name | NT ID | AA ID | NT LN | AA LN | Score | P-Value |
|---|---|---|---|---|---|---|
| AI7503000987_4892127_c1_746 | 1638 | 5410 | 2706 | 901 | 1557 | 7.6e−160 |

Description
pir:[LN:H69780] [AC:H69780] [PN:antibiotic transport-associated protein homolog ydfJ] [GN:ydfJ] [OR:*Bacillus subtilis*] [DB:pir2] >gp:[GI:d1020130:g1881350] [LN:AB001488] [AC:AB001488] [GN:ydfJ] [OR:*Bacillus subtilis*] [SR:*Bacillus subtilis* (strain:168) DNA] [DB:genpept-bct1] [DE:*Bacillus subtilis* genome sequence, 148 kb sequence of the regionbetween 35 and 47 degree.] [NT:PROBABLE TRANSPORT PROTEIN, SIMILAR TO ANTIBIOTIC] [LE:122935] [RE:125109] [DI:direct] >gp:[GI:e1182509:g2632843] [LN:BSUB0003] [AC:Z99106:AL009126] [GN:ydfJ] [FN:unknown] [OR:*Bacillus subtilis*] [DB:genpept-bct1] [DE:*Bacillus subtilis*

-continued complete genome (section 3 of 21): from 402751 to611850.] [NT:similar to antibiotic transport-associated protein] [LE:186681] [RE:188855] [DI:direct]

| ORF Name | NT ID | AA ID | NT LN | AA LN | Score | P-Value |
|---|---|---|---|---|---|---|
| AI7503000987_4901703_c2_792 | 1639 | 5411 | 510 | 169 | 95 | 0.0031 |

Description
pir:[LN:D69887] [AC:D69887] [PN:conserved hypothetical protein ynaD] [GN:ynaD] [OR:*Bacillus subtilis*] [DB:pir2] >gp:[GI:g1750115] [LN:BSU66480] [AC:U66480] [PN:YnaD] [GN:ynaD] [OR:*Bacillus subtilis*] [DB:genpept-bct1] [DE:*Bacillus subtilis* SpoVK (spoVK), YnbA (ynbA), YnbB (ynbB), GlnR(glnR), glutamine synthetase (glnA), YnaA (ynaA), YnaB (ynaB), YnaC(ynaC), YnaD (ynaD), YnaE (ynaE), YnaF (ynaF), YnaG (ynaG), YnaH(ynaH), YnaI (ynaI), YnaJ (ynaJ), xylan beta-1,4-xylosidase (xynB),xylose repressor (xylR), xylose isomerase (xylA), xylulose kinase(xylB), YncB (yncB), YncC (yncC), YncD (yncD) and YncE (yncE)genes, complete cds.] [LE:9169] [RE:9681] [DI:direct] >gp:[GI:e1183411:g2634136] [LN:BSUB0010] [AC:Z99113:AL009126] [GN:ynaD] [FN:unknown] [OR:*Bacillus subtilis*] [DB:genpept-bct1] [DE:*Bacillus subtilis* complete genome (section 10 of 21): from 1781201to 2014980.] [NT:similar to hypothetical proteins] [LE:101220] [RE:101732] [DI:direct]

| ORF Name | NT ID | AA ID | NT LN | AA LN | Score | P-Value |
|---|---|---|---|---|---|---|
| AI7503000987_4946962_c3_907 | 1640 | 5412 | 1068 | 355 | 183 | 1.0e-11 |

Description
gp:[GI:g3264834] [LN:AF072541] [AC:AF072541] [PN:xylitol dehydrogenase] [GN:xdh] [FN:xylose utilisation] [OR:*Galactocandida mastotermitis*] [DB:genpept-pln2] [EC:1.1.1.9] [DE:*Galactocandida mastotermitis* xylitol dehydrogenase (xdh) gene,complete cds.] [NT:a member of the medium chain dehydrogenase] [LE:301:373] [RE:312:1422] [DI:directJoin]

| ORF Name | NT ID | AA ID | NT LN | AA LN | Score | P-Value |
|---|---|---|---|---|---|---|
| AI7503000987_4964677_c2_832 | 1641 | 5413 | 444 | 147 | 257 | 4.3e-22 |

Description
pir:[LN:T00179] [AC:T00179] [PN:ssDNA-binding protein] [OR:*Staphylococcus aureus* phage phi PVL] [DB:pir3] >gp:[GI:d1032880:g3341953] [LN:AB009866] [AC:AB009866] [PN:ssDNA binding protein] [OR:*bacteriophage phi* PVL] [SR:*bacteriophage phi* PVL (specific_host:*Staphylococcus aureus* ATC] [DB:genpept-phg] [DE:*Bacteriophage phi* PVL proviral DNA, complete sequence.] [NT:orf 45] [LE:34657] [RE:35127] [DI:direct]

| ORF Name | NT ID | AA ID | NT LN | AA LN | Score | P-Value |
|---|---|---|---|---|---|---|
| AI7503000987_5080092_c2_809 | 1642 | 5414 | 744 | 247 | 529 | 6.5e-51 |

Description
sp:[LN:YBFT_BACSU] [AC:O31458] [GN:YBFT] [OR:*BACILLUS SUBTILIS*] [DE:HYPOTHETICAL 27.3 KD PROTEIN IN GLTP-CWLJ INTERGENIC REGION] [SP:O31458] [DB:swissprot] >pir:[LN:E69750] [AC:E69750] [PN:glucosamine-6-phosphate isomerase homolog ybfT] [GN:ybfT] [CL:glucosamine-6-phosphate isomerase] [OR:*Bacillus subtilis*] [DB:pir2] >gp:[GI:d1034099:g3599658] [LN:AB006424] [AC:AB006424] [GN:ybfT] [OR:*Bacillus subtilis*] [SR:*Bacillus subtilis* (strain:168) DNA] [DB:genpept-bct1] [DE:*Bacillus subtilis* genomic DNA, 70 kb region between 17 and 23degree.] [LE:59813] [RE:60562] [DI:complement] >gp:[GI:e1182188:g2632522] [LN:BSUB0002] [AC:Z99105:AL009126] [GN:ybfT] [FN:unknown] [OR:*Bacillus subtilis*] [DB:genpept-bct1] [DE:*Bacillus subtilis* complete genome (section 2 of 21): from 194651 to415810.] [NT:similar to glucosamine-6-phosphate isomerase] [SP:O31458] [LE:62162] [RE:62911] [DI:complement]

| ORF Name | NT ID | AA ID | NT LN | AA LN | Score | P-Value |
|---|---|---|---|---|---|---|
| AI7503000987_5125076_f3_531 | 1643 | 5415 | 810 | 269 | 873 | 2.3e-87 |

Description
sp:[LN:YWFI_BACSU] [AC:P39645] [GN:YWFI:IPA-87R] [OR:*BACILLUS SUBTILIS*] [DE:HYPOTHETICAL 29.5 KD PROTEIN IN ROCC-PTA INTERGENIC REGION] [SP:P39645] [DB:swissprot] >pir:[LN:S39742] [AC:S39742:B70056] [PN:ywfI protein:hypothetical protein ipa-87r] [GN:ywfI] [OR:*Bacillus subtilis*] [DB:pir2] >gp:[GI:g414011] [LN:BSGENR] [AC:X73124] [GN:ipa-87r] [OR:*Bacillus subtilis*] [DB:genpept-bct1] [DE:*B.subtilis* genomic region (325 to 333).] [SP:P39645] [LE:90200] [RE:90964] [DI:complement] >gp:[GI:e1186267:g2636303] [LN:BSUB0020] [AC:Z99123:AL009126] [GN:ywfI] [FN:unknown] [OR:*Bacillus subtilis*] [DB:genpept-bct1] [DE:*Bacillus subtilis* complete genome (section 20 of 21): from 3798401to 4010550.] [NT:alternate gene name: ipa-87r;

-continued similar to] [SP:P39645] [LE:66995] [RE:67759] [DI:direct]

| ORF Name | NT ID | AA ID | NT LN | AA LN | Score | P-Value |
|---|---|---|---|---|---|---|
| AI7503000987__5251588__c1__747 | 1644 | 5416 | 582 | 193 | 87 | 0.0010 |

Description
gp:[GI:g1079814] [LN:S79230] [AC:S79230] [PN:BM1P1] [GN:CYP106] [OR:*Bacillus megaterium*] [DB:genpept-bct2] [DE:CYP106=BM1P2 orf . . . CYP106=P450BM-1 orf {regulatory regions}[*Bacillus megaterium*, mRNA Partial, 3 genes, 1400 nt].]
[NT:positive transcription factor involved in] [LE:763] [RE:1059]
[DI:complement]

| ORF Name | NT ID | AA ID | NT LN | AA LN | Score | P-Value |
|---|---|---|---|---|---|---|
| AI7503000987__5258515__c3__965 | 1645 | 5417 | 1314 | 437 | 1298 | 2.1e−132 |

Description
sp:[LN:TERL_BPSPP] [AC:P54308] [GN:2] [OR:*BACTERIOPHAGE* SPP1] [DE:TERMINASE
LARGE SUBUNIT (G2P)] [SP:P54308] [DB:swissprot] >pir:[LN:S24451] [AC:S24451]
[PN:terminase] [OR:phage SPP1] [DB:pir2] >gp:[GI:e244468:g2764840]
[LN:BSPP1GENM] [AC:X97918] [OR:*Bacteriophage* SPP1] [DB:genpept-phg]
[DE:*Bacteriophage* SPP1 complete nucleotide sequence.] [NT:gene 2]
[SP:P54308] [LE:307] [RE:1575] [DI:direct] >gp:[GI:g15466] [LN:NCSPP116]
[AC:X56064:S35313] [PN:terminase] [OR:SPP1 gene 2] [OR:*Bacteriophage* SPP1]
[DB:genpept-phg] [DE:*B. subtilis* bacteriophage SPP1 genes for terminase and
portalprotein.] [SP:P54308] [LE:633] [RE:1901] [DI:direct]

| ORF Name | NT ID | AA ID | NT LN | AA LN | Score | P-Value |
|---|---|---|---|---|---|---|
| AI7503000987__5370450__f3__432 | 1646 | 5418 | 1284 | 427 | 305 | 3.6e−27 |

Description
pir:[LN:A69256] [AC:A69256] [PN:hypothetical protein AF0049]
[OR:*Archaeoglobus fulgidus*] [DB:pir2] >gp:[GI:g2650605] [LN:AE001103]
[AC:AE001103:AE000782] [PN:*A. fulgidus* predicted coding region AF0049]
[GN:AF0049] [OR:*Archaeoglobus fulgidus*] [DB:genpept-bct2] [DE:*Archaeoglobus fulgidus* section 4 of 172 of the complete genome.] [NT:hypothetical protein;
identified by GeneMark;] [LE:7830] [RE:9068] [DI:complement]

| ORF Name | NT ID | AA ID | NT LN | AA LN | Score | P-Value |
|---|---|---|---|---|---|---|
| AI7503000987__56626__c2__855 | 1647 | 5419 | 336 | 111 | 84 | 0.0020 |

Description
gp:[GI:g1209829] [LN:BBU45421] [AC:U45421] [GN:REP+] [OR:*Borrelia burgdorferi*] [SR:Lyme disease spirochete strain=297] [DB:genpept-bct1]
[DE:*Borrelia burgdorferi* 2.9-1 locus, ORF 5–8, ORF-A-D, REP+, REP−,
andlipoprotein (LP) genes, complete cds.] [NT:repeat motif-containing gene]
[LE:4602] [RE:5156] [DI:direct]

| ORF Name | NT ID | AA ID | NT LN | AA LN | Score | P-Value |
|---|---|---|---|---|---|---|
| AI7503000987__587811__f1__125 | 1648 | 5420 | 345 | 114 | | |

Description
NO-HIT

| ORF Name | NT ID | AA ID | NT LN | AA LN | Score | P-Value |
|---|---|---|---|---|---|---|
| AI7503000987__6056625__c1__755 | 1649 | 5421 | 258 | 85 | | |

Description
NO-HIT

| ORF Name | NT ID | AA ID | NT LN | AA LN | Score | P-Value |
|---|---|---|---|---|---|---|
| AI7503000987__6149152__c3__884 | 1650 | 5422 | 1389 | 462 | 1543 | 2.3e−158 |

Description
sp:[LN:RADA_BACSU] [AC:P37572] [GN:RADA:SMS] [OR:*BACILLUS SUBTILIS*] [DE:DNA
REPAIR PROTEIN RADA HOMOLOG (DNA REPAIR PROTEIN SMS HOMOLOG)] [SP:P37572]
[DB:swissprot] >pir:[LN:S66116] [AC:S66116:I40509:A69709] [PN:DNA repair
protein homolog sms] [GN:sms] [CL:DNA repair protein sms] [OR:*Bacillus subtilis*] [DB:pir2] >gp:[GI:d1005863:g467475] [LN:BAC180K] [AC:D26185]
[PN:unknown] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:169695] [RE:171071]
[DI:direct] >gp:[GI:e1182020:g2632354] [LN:BSUB0001] [AC:Z99104:AL009126]

-continued

[PN:DNA repair protein homolog] [GN:sms] [OR:*Bacillus subtilis*]
[DB:genpept-bct1] [DE:*Bacillus subtilis* complete genome (section 1 of 21):
from 1 to213080.] [NT:alternate gene name: yacJ] [SP:P37572] [LE:106093]
[RE:107469] [DI:direct]

| ORF Name | NT ID | AA ID | NT LN | AA LN | Score | P-Value |
|---|---|---|---|---|---|---|
| AI7503000987__6250050__f2__233 | 1651 | 5423 | 147 | 48 | | |

Description
NO-HIT

| ORF Name | NT ID | AA ID | NT LN | AA LN | Score | P-Value |
|---|---|---|---|---|---|---|
| AI7503000987__6406337__f3__448 | 1652 | 5424 | 210 | 69 | | |

Description
NO-HIT

| ORF Name | NT ID | AA ID | NT LN | AA LN | Score | P-Value |
|---|---|---|---|---|---|---|
| AI7503000987__6407136__c2__840 | 1653 | 5425 | 1455 | 484 | 667 | 1.6e−65 |

Description
sp:[LN:SIZ__BPSPP] [AC:P54309] [GN:6:SIZ] [OR:*BACTERIOPHAGE* SPP1] [DE:PORTAL
PROTEIN (PORTAL VERTEX PROTEIN) (GP6)] [SP:P54309] [DB:swissprot]
>pir:[LN:S21805] [AC:S21805:S24455:S36725] [PN:portal protein:gene 6
protein] [GN:6] [OR:phage SPP1] [DB:pir2] >gp:[GI:e244702:g2764847]
[LN:BSPP1GENM] [AC:X97918] [OR:*Bacteriophage* SPP1] [DB:genpept-phg]
[DE:*Bacteriophage* SPP1 complete nucleotide sequence.] [NT:gene 6]
[SP:P54309] [LE:2334] [RE:3845] [DI:direct] >gp:[GI:g15470] [LN:NCSPP116]
[AC:X56064:S35313] [PN:portal protein] [GN:SPP1 gene 6] [OR:*Bacteriophage*
SPP1] [DB:genpept-phg] [DE:*B. subtilis* bacteriophage SPP1 genes for
terminase and portalprotein.] [SP:P54309] [LE:2660] [RE:4171] [DI:direct]

| ORF Name | NT ID | AA ID | NT LN | AA LN | Score | P-Value |
|---|---|---|---|---|---|---|
| AI7503000987__6443763__c2__769 | 1654 | 5426 | 408 | 135 | 298 | 2.0e−26 |

Description
pir:[LN:C69742] [AC:C69742] [PN:conserved hypothetical protein yazC]
[GN:yazC] [OR:*Bacillus subtilis*] [DB:pir2] >gp:[GI:e1182028:g2632362]
[LN:BSUB0001] [AC:Z99104:AL009126] [GN:yazC] [FN:unknown] [OR:*Bacillus
subtilis*] [DB:genpept-bct1] [DE:*Bacillus subtilis* complete genome (section 1
of 21): from 1 to213080.] [NT:similar to hypothetical proteins] [LE:114851]
[RE:115282] [DI:direct]

| ORF Name | NT ID | AA ID | NT LN | AA LN | Score | P-Value |
|---|---|---|---|---|---|---|
| AI7503000987__661062__c1__641 | 1655 | 5427 | 1440 | 479 | 1568 | 5.2e−161 |

Description
sp:[LN:SYC__BACSU] [AC:Q06752] [GN:CYSS:SPNA] [OR:*BACILLUS SUBTILIS*]
[EC:6.1.1.16] [DE:(CYSRS)] [SP:Q06752] [DB:swissprot] >pir:[LN:C53402]
[AC:C53402:S44447:S66123:B69612] [PN:cysteine--tRNA ligase,
cysS:cysteinyl-tRNA synthetase cysS] [GN:cysS] [CL:cysteine--tRNA ligase]
[OR:*Bacillus subtilis*] [EC:6.1.1.16] [DB:pir1] >gp:[GI:d1005870:g467482]
[LN:BAC180K] [AC:D26185] [PN:cysteinyl-tRNA synthetase] [GN:cysS]
[OR:*Bacillus subtilis*] [SR:*Bacillus subtilis* (sub__species:Marburg,
strain:168) DNA] [DB:genpept-bct1] [DE:*B. subtilis* DNA, 180 kilobase region
of replication origin.] [LE:177049] [RE:178449] [DI:direct] >gp:[GI:g289284]
[LN:BACGLUSYN] [AC:L14580] [PN:cysteinyl-tRNA synthetase] [OR:*Bacillus
subtilis*] [SR:*Bacillus subtilis* (strain 168T) DNA] [DB:genpept-bct1]
[DE:*Bacillus subtilis* glutamyl-tRNA transferase (gltX),
serineacetyltransferase (cysE), and cysteinyl-tRNA synthetase (cysS)genes,
complete cds's.] [LE:4109] [RE:5509] [DI:direct] >gp:[GI:g499303] [LN:BSCTS]
[AC:X73989] [PN:cysteine--tRNA ligase] [GN:SPNA/CYSS] [OR:*Bacillus subtilis*]
[DB:genpept-bct1] [EC:6.1.1.16] [DE:*B.subtilis* gene for cysteinyl-tRNA
synthetase.] [SP:Q06752] [LE:321] [RE:1721] [DI:direct]
>gp:[GI:e1182027:g2632361] [LN:BSUB0001] [AC:Z99104:AL009126]
[PN:cysteinyl-tRNA synthetase] [GN:cysS] [OR:*Bacillus subtilis*]
[DB:genpept-bct1] [EC:6.1.1.16] [DE:*Bacillus subtilis* complete genome
(section 1 of 21): from 1 to213080.] [NT:alternate gene name: snpA]
[SP:Q06752] [LE:113447] [RE:114847] [DI:direct]

| ORF Name | NT ID | AA ID | NT LN | AA LN | Score | P-Value |
|---|---|---|---|---|---|---|
| AI7503000987__6725707__c2__770 | 1656 | 5428 | 552 | 183 | 327 | 1.7e−29 |

Description
sp:[LN:YACP_BACSU] [AC:P37574] [GN:YACP] [OR:*BACILLUS SUBTILIS*]
[DE:HYPOTHETICAL 19.7 KD PROTEIN IN CYSS 3'REGION] [SP:P37574]
[DB:swissprot] >pir:[LN:S66125] [AC:S66125:H69741] [PN:conserved
hypothetical protein yacP] [GN:yacP] [OR:*Bacillus subtilis*] [DB:pir2]
>gp:[GI:d1005872:g467484] [LN:BAC180K] [AC:D26185] [PN:unknown] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:179624] [RE:180136] [DI:direct] >gp:[GI:e1182030:g2632364]
[LN:BSUB0001] [AC:Z99104:AL009126] [GN:yacP] [FN:unknown] [OR:*Bacillus
subtilis*] [DB:genpept-bct1] [DE:*Bacillus subtilis* complete genome (section 1
of 21): from 1 to213080.] [NT:similar to hypothetical proteins] [SP:P37574]
[LE:116022] [RE:116534] [DI:direct]

| ORF Name | NT ID | AA ID | NT LN | AA LN | Score | P-Value |
|---|---|---|---|---|---|---|
| AI7503000987_6757338_c3_906 | 1657 | 5429 | 1089 | 362 | 1129 | 1.7e−114 |

Description
pir:[LN:H69750] [AC:H69750] [PN:branched-chain amino acid aminotransferase
homolog ybgE] [GN:ybgE] [CL:branched-chain-amino-acid transaminase BAT1]
[OR:*Bacillus subtilis*] [DB:pir2] >gp:[GI:d1034103:g3599662] [LN:AB006424]
[AC:AB006424] [GN:ybgE] [OR:*Bacillus subtilis*] [SR:*Bacillus subtilis*
(strain:168) DNA] [DB:genpept-bct1] [DE:*Bacillus subtilis* genomic DNA, 70 kb
region between 17 and 23degree.] [LE:62005] [RE:63075] [DI:direct]
>gp:[GI:e1182191:g2632525] [LN:BSUB0002] [AC:Z99105:AL009126] [GN:ybgE]
[FN:unknown] [OR:*Bacillus subtilis*] [DB:genpept-bct1] [DE:*Bacillus subtilis*
complete genome (section 2 of 21): from 194651 to415810.] [NT:similar to
branched-chain amino acid] [LE:64355] [RE:65425] [DI:direct]

| ORF Name | NT ID | AA ID | NT LN | AA LN | Score | P-Value |
|---|---|---|---|---|---|---|
| AI7503000987_6932750_f2_348 | 1658 | 5430 | 378 | 125 | 266 | 4.8e−23 |

Description
pir:[LN:C69906] [AC:C69906] [PN:hypothetical protein yojF] [GN:yojF]
[OR:*Bacillus subtilis*] [DB:pir2] >gp:[GI:e1185419:g2634340] [LN:BSUB0011]
[AC:Z99114:AL009126] [GN:yojF] [FN:unknown] [OR:*Bacillus subtilis*]
[DB:genpept-bct1] [DE:*Bacillus subtilis* complete genome (section 11 of 21):
from 2000171to 2207900.] [LE:121397] [RE:121747] [DI:complement]
>gp:[GI:g3169322] [LN:AF026147] [AC:AF026147] [PN:YojF] [GN:yojF]
[FN:unknown] [OR:*Bacillus subtilis*] [DB:genpept-bct2] [DE:*Bacillus subtilis*
YojA (yojA), YojB (yojB), YojC (yojC), YojD(yojD), YojE (yojE), YojF (yojF),
YojG (yojG), YojH (yojH), YojI(yojI), YojJ (yojJ), YojK (yojK), YojL (yojL),
YojM (yojM), YojN(yojN), and YojO (yojO) genes, complete cds; and OdhA
(odhA) gene,partial cds.] [LE:3518] [RE:3868] [DI:direct]

| ORF Name | NT ID | AA ID | NT LN | AA LN | Score | P-Value |
|---|---|---|---|---|---|---|
| AI7503000987_7032188_f2_246 | 1659 | 5431 | 126 | 41 | | |

Description
NO-HIT

| ORF Name | NT ID | AA ID | NT LN | AA LN | Score | P-Value |
|---|---|---|---|---|---|---|
| AI7503000987_7068751_c3_984 | 1660 | 5432 | 945 | 314 | 974 | 4.6e−98 |

Description
sp:[LN:IOLS_BACSU] [AC:P46336] [GN:IOLS:SS92ER] [OR:*BACILLUS SUBTILIS*]
[DE:IOLS PROTEIN (VEGETATIVE PROTEIN 147) (VEG147)] [SP:P46336]
[DB:swissprot] >pir:[LN:D69646] [AC:D69646] [PN:myo-inositol catabolism
iolS] [GN:iolS] [CL:conserved hypothetical protein YPL088w] [OR:*Bacillus
subtilis*] [DB:pir2] >gp:[GI:d1022457:g904205] [LN:AB005554]
[AC:AB005554:D45242:D31629] [GN:iolS] [OR:*Bacillus subtilis*] [SR:*Bacillus
subtilis* (strain:BGSC 1A1) DNA] [DB:genpept-bct1] [DE:*Bacillus subtilis*
genomic DNA, 36 kb region between gnt and ioloperons.] [NT:plausibly
involved in inositol catabolism] [LE:32539] [RE:33471] [DI:complement]
>gp:[GI:e1184703:g2636524] [LN:BSUB0021] [AC:Z99124:AL009126] [GN:iolS]
[OR:*Bacillus subtilis*] [DB:genpept-bct1] [DE:*Bacillus subtilis* complete
genome (section 21 of 21): from 3999281to 4214814.] [NT:alternate gene name:
yxbF; myo-inositol catabolism [SP:P46336] [LE:85121] [RE:86053] [DI:direct]

| ORF Name | NT ID | AA ID | NT LN | AA LN | Score | P-Value |
|---|---|---|---|---|---|---|
| AI7503000987_7160287_c2_805 | 1661 | 5433 | 126 | 41 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000987_7164191_c2_798 | 1662 | 5434 | 150 | 49 | | |

| Description | | | | | | |
|---|---|---|---|---|---|---|
| NO-HIT | | | | | | |
| ORF Name | NT ID | AA ID | NT LN | AA LN | Score | P-Value |
| AI7503000987_7229680_c1_634 | 1663 | 5435 | 492 | 163 | 377 | 8.3e−35 |

Description
sp:[LN:CTSR_BACSU] [AC:P37568] [GN:CTSR] [OR:*BACILLUS SUBTILIS*]
[DE:TRANSCRIPTIONAL REGULATOR CTSR] [SP:P37568] [DB:swissprot]
>pir:[LN:S66112] [AC:S66112:D69610] [PN:transcription repressor of class
III stress genes ctsR] [GN:ctsR] [OR:*Bacillus subtilis*] [DB:pir2]
>gp:[GI:d1005859:g467471] [LN:BAC180K] [AC:D26185] [PN:unknown] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:165048] [RE:165512] [DI:direct] >gp:[GI:e1182016:g2632350]
[LN:BSUB0001] [AC:Z99104:AL009126] [PN:transcriptional regulator] [GN:ctsR]
[FN:negative regulation of class III stress genes] [OR:*Bacillus subtilis*]
[DB:genpept-bct1] [DE:*Bacillus subtilis* complete genome (section 1 of 21):
from 1 to213080.] [NT:alternate gene name: yacG] [SP:P37568] [LE:101446]
[RE:101910] [DI:direct]

| ORF Name | NT ID | AA ID | NT LN | AA LN | Score | P-Value |
|---|---|---|---|---|---|---|
| AI7503000987_7275263_c1_733 | 1664 | 5436 | 441 | 146 | 158 | 1.3e−11 |

Description
gp:[GI:e244713:g2764865] [LN:BSPP1GENM] [AC:X97918] [OR:*Bacteriophage* SPP1]
[DB:genpept-phg] [DE:*Bacteriophage* SPP1 complete nucleotide sequence.]
[NT:gene 17] [LE:10063] [RE:10467] [DI:direct]

| ORF Name | NT ID | AA ID | NT LN | AA LN | Score | P-Value |
|---|---|---|---|---|---|---|
| AI7503000987_782590_f1_114 | 1665 | 5437 | 171 | 56 | 56 | 0.044 |

Description
gp:[GI:e289995:g1764015] [LN:CICOS41] [AC:Z83760] [PN:COS41.5] [OR:*Ciona
intestinalis*] [DB:genpept-inv1] [DE:*Ciona intestinalis* DNA sequence from
cosmid COS41.] [NT:weak similarity to membrane transport proteins]
[LE:11497:13519:14634] [RE:13190:13703:14681] [DI:complementJoin]

| ORF Name | NT ID | AA ID | NT LN | AA LN | Score | P-Value |
|---|---|---|---|---|---|---|
| AI7503000987_783425_c1_675 | 1666 | 5438 | 165 | 54 | | |

| Description | | | | | | |
|---|---|---|---|---|---|---|
| NO-HIT | | | | | | |
| ORF Name | NT ID | AA ID | NT LN | AA LN | Score | P-Value |
| AI7503000987_818942_c3_989 | 1667 | 5439 | 477 | 158 | 173 | 3.4e−17 |

Description
sp:[LN:OPUC_BACSU] [AC:P46922] [GN:OPUAC] [OR:*BACILLUS SUBTILIS*] [DE:GLYCINE
BETAINE-BINDING PROTEIN PRECURSOR] [SP:P46922] [DB:swissprot]
>pir:[LN:I40537] [AC:I40537:F69669] [PN:glycine betaine ABC transporter
(glycine betaine-binding protein) opuAC precursor] [GN:opuAC] [OR:*Bacillus
subtilis*] [DB:pir2] >gp:[GI:e1182252:g2632586] [LN:BSUB0002]
[AC:Z99105:AL009126] [PN:glycine betaine ABC transporter (glycine]
[GN:opuAC] [FN:glycine betaine transport (osmoprotection)] [OR:*Bacillus
subtilis*] [DB:genpept-bct1] [DE:*Bacillus subtilis* complete genome (section 2
of 21): from 194651 to415810.] [SP:P46922] [LE:128023] [RE:128904]
[DI:direct] >gp:[GI:d1009569:g1805372] [LN:D50453] [AC:D50453] [PN:glycine
betain-binding protein precursor] [GN:opuAC] [OR:*Bacillus subtilis*]
[SR:*Bacillus subtilis* (strain:168 trpC2) DNA] [DB:genpept-bct1] [DE:*Bacillus
subtilis* DNA for 25–36 degree region containing theamyE-srfA region,
complete cds.] [LE:2326] [RE:3207] [DI:direct] >gp:[GI:g984805]
[LN:BSU17292] [AC:U17292] [PN:glycine betaine-binding protein precursor]

-continued

[GN:opuAC] [OR:*Bacillus subtilis*] [DB:genpept-bct2] [DE:*Bacillus subtilis*
ATPase (opuAA), transmembrane protein (opuAB) andglycine betaine-binding
protein precursor (opuAC) genes, completecds.] [LE:2332] [RE:3213]
[DI:direct]

| ORF Name | NT ID | AA ID | NT LN | AA LN | Score | P-Value |
|---|---|---|---|---|---|---|
| AI7503000987_819575_c2_850 | 1668 | 5440 | 1857 | 618 | 158 | 1.4e−08 |

Description
gp:[GI:e247163:g1926361] [LN:LBPHIG1E] [AC:X98106] [GN:Rorf372]
[OR:*Bacteriophage phigle*] [DB:genpept-phg] [DE:*Lactobacillus bacteriophage
phigle* complete genomic DNA.] [LE:13476] [RE:14594] [DI:complement]

| ORF Name | NT ID | AA ID | NT LN | AA LN | Score | P-Value |
|---|---|---|---|---|---|---|
| AI7503000987_821012_c1_664 | 1669 | 5441 | 1725 | 574 | 469 | 6.8e−44 |

Description
pir:[LN:S49240] [AC:S49240] [PN:hypothetical protein 3 (capsulation locus)]
[OR:*Haemophilus influenzae*] [DB:pir2] >gp:[GI:g547513] [LN:HIACAPIID]
[AC:Z37516] [OR:*Haemophilus influenzae*] [DB:genpept-bct1] [DE:*Haemophilus
influenzae* serotype a capsulation locus region II DNA.] [NT:orf3] [LE:2838]
[RE:5207] [DI:direct]

| ORF Name | NT ID | AA ID | NT LN | AA LN | Score | P-Value |
|---|---|---|---|---|---|---|
| AI7503000987_833125_f3_493 | 1670 | 5442 | 285 | 94 | | |

Description
NO-HIT

| ORF Name | NT ID | AA ID | NT LN | AA LN | Score | P-Value |
|---|---|---|---|---|---|---|
| AI7503000987_892842_c3_926 | 1671 | 5443 | 387 | 128 | 337 | 1.4e−30 |

Description
sp:[LN:YWDK_BACSU] [AC:P39619] [GN:YWDK:IPA-61D] [OR:*BACILLUS SUBTILIS*]
[DE:HYPOTHETICAL 12.0 KD PROTEIN IN UNG-ROCA INTERGENIC REGION] [SP:P39619]
[DB:swissprot] >pir:[LN:S39716] [AC:S39716:F70054] [PN:ywdK
protein:hypothetical protein ipa-61d] [GN:ywdK] [OR:*Bacillus subtilis*]
[DB:pir2] >gp:[GI:g413985] [LN:BSGENR] [AC:X73124] [GN:ipa-61d] [OR:*Bacillus
subtilis*] [DB:genpept-bct1] [DE:*B.subtilis* genomic region (325 to 333).]
[SP:P39619] [LE:63169] [RE:63510] [DI:direct] >gp:[GI:e1186292:g2636328]
[LN:BSUB0020] [AC:Z99123:AL009126] [GN:ywdK] [FN:unknown] [OR:*Bacillus
subtilis*] [DB:genpept-bct1] [DE:*Bacillus subtilis* complete genome (section
20 of 21): from 3798401to 4010550.] [NT:alternate gene name: ipa-61d;
similar to] [SP:P39619] [LE:94452] [RE:94793] [DI:complement]

| ORF Name | NT ID | AA ID | NT LN | AA LN | Score | P-Value |
|---|---|---|---|---|---|---|
| AI7503000987_972187_f2_208 | 1672 | 5444 | 924 | 307 | 834 | 3.1e−83 |

Description
gp:[GI:g2689564] [LN:U93688] [AC:U93688] [PN:integrase] [GN:int]
[OR:*Staphylococcus aureus*] [DB:genpept-bct2] [DE:*Staphylococcus aureus* toxic
shock syndrome toxin-1 (tst),enterotoxin (ent), and integrase (int) genes,
complete cds.] [NT:similar to *staphylococcal phage integrase*] [LE:13871]
[RE:15091] [DI:direct]

| ORF Name | NT ID | AA ID | NT LN | AA LN | Score | P-Value |
|---|---|---|---|---|---|---|
| AI7503000987_9765677_c3_949 | 1673 | 5445 | 804 | 267 | 226 | 8.4e−19 |

Description
gp:[GI:g928839] [LN:BK5TATTP] [AC:L44593] [FN:unidentified] [OR:*Lactococcus
lactis phage* BK5-T] [SR:*Bacteriophage* BK5-T DNA] [DB:genpept-phg]
[DE:*Bacteriophage* BK5-T ORF'410, 3' end pf cds, 20 ORFs, repressorprotein,
and Cro repressor protein genes, complete cds, ORF70'gene, 5' end of cds.]
[NT:ORF266; putative] [LE:14882] [RE:15682] [DI:direct]

| ORF Name | NT ID | AA ID | NT LN | AA LN | Score | P-Value |
|---|---|---|---|---|---|---|
| AI7503000987_977181_c1_702 | 1674 | 5446 | 180 | 59 | | |

Description
NO-HIT

-continued

| ORF Name | NT ID | AA ID | NT LN | AA LN | Score | P-Value |
|---|---|---|---|---|---|---|
| AI7503000987_978377_c1_689 | 1675 | 5447 | 264 | 87 | 75 | 0.0037 |

Description
sp:[LN:VG05_VACCC] [AC:P21026] [GN:G5R] [OR:VACCINIA VIRUS] [SR:COPENHAGEN,]
[DE:PROTEIN G5] [SP:P21026] [DB:swissprot] >pir:[LN:A42512] [AC:A42512]
[PN:GSR protein] [OR:vaccinia virus] [DB:pir2] >gp:[GI:g335417] [LN:VACCG]
[AC:M35027] [OR:Vaccinia virus] [SR:Vaccinia virus (strain Copenhagen) DNA,
clone VC-2] [DB:genpept-vr1] [DE:Vaccinia virus, complete genome.] [NT:G5R;
putative] [LE:75218] [RE:76522] [DI:direct]

| ORF Name | NT ID | AA ID | NT LN | AA LN | Score | P-Value |
|---|---|---|---|---|---|---|
| AI7503000987_9819392_c3_908 | 1676 | 5448 | 789 | 262 | 179 | 6.4e−13 |

Description
gp:[GI:g1463023] [LN:CELF45E1] [AC:U28732] [GN:F45E1.3] [OR:*Caenorhabditis
elegans*] [SR:*Caenorhabditis elegans* strain=Bristol N2] [DB:genpept-inv1]
[DE:*Caenorhabditis elegans* cosmid F45E1.] [LE:13873:15298:15662:15851]
[RE:14009:15615:15806:16024] [DI:directJoin]

| ORF Name | NT ID | AA ID | NT LN | AA LN | Score | P-Value |
|---|---|---|---|---|---|---|
| AI7503000987_9924055_c2_765 | 1677 | 5449 | 216 | 71 | | |

Description
NO-HIT

| ORF Name | NT ID | AA ID | NT LN | AA LN | Score | P-Value |
|---|---|---|---|---|---|---|
| AI7503000987_9926903_c2_835 | 1678 | 5450 | 309 | 102 | 79 | 0.0032 |

Description
pir:[LN:F45681] [AC:F45681] [PN:orf 61.2] [OR:phage T2] [DB:pir2]
>gp:[GI:g298525] [LN:S57515] [AC:S57515] [GN:orf 61.2] [OR:coliphage T2]
[DB:genpept-phg] [DE:orf 61.2 {intergenic region between 41 and 61}
[*bacteriophage* T2,Genomic, 323 nt].] [NT:This sequence comes from FIG. A3.]
[LE:12] [RE:323] [DI:direct]

| ORF Name | NT ID | AA ID | NT LN | AA LN | Score | P-Value |
|---|---|---|---|---|---|---|
| AI7503000987_994052_c3_979 | 1679 | 5451 | 1536 | 511 | 130 | 0.00012 |

Description
gp:[GI:g4049717] [LN:AF063866] [AC:AF063866] [PN:ORF MSV156 hypothetical
protein] [GN:MSV156] [OR:*Melanoplus sanguinipes* entomopoxvirus]
[DB:genpept-vr1] [DE:*Melanoplus sanguinipes* entomopoxvirus, complete
genome.] [LE:140126] [RE:143509] [DI:direct]

| ORF Name | NT ID | AA ID | NT LN | AA LN | Score | P-Value |
|---|---|---|---|---|---|---|
| AI7503000988_22939705_c3_35 | 1680 | 5452 | 402 | 133 | 99 | 0.00020 |

Description
gp:[GI:g2689564] [LN:U93688] [AC:U93688] [PN:integrase] [GN:int]
[OR:*Staphylococcus aureus*] [DB:genpept-bct2] [DE:*Staphylococcus aureus* toxic
shock syndrome toxin-1 (tst),enterotoxin (ent), and integrase (int) genes,
complete cds.] [NT:similar to *staphylococcal phage* integrase] [LE:13871]
[RE:15091] [DI:direct]

| ORF Name | NT ID | AA ID | NT LN | AA LN | Score | P-Value |
|---|---|---|---|---|---|---|
| AI7503000988_235762_f2_11 | 1681 | 5453 | 159 | 52 | | |

Description
NO-HIT

| ORF Name | NT ID | AA ID | NT LN | AA LN | Score | P-Value |
|---|---|---|---|---|---|---|
| AI7503000988_23626577_c2_32 | 1682 | 5454 | 210 | 69 | 56 | 0.0035 |

Description
gp:[GI:d1009788:g829068] [LN:SHFORF] [AC:D50601] [PN:ORF10] [OR:*Shigella
sonnei*] [SR:*Shigella sonnei* (individual_isolate HW383) DNA, clone pJK1142]
[DB:genpept-bct1] [DE:*Shigella sonnei* DNA for 26 ORFs, complete cds.]
[LE:5933] [RE:6628] [DI:direct]

-continued

| ORF Name | NT ID | AA ID | NT LN | AA LN | Score | P-Value |
|---|---|---|---|---|---|---|
| AI7503000988_24297062_f1_1 | 1683 | 5455 | 183 | 60 | | |

Description
NO-HIT

| ORF Name | NT ID | AA ID | NT LN | AA LN | Score | P-Value |
|---|---|---|---|---|---|---|
| AI7503000988_24642202_c1_30 | 1684 | 5456 | 648 | 215 | 822 | 5.8e−82 |

Description
gp:[GI:g2689554] [LN:U93688] [AC:U93688] [OR:*Staphylococcus aureus*]
[DB:genpept-bct2] [DE:*Staphylococcus aureus* toxic shock syndrome toxin-1
(tst),enterotoxin (ent), and integrase (int) genes, complete cds.] [NT:orf7]
[LE:6109] [RE:6708] [DI:complement]

| ORF Name | NT ID | AA ID | NT LN | AA LN | Score | P-Value |
|---|---|---|---|---|---|---|
| AI7503000988_25665687_c2_33 | 1685 | 5457 | 876 | 291 | 322 | 5.6e−29 |

Description
gp:[GI:g2689560] [LN:U93688] [AC:U93688] [OR:*Staphylococcus aureus*]
[DB:genpept-bct2] [DE:*Staphylococcus aureus* toxic shock syndrome toxin-1
(tst),enterotoxin (ent) , and integrase (int) genes, complete cds.]
[NT:orf13] [LE:9717] [RE:10004] [DI:complement]

| ORF Name | NT ID | AA ID | NT LN | AA LN | Score | P-Value |
|---|---|---|---|---|---|---|
| AI7503000988_34428905_f1_3 | 1686 | 5458 | 165 | 54 | | |

Description
NO-HIT

| ORF Name | NT ID | AA ID | NT LN | AA LN | Score | P-Value |
|---|---|---|---|---|---|---|
| AI7503000988_35428187_c3_37 | 1687 | 5459 | 438 | 145 | | |

Description
NO-HIT

| ORF Name | NT ID | AA ID | NT LN | AA LN | Score | P-Value |
|---|---|---|---|---|---|---|
| AI7503000988_36601678_c1_29 | 1688 | 5460 | 1728 | 575 | 102 | 0.010 |

Description
gp:[GI:g1004289] [LN:PPRNAE14B] [AC:Z50050] [PN:Xylanase B] [OR:*Penicillium purporogenum*] [DB:genpept-pln1] [EC:3.2.1.8] [DE:*P.purpurogenum* mRNA for endo-1,4-beta-xylanase.] [LE:11] [RE:637] [DI:direct]

| ORF Name | NT ID | AA ID | NT LN | AA LN | Score | P-Value |
|---|---|---|---|---|---|---|
| AI7503000988_4303175_f1_10 | 1689 | 5461 | 180 | 59 | | |

Description
NO-HIT

| ORF Name | NT ID | AA ID | NT LN | AA LN | Score | P-Value |
|---|---|---|---|---|---|---|
| AI7503000988_9923176_f3_20 | 1690 | 5462 | 162 | 53 | 56 | 0.013 |

Description
sp:[LN:NU5M_CAEEL] [AC:P24896] [GN:ND5] [OR:*CAENORHABDITIS ELEGANS*]
[EC:1.6.5.3] [DE:NADH-UBIQUINONE OXIDOREDUCTASE CHAIN 5,] [SP:P24896]
[DB:swissprot] >pir:[LN:S26037] [AC:S26037:S25810] [PN:NADH dehydrogenase
(ubiquinone), chain 5] [GN:ND5] [CL:NADH dehydrogenase (ubiquinone) chain
5] [OR:mitochondrion *Caenorhabditis elegans*] [EC:1.6.5.3] [DB:pir2]
>gp:[GI:g515886] [LN:MTCE] [AC:X54252:S93745] [OR:Mitochondrion
*Caenorhabditis elegans*] [SR:*Caenorhabditis elegans*] [DB:genpept-inv1] [DE:*C. elegans* complete mitochondrial genome.] [NT:ND5 protein (AA 1–527)]
[SP:P24896] [LE:11691] [RE:13274] [DI:direct]

| ORF Name | NT ID | AA ID | NT LN | AA LN | Score | P-Value |
|---|---|---|---|---|---|---|
| AI7503000990_10003756_f3_471 | 1691 | 5463 | 138 | 45 | | |

Description
NO-HIT

-continued

| ORF Name | NT ID | AA ID | NT LN | AA LN | Score | P-Value |
|---|---|---|---|---|---|---|
| AI7503000990__10193763__c2__864 | 1692 | 5464 | 186 | 61 | | |

Description
NO-HIT

| ORF Name | NT ID | AA ID | NT LN | AA LN | Score | P-Value |
|---|---|---|---|---|---|---|
| AI7503000990__10194713__f1__31 | 1693 | 5465 | 147 | 48 | | |

Description
NO-HIT

| ORF Name | NT ID | AA ID | NT LN | AA LN | Score | P-Value |
|---|---|---|---|---|---|---|
| AI7503000990__10241287__c2__822 | 1694 | 5466 | 663 | 220 | 74 | 0.037 |

Description
gp:[GI:g924349] [LN:HIV1U13473] [AC:U13473] [PN:envelope glycoprotein V1V2
region] [GN:env] [OR:Human immunodeficiency virus type 1] [DB:genpept-vrl]
[DE:Human immunodeficiency virus type 1 isolate 037 clone 03 fromUganda,
envelope glycoprotein (env) gene, V1V2 region, partial cds.] [LE:<1]
[RE:>285] [DI:direct]

| ORF Name | NT ID | AA ID | NT LN | AA LN | Score | P-Value |
|---|---|---|---|---|---|---|
| AI7503000990__10268812__c2__820 | 1695 | 5467 | 144 | 47 | | |

Description
NO-HIT

| ORF Name | NT ID | AA ID | NT LN | AA LN | Score | P-Value |
|---|---|---|---|---|---|---|
| AI7503000990__10360902__f3__536 | 1696 | 5468 | 183 | 60 | | |

Description
NO-HIT

| ORF Name | NT ID | AA ID | NT LN | AA LN | Score | P-Value |
|---|---|---|---|---|---|---|
| AI7503000990__1042202__c3__948 | 1697 | 5469 | 1074 | 357 | 625 | 4.4e−61 |

Description
sp:[LN:POTD_ECOLI] [AC:P23861] [GN:POTD] [OR:*ESCHERICHIA COLI*]
[DE:SPERMIDINE/PUTRESCINE-BINDING PERIPLASMIC PROTEIN PRECURSOR (SPBP)]
[SP:P23861] [DB:swissprot] >pir:[LN:D40840] [AC:D40840:H64856]
[PN:spermidine/putrescine-binding protein precursor:spermidine/putrescine
transport protein D] [GN:potD] [OR:*Escherichia coli*] [DB:pir2]
>gp:[GI:d1036929:g1651550] [LN:D90747] [AC:D90747:AB001340]
[PN:Spermidine/putrescine transport protein D] [GN:potD] [OR:*Escherichia
coli*] [SR:*Escherichia coli*(strain:K12) DNA, clone:Kohara clone #238]
[DB:genpept-bct1] [DE:*Escherichia coli* genomic DNA. (25.2–25.6 min).]
[NT:ORF_ID:o238#12; similar to PIR Accession Number] [LE:13470] [RE:14516]
[DI:complement] >gp:[GI:g1787367] [LN:AE000212] [AC:AE000212:U00096]
[PN:spermidine/putrescine periplasmic transport] [GN:potD] [FN:transport;
Transport of small molecules: Amino ] [OR:*Escherichia coli*] [DB:genpept-bct2]
[DE:*Escherichia coli* K-12 MG1655 section 102 of 400 of the completegenome.]
[NT:f348; 100 pct identical to POTD_ECOLI SW: P23861] [LE:7785] [RE:8831]
[DI:complement] >gp:[GI:g147329] [LN:ECOPOTABCD] [AC:M64519] [PN:transport
protein] [GN:potD] [OR:*Escherichia coli*] [SR:*E.coli* (strain DR112) DNA,
clone pPT104] [DB:genpept-bct2] [DE:*E.coli* transport protein (potA, potB,
potC and potD) genes,complete cds.] [LE:3144] [RE:4190] [DI:direct]

| ORF Name | NT ID | AA ID | NT LN | AA LN | Score | P-Value |
|---|---|---|---|---|---|---|
| AI7503000990__10579000__c1__734 | 1698 | 5470 | 957 | 318 | 728 | 5.3e−72 |

Description
sp:[LN:COXX_BACSU] [AC:P24009] [GN:CTAB] [OR:*BACILLUS SUBTILIS*] [DE:PROBABLE
CYTOCHROME C OXIDASE ASSEMBLY FACTOR] [SP:P24009] [DB:swissprot]
>pir:[LN:C69609] [AC:C69609:S14395] [PN:cytochrome caa3 oxidase (assembly
factor) ctaB] [GN:ctaB] [CL:heme O synthase] [OR:*Bacillus subtilis*]
[DB:pir2] >gp:[GI:e334763:g2339991] [LN:BS16823KB] [AC:Z98682] [PN:CtaB
protein] [GN:ctaB] [OR:*Bacillus subtilis*] [DB:genpept-bct1] [DE:*Bacillus
subtilis* genomic DNA 23.9 kB fragment.] [SP:P24009] [LE:4441] [RE:5358]
[DI:direct] >gp:[GI:g994794] [LN:BSCTABF] [AC:X54140] [PN:cytochrome a
assembly facto] [GN:ctaB] [OR:*Bacillus subtilis*] [DB:genpept-bct1]
[EC:1.9.3.1] [DE:*B. subtilis* ctaB-F genes for cytochrome a assembly factor -continued andcytochrome-c oxidase (EC 1.9.3.1) subunits II, I, II, and IVB.]
[NT:putative] [SP:P24009] [LE:408] [RE:1325] [DI:direct]
>gp:[GI:e1185078:g2633859] [LN:BSUB0008] [AC:Z99111:AL009126] [PN:cytochrome
caa3 oxydase assembly factor] [GN:ctaB] [OR:*Bacillus subtilis*]
[DB:genpept-bct1] [DE:*Bacillus subtilis* complete genome (section 8 of 21):
from 1394791to 1603020.] [SP:P24009] [LE:163924] [RE:164841] [DI:direct]

| ORF Name | NT ID | AA ID | NT LN | AA LN | Score | P-Value |
|---|---|---|---|---|---|---|
| AI7503000990_1063753_c2_874 | 1699 | 5471 | 1374 | 457 | 2070 | 3.3e−214 |

Description
sp:[LN:MURD_STAAU] [AC:O33595:O07323] [GN:MURD] [OR:*STAPHYLOCOCCUS AUREUS*]
[EC:6.3.2.9] [DE:ADDING ENZYME)] [SP:O33595:O07323] [DB:swissprot]
>pir:[LN:JC6560] [AC:JC6560] [PN:UDP-N-acetylmuramoylalanine--D-glutamate
ligase, :UDP-N-acetylmuramoyl-L-alanyl-D-glutamate synthetase] [GN:murD]
[OR:*Staphylococcus aureus*] [EC:6.3.2.9] [DB:pir2] >gp:[GI:g2271510]
[LN:AF009671] [AC:AF009671] [PN:UDP-N-acetylmuramoyl-L-alanine:
D-glutamate] [GN:murD] [FN:catalyzes ATP-dependent D-glutamate addition]
[OR:*Staphylococcus aureus*] [DB:genpept-bct2] [DE:*Staphylococcus aureus*
UDP-N-acetylmuramoyl-L-alanine:D-glutamateligase (murD) gene, complete
cds.] [NT:MurD] [LE:1] [RE:1350] [DI:direct]

| ORF Name | NT ID | AA ID | NT LN | AA LN | Score | P-Value |
|---|---|---|---|---|---|---|
| AI7503000990_10740628_f3_637 | 1700 | 5472 | 183 | 60 | | |

Description
NO-HIT

| ORF Name | NT ID | AA ID | NT LN | AA LN | Score | P-Value |
|---|---|---|---|---|---|---|
| AI7503000990_10928_c3_958 | 1701 | 5473 | 1242 | 413 | 239 | 1.1e−17 |

Description
pir:[LN:T03492] [AC:T03492] [PN:hypothetical protein] [OR:*Rhodobacter
capsulatus*] [DB:pir2] [MP:1] >gp:[GI:g3128293] [LN:AF010496] [AC:AF010496]
[PN:hypothetical protein] [OR:*Rhodobacter capsulatus*] [DB:genpept-bct2]
[DE:*Rhodobacter capsulatus* strain SB1003, partial genome.] [LE:54291]
[RE:55613] [DI:complement]

| ORF Name | NT ID | AA ID | NT LN | AA LN | Score | P-Value |
|---|---|---|---|---|---|---|
| AI7503000990_10969052_c3_935 | 1702 | 5474 | 1725 | 574 | 2602 | 1.4e−270 |

Description
sp:[LN:PT1_STAAU] [AC:P51183] [GN:PTSI] [OR:*STAPHYLOCOCCUS AUREUS*]
[EC:2.7.3.9] [DE:(PHOSPHOTRANSFERASE SYSTEM, ENZYME I)] [SP:P51183]
[DB:swissprot] >gp:[GI:g1070386] [LN:SAPTSHI] [AC:X93205]
[PN:phosphoenolpyruvate-protein phosphatase] [GN:ptsI] [OR:*Staphylococcus
aureus*] [DB:genpept-bct1] [EC:2.7.3.9] [DE:*S.aureus* ptsH and ptsI genes.]
[SP:P51183] [LE:462] [RE:2180] [DI:direct]

| ORF Name | NT ID | AA ID | NT LN | AA LN | Score | P-Value |
|---|---|---|---|---|---|---|
| AI7503000990_10972150_c3_1037 | 1703 | 5475 | 2055 | 684 | 3024 | 0.0 |

Description
sp:[LN:RECG_STAAU] [AC:O50581] [GN:RECG] [OR:*STAPHYLOCOCCUS AUREUS*]
[EC:3.6.1.-] [DE:ATP-DEPENDENT DNA HELICASE RECG,] [SP:O50581]
[DB:swissprot] >gp:[GI:d1025491:g2826896] [LN:AB000439] [AC:AB000439]
[PN:RecG] [GN:recG] [OR:*Staphylococcus aureus*] [SR:*Staphylococcus aureus*
(strain:RN4220) DNA] [DB:genpept-bct1] [DE:*Staphylococcus aureus* recG gene,
complete cds.] [LE:319] [RE:2379] [DI:direct]

| ORF Name | NT ID | AA ID | NT LN | AA LN | Score | P-Value |
|---|---|---|---|---|---|---|
| AI7503000990_1173177_f3_667 | 1704 | 5476 | 1053 | 350 | 691 | 4.4e−68 |

Description
sp:[LN:YAAF_ECOLI] [AC:P22564] [GN:YAAF] [OR:*ESCHERICHIA COLI*]
[DE:HYPOTHETICAL 32.6 KD PROTEIN IN LYTB-DAPB INTERGENIC REGION] [SP:P22564]
[DB:swissprot] >pir:[LN:JE0404] [AC:JE0404:S40553:F64723:S22291]
[PN:probable glycosidase, yaaF] [GN:yaaF] [CL:yaaF protein] [OR:*Escherichia
coli*] [EC:3.2.-.-] [DB:pir2] >gp:[GI:g41934] [LN:ECLSPDAP] [AC:X54945]
[GN:ORF 3] [OR:*Escherichia coli*] [DB:genpept-bct1] [DE:*E. coli* lsp-dapB
interval.] [NT:product appears to be membrane bound] [SP:P22564] [LE:1613]
[RE:2527] [DI:direct] >gp:[GI:d1001780:g216457] [LN:ECO110K]
[AC:D10483:J01597:J01683:J01706:K01298:K01990:M10420:M10611:M12544]

-continued

[OR:*Escherichia coli*] [SR:*Escherichia coli* (strain:K-12) DNA]
[DB:genpept-bct1] [DE:*E.coli* K12 genome, 0–2.4 min. region.] [NT:hypothetical
32.6K protein(PIR:JE0404)] [LE:26947] [RE:27861] [DI:direct]
>gp:[GI:g1786213] [LN:AE000113] [AC:AE000113:U00096] [PN:orf, hypothetical
protein] [GN:yaaF] [FN:orf; Unknown] [OR:*Escherichia coli*] [DB:genpept-bct2]
[DE:*Escherichia coli* K-12 MG1655 section 3 of 400 of the completegenome.]
[NT:o304; 100 pct identical to YAAF_ECOLI SW: P22564] [LE:6634] [RE:7548]
[DI:direct]

| ORF Name | NT ID | AA ID | NT LN | AA LN | Score | P-Value |
|---|---|---|---|---|---|---|
| AI7503000990_1178828_c2_810 | 1705 | 5477 | 705 | 234 | 649 | 1.3e−63 |

Description
gp:[GI:g4097530] [LN:LLU64311] [AC:U64311]
[PN:phosphoribosylaminoimidazolesuccinocarboxamide] [GN:purC]
[OR:*Lactococcus lactis*] [DB:genpept-bct2] [EC:6.3.2.6] [DE:*Lactococcus
lactis* phosphoribosylaminoimidazolesuccinocarboxamidesynthetase (purC),
phosphoribosylformylglycinamidine synthetase I (purQ),
phosphoribosylformylglycinamidine synthetase II (purL),
andphosphoribosylpyrophosphate amidotransferase (purF) genes, completecds;
and unknown gene.] [NT:SAICAR synthetase] [LE:792] [RE:1502] [DI:direct]

| ORF Name | NT ID | AA ID | NT LN | AA LN | Score | P-Value |
|---|---|---|---|---|---|---|
| AI7503000990_1179542_c2_839 | 1706 | 5478 | 222 | 73 | | |

Description
NO-HIT

| ORF Name | NT ID | AA ID | NT LN | AA LN | Score | P-Value |
|---|---|---|---|---|---|---|
| AI7503000990_11806512_f3_562 | 1707 | 5479 | 207 | 68 | 86 | 0.0050 |

Description
gp:[GI:e1344613:g3874900] [LN:CEC41G6] [AC:Z81047] [GN:C41G6.8]
[OR:*Caenorhabditis elegans*] [DB:genpept-inv1] [DE:*Caenorhabditis elegans*
cosmid C41G6, complete sequence.] [LE:18951:19702:20184]
[RE:19549:20043:20463] [DI:directJoin]

| ORF Name | NT ID | AA ID | NT LN | AA LN | Score | P-Value |
|---|---|---|---|---|---|---|
| AI7503000990_1204567_c2_897 | 1708 | 5480 | 750 | 249 | 481 | 8.0e−46 |

Description
pir:[LN:G69878] [AC:G69878] [PN:conserved hypothetical protein yloO]
[GN:yloO] [CL:conserved hypothetical protein yloO:conserved hypothetical
protein yloO homology] [OR:*Bacillus subtilis*] [DB:pir2]
>gp:[GI:e1185167:g2633948] [LN:BSUB0009] [AC:Z99112:AL009126] [GN:yloO]
[FN:unknown] [OR:*Bacillus subtilis*] [DB:genpept-bct1] [DE:*Bacillus subtilis*
complete genome (section 9 of 21): from 1598421to 1807200.] [NT:similar to
hypothetical proteins] [LE:51363] [RE:52127] [DI:direct]
>gp:[GI:e323505:g2337805] [LN:BSY13937] [AC:Y13937] [PN:putative Ptc1
protein] [GN:yloO] [FN:unknown] [OR:*Bacillus subtilis*] [DB:genpept-bct1]
[DE:*Bacillus subtilis* genomic DNA from the spoVM region.] [LE:13135]
[RE:13899] [DI:direct]

| ORF Name | NT ID | AA ID | NT LN | AA LN | Score | P-Value |
|---|---|---|---|---|---|---|
| AI7503000990_1209638_c1_775 | 1709 | 5481 | 540 | 179 | 642 | 6.9e−63 |

Description
sp:[LN:LSPA_STAAU] [AC:P31024] [GN:LSPA:LSP] [OR:*STAPHYLOCOCCUS AUREUS*]
[EC:3.4.23.36] [DE:PEPTIDASE) (SIGNAL PEPTIDASE II) (SPASE II)] [SP:P31024]
[DB:swissprot] >pir:[LN:S20433] [AC:S20433] [PN:lipoprotein signal
peptidase,] [CL:lipoprotein signal peptidase] [OR:*Staphylococcus aureus*]
[EC:3.4.23.36] [DB:pir2] >gp:[GI:g153045] [LN:STALSP] [AC:M83994:M84707]
[PN:prolipoprotein signal peptidase] [GN:lsp] [OR:*Staphylococcus aureus*]
[SR:*Staphylococcus aureus* DNA] [DB:genpept-bct1] [DE:*Staphylococcus aureus*
prolipoprotein signal peptidase (lsp) gene,complete cds.] [LE:1213]
[RE:1704] [DI:direct]

| ORF Name | NT ID | AA ID | NT LN | AA LN | Score | P-Value |
|---|---|---|---|---|---|---|
| AI7503000990_1209682_c2_856 | 1710 | 5482 | 2409 | 802 | 1984 | 4.3e−205 |

Description
sp:[LN:SYFB_BACSU] [AC:P17922:P94540] [GN:PHET] [OR:*BACILLUS SUBTILIS*]
[EC:6.1.1.20] [DE:TRNA LIGASE BETA CHAIN) (PHERS)] [SP:P17922:P94540]
[DB:swissprot] >pir:[LN:YFBSB] [AC:A69676:140460:S11731]
[PN:phenylalanine--tRNA ligase, beta chain:phenylalanyl-tRNA synthetase beta
chain] [GN:pheT] [CL:phenylalanine--tRNA ligase beta chain] [OR:*Bacillus
subtilis*] [EC:6.1.1.20] [DB:pir1] >gp:[GI:e1184112:g2635328] [LN:BSUB0015]
[AC:Z99118:AL009126] [PN:phenylalanyl-tRNA synthetase (beta subunit)]
[GN:pheT] [OR:*Bacillus subtilis*] [DB:genpept-bct1] [EC:6.1.1.20]
[DE:*Bacillus subtilis* complete genome (section 15 of 21):from 2795131 to
3013540.] [SP:P17922] [LE:130980] [RE:133394] [DI:complement]
>gp:[GI:e1165325:g1770031] [LN:BSZ75208] [AC:Z75208] [PN:phenylalanyl-tRNA
synthetase beta subunit] [GN:pheT] [OR:*Bacillus subtilis*] [DB:genpept-bct1]
[EC:6.1.1.20] [DE:*B. subtilis* genomic sequence 89009bp.]
[NT:phenylalanyl-tRNA synthetase beta subunit] [SP:P17922] [LE:36513]
[RE:38927] [DI:direct]

| ORF Name | NT ID | AA ID | NT LN | AA LN | Score | P-Value |
|---|---|---|---|---|---|---|
| AI7503000990_13720312_c3_1024 | 1711 | 5483 | 240 | 79 | 117 | 3.0e−07 |

Description
pir:[LN:C69878] [AC:C69878] [PN:hypothetical protein yloH] [GN:yloH]
[OR:*Bacillus subtilis*] [DB:pir2] >gp:[GI:e1185160:g2633941] [LN:BSUB0009]
[AC:Z99112:AL009126] [GN:yloH] [FN:unknown] [OR:*Bacillus subtilis*]
[DB:genpept-bct1] [DE:*Bacillus subtilis* complete genome (section 9 of 21):
from 1598421 to 1807200.] [LE:43546] [RE:43749] [DI:direct]
>gp:[GI:e323522:g2337798] [LN:BSY13937] [AC:Y13937] [PN:putative rpoZ
protein] [GN:yloH] [FN:unknown] [OR:*Bacillus subtilis*] [DB:genpept-bct1]
[DE:*Bacillus subtilis* genomic DNA from the spoVM region.] [LE:5318]
[RE:5521] [DI:direct]

| ORF Name | NT ID | AA ID | NT LN | AA LN | Score | P-Value |
|---|---|---|---|---|---|---|
| AI7503000990_13757785_f3_639 | 1712 | 5484 | 135 | 44 | | |

Description
NO-HIT

| ORF Name | NT ID | AA ID | NT LN | AA LN | Score | P-Value |
|---|---|---|---|---|---|---|
| AI7503000990_1376317_c2_881 | 1713 | 5485 | 564 | 187 | 481 | 8.0e−46 |

Description
gp:[GI:e199384:g1514599] [LN:LPPYRBSOP] [AC:Z54240] [GN:pyrR] [FN:regulatory
protein] [OR:*Lactobacillus plantarum*] [DB:genpept-bct1] [DE:*L. plantarum*
pyrimidine biosynthetic operon (pyrR, pyrB, pyrC, pyrAA, pyrAB, pyrD, pyrF,
and pyrE) genes.] [LE:781] [RE:1323] [DI:direct]

| ORF Name | NT ID | AA ID | NT LN | AA LN | Score | P-Value |
|---|---|---|---|---|---|---|
| AI7503000990_13797076_c3_915 | 1714 | 5486 | 135 | 44 | | |

Description
NO-HIT

| ORF Name | NT ID | AA ID | NT LN | AA LN | Score | P-Value |
|---|---|---|---|---|---|---|
| AI7503000990_13864213_f3_624 | 1715 | 5487 | 234 | 77 | 186 | 1.4e−14 |

Description
pir:[LN:D69871] [AC:D69871] [PN:hypothetical protein ykzG] [GN:ykzG]
[OR:*Bacillus subtilis*] [DB:pir2] >gp:[GI:e1185044:g2633825] [LN:BSUB0008]
[AC:Z99111:AL009126] [GN:ykzG] [FN:unknown] [OR:*Bacillus subtilis*]
[DB:genpept-bct1] [DE:*Bacillus subtilis* complete genome (section 8 of 21):
from 1394791 to 1603020.] [LE:129406] [RE:129615] [DI:complement]

| ORF Name | NT ID | AA ID | NT LN | AA LN | Score | P-Value |
|---|---|---|---|---|---|---|
| AI7503000990_13869091_f2_433 | 1716 | 5488 | 294 | 97 | 246 | 6.4e−21 |

Description
sp:[LN:QOX4_BACSU] [AC:P34959] [GN:QOXD:IPA-40D] [OR:*BACILLUS SUBTILIS*]
[EC:1.9.3.—] [DE:SUBUNIT QOXD)] [SP:P34959] [DB:swissprot] >pir:[LN:D38129]
[AC:D38129:S39695:H69687] [PN:quinol oxidase aa3-600 chain IV -continued qoxD:cytochrome aa3 quinol oxidase (subunit IV) qoxD] [GN:qoxD]
[OR:*Bacillus subtilis*] [DB:pir2] >gp:[GI:g143399] [LN:BACQOXA] [AC:M86548]
[PN:quinol oxidase] [GN:QOXD] [OR:*Bacillus subtilis*] [SR:*Bacillus subtilis*
DNA] [DB:genpept-bct1] [DE:*Bacillus subtilis* AA3-600 quinol oxidase (QOXA,
QOXB, QOXC, QOXD) genes, complete cds.] [LE:4425] [RE:4799] [DI:direct]
>gp:[GI:g413964] [LN:BSGENR] [AC:X73124] [GN:ipa-40d qoxD] [OR:*Bacillus
subtilis*] [DB:genpept-bct1] [DE:*B. subtilis* genomic region (325 to 333).]
[SP:P34959] [LE:42877] [RE:43251] [DI:direct] >gp:[GI:e1186313:g2636349]
[LN:BSUB0020] [AC:Z99123:AL009126] [PN:cytochrome aa3 quinol oxidase
(subunit IV)] [GN:qoxD] [OR:*Bacillus subtilis*] [DB:genpept-bct1]
[DE:*Bacillus subtilis* complete genome (section 20 of 21):from 3798401 to
4010550.] [NT:alternate gene name:ipa-40d] [SP:P34959] [LE:114711]
[RE:115085] [DI:complement]

| ORF Name | NT ID | AA ID | NT LN | AA LN | Score | P-Value |
|---|---|---|---|---|---|---|
| AI7503000990__13916017__c1__738 | 1717 | 5489 | 123 | 40 | | |

Description
NO-HIT

| ORF Name | NT ID | AA ID | NT LN | AA LN | Score | P-Value |
|---|---|---|---|---|---|---|
| AI7503000990__14460882__c2__840 | 1718 | 5490 | 240 | 79 | 321 | 7.2e−29 |

Description
gp:[GI:g1022726] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000990__14557882__f3__532 | 1719 | 5491 | 126 | 41 | | |

Description
NO-HIT

| ORF Name | NT ID | AA ID | NT LN | AA LN | Score | P-Value |
|---|---|---|---|---|---|---|
| AI7503000990__14642135__c3__957 | 1720 | 5492 | 1905 | 634 | 2456 | 4.1e−255 |

Description
sp:[LN:TYPA__BACSU] [AC:O07631] [GN:TYPA] [OR:*BACILLUS SUBTILIS*]
[DE:GTP-BINDING PROTEIN TYPA/BIPA HOMOLOG] [SP:O07631] [DB:swissprot]
>pir:[LN:E69872] [AC:E69872] [PN:GTP-binding elongation factor homolog
ylaG] [GN:ylaG] [CL:translation elongation factor Tu homology] [OR:*Bacillus
subtilis*] [DB:pir2] >gp:[GI:e1185067:g2633848] [LN:BSUB0008]
[AC:Z99111:AL009126] [GN:ylaG] [FN:unknown] [OR:*Bacillus subtilis*]
[DB:genpept-bct1] [DE:*Bacillus subtilis* complete genome (section 8 of 21):
from 1394791 to 1603020.] [NT:similar to GTP-binding elongation factor]
[SP:O07631] [LE:150736] [RE:152574] [DI:direct] >gp:[GI:e1191893:g2224766]
[LN:BSZ97025] [AC:Z97025] [GN:ylaG] [OR:*Bacillus subtilis*] [DB:genpept-bct1]
[DE:*Bacillus subtilis* nprE, yla[A,B,C,D,E,F,G,H,I,J,K,L,M,N,O] and
pycA genes.] [NT:product highly similar to elongation factor EF-G]
[SP:O07631] [LE:4995] [RE:6833] [DI:direct]

| ORF Name | NT ID | AA ID | NT LN | AA LN | Score | P-Value |
|---|---|---|---|---|---|---|
| AI7503000990__14644066__c2__865 | 1721 | 5493 | 189 | 62 | 79 | 0.0032 |

Description
gp:[GI:g3212079] [LN:AF068633] [AC:AF068633] [PN:phenol soluble modulin beta
1] [FN:inflammatory protein] [OR:*Staphylococcus epidermidis*]
[DB:genpept-bct2] [DE:*Staphylococcus epidermidis* phenol soluble modulin beta
1 and phenol soluble modulin beta 2 genes, complete cds.] [NT:PSM beta 1]
[LE:669] [RE:803] [DI:direct] >gp:[GI:g3212080] [LN:AF068633] [AC:AF068633]
[PN:phenol soluble modulin beta 2] [FN:inflammatory protein]
[OR:*Staphylococcus epidermidis*] [DB:genpept-bct2] [DE:*Staphylococcus
epidermidis* phenol soluble modulin beta 1 and phenol soluble modulin beta 2
genes, complete cds.] [NT:PSM beta 2] [LE:859] [RE:993] [DI:direct]

| ORF Name | NT ID | AA ID | NT LN | AA LN | Score | P-Value |
|---|---|---|---|---|---|---|
| AI7503000990__14650302__c1__688 | 1722 | 5494 | 264 | 87 | 179 | 8.0e−14 |

Description
sp:[LN:YEXA__BACSU] [AC:P12049] [GN:YEXA] [OR:*BACILLUS SUBTILIS*]
[DE:HYPOTHETICAL 9.7 KD PROTEIN IN PURC-PURL INTERGENIC REGION] [SP:P12049]

-continued

[DB:swissprot] >pir:[LN:E29326] [AC:E29326:E69799] [PN:conserved
hypothetical protein yexA:hypothetical protein (pur operon)] [GN:yexA]
[CL:conserved hypothetical protein MJ1593] [OR:*Bacillus subtilis*] [DB:pir2]
>gp:[GI:e1182626:g2632960] [LN:BSUB0004] [AC:Z99107:AL009126] [GN:yexA]
[FN:unknown] [OR:*Bacillus subtilis*] [DB:genpept-bct1] [DE:*Bacillus subtilis*
complete genome (section 4 of 21):from 600701 to 813890.] [NT:similar to
hypothetical proteins] [LE:101124] [RE:101378] [DI:direct]

| ORF Name | NT ID | AA ID | NT LN | AA LN | Score | P-Value |
|---|---|---|---|---|---|---|
| AI7503000990__14664012__f2__323 | 1723 | 5495 | 468 | 155 | 341 | 5.4e−31 |

Description
pir:[LN:E69875] [AC:E69875] [PN:hypothetical protein ylbP] [GN:ylbP]
[OR:*Bacillus subtilis*] [DB:pir2] >gp:[GI:e334785:g2340013] [LN:BS16823KB]
[AC:Z98682] [PN:YlbP protein] [GN:ylbP] [OR:*Bacillus subtilis*]
[DB:genpept-bct1] [DE:*Bacillus subtilis* genomic DNA 23.9 kB fragment.]
[LE:21896] [RE:22378] [DI:complement] >gp:[GI:e1185100:g2633881]
[LN:BSUB0008] [AC:Z99111:AL009126] [GN:ylbP] [FN:unknown] [OR:*Bacillus
subtilis*] [DB:genpept-bct1] [DE:*Bacillus subtilis* complete genome (section 8
of 21):from 1394791 to 1603020.] [LE:181379] [RE:181861] [DI:complement]

| ORF Name | NT ID | AA ID | NT LN | AA LN | Score | P-Value |
|---|---|---|---|---|---|---|
| AI7503000990__14851587__c3__1010 | 1724 | 5496 | 126 | 41 | | |

Description
NO-HIT

| ORF Name | NT ID | AA ID | NT LN | AA LN | Score | P-Value |
|---|---|---|---|---|---|---|
| AI7503000990__14875002__f2__408 | 1725 | 5497 | 141 | 46 | 85 | 0.0044 |

Description
gp:[GI:g488889] [LN:A12521] [AC:A12521] [PN:Acidic Basic Repeat Antigen
Rhoptry (ABRA)] [OR:*Plasmodium falciparum*] [SR:malaria parasite *P.
falciparum*] [DB:genpept-pat] [DE:Ag189 clone.] [LE:1:61] [RE:45:963]
[DI:directJoin]

| ORF Name | NT ID | AA ID | NT LN | AA LN | Score | P-Value |
|---|---|---|---|---|---|---|
| AI7503000990__156502__f1__179 | 1726 | 5498 | 243 | 80 | | |

Description
NO-HIT

| ORF Name | NT ID | AA ID | NT LN | AA LN | Score | P-Value |
|---|---|---|---|---|---|---|
| AI7503000990__16593800__f2__359 | 1727 | 5499 | 144 | 47 | | |

Description
NO-HIT

| ORF Name | NT ID | AA ID | NT LN | AA LN | Score | P-Value |
|---|---|---|---|---|---|---|
| AI7503000990__19537562__f2__429 | 1728 | 5500 | 198 | 65 | | |

Description
NO-HIT

| ORF Name | NT ID | AA ID | NT LN | AA LN | Score | P-Value |
|---|---|---|---|---|---|---|
| AI7503000990__19537878__f1__177 | 1729 | 5501 | 159 | 52 | | |

Description
NO-HIT

| ORF Name | NT ID | AA ID | NT LN | AA LN | Score | P-Value |
|---|---|---|---|---|---|---|
| AI7503000990__19556326__f1__94 | 1730 | 5502 | 141 | 46 | | |

Description
NO-HIT

| ORF Name | NT ID | AA ID | NT LN | AA LN | Score | P-Value |
|---|---|---|---|---|---|---|
| AI7503000990__19557752__c1__777 | 1731 | 5503 | 912 | 303 | 844 | 2.7e−84 |

-continued

Description
sp:[LN:PYRB_BACSU] [AC:P05654] [GN:PYRB] [OR:*BACILLUS SUBTILIS*] [EC:2.1.3.2]
[DE:TRANSCARBAMYLASE) (ATCASE)] [SP:P05654] [DB:swissprot] >pir:[LN:OWBSAC]
[AC:A25015:C39845:B69686] [PN:aspartate carbamoyltransferase, catalytic
chain:aspartate transcarbamoylase] [GN:pyrB] [CL:ornithine
carbamoyltransferase:aspartate/ornithine carbamoyltransferase homology]
[OR:*Bacillus subtilis*] [EC:2.1.3.2] [DB:pir1] [MP:37 min] >gp:[GI:g143384]
[LN:BACPYRB] [AC:M13128] [OR:*Bacillus subtilis*] [SR:*B. subtilis* (strain
JH861) DNA, clone pLS201] [DB:genpept-bct1] [DE:*B. subtilis* pyrB gene
encoding aspartate transcarbamoylase, complete cds.] [NT:aspartate
transcarbamoylase (EC 2.1.3.2)] [LE:96] [RE:1010] [DI:direct]
>gp:[GI:e1185141:g2633922] [LN:BSUB0009] [AC:Z99112:AL009126] [PN:aspartate
carbamoyltransferase] [GN:pyrB] [FN:pyrimidine biosynthesis] [OR:*Bacillus
subtilis*] [DB:genpept-bct1] [EC:2.1.3.2] [DE:*Bacillus subtilis* complete
genome (section 9 of 21):from 1598421 to 1807200.] [SP:P05654] [LE:21455]
[RE:22369] [DI:direct] >gp:[GI:g143387] [LN:BACPYROP] [AC:M59757]
[PN:aspartate transcarbamoylase] [GN:pyrB] [OR:*Bacillus subtilis*]
[DB:genpept-bct2] [DE:*Bacillus subtilis* ORF1A (pyrR), putative
membrane-bound uracilpermease (pyrP), aspartate transcarbamylase (pyrB),
dihydroorotase (pyrC), glutaminase of carbamyl phosphate synthetase
(pyrAA), carbamyl phosphate synthetase (pyrAB), dihydroorotase
dehydrogenase (pyrD), OMP decarboxylase (pyrF), and OMP-PRPP transferase
(pyrE) genes, complete cds; and unknown gene.] [LE:2859] [RE:3773]
[DI:direct]

| ORF Name | NT ID | AA ID | NT LN | AA LN | Score | P-Value |
| --- | --- | --- | --- | --- | --- | --- |
| AI7503000990_19565627_c2_879 | 1732 | 5504 | 132 | 43 | | |

Description
NO-HIT

| ORF Name | NT ID | AA ID | NT LN | AA LN | Score | P-Value |
| --- | --- | --- | --- | --- | --- | --- |
| AI7503000990_19609530_f1_155 | 1733 | 5505 | 147 | 48 | | |

Description
NO-HIT

| ORF Name | NT ID | AA ID | NT LN | AA LN | Score | P-Value |
| --- | --- | --- | --- | --- | --- | --- |
| AI7503000990_19804703_c2_811 | 1734 | 5506 | 747 | 248 | 696 | 1.3e−68 |

Description
sp:[LN:PURQ_BACSU] [AC:P12041] [GN:PURQ] [OR:*BACILLUS SUBTILIS*] [EC:6.3.5.3]
[DE:SYNTHASE I)] [SP:P12041] [DB:swissprot] >pir:[LN:SYBS1G]
[AC:F29326:H69684] [PN:phosphoribosylformylglycinamidine synthase,
component I] [GN:purQ] [CL:phosphoribosylformylglycinamidine synthase
component I] [OR:*Bacillus subtilis*] [EC:6.3.5.3] [DB:pir1] [MP:18 min]
>gp:[GI:g143368] [LN:BACPURF] [AC:J02732:K00047] [OR:*Bacillus subtilis*]
[SR:*B. subtilis* (strain DE1 (prototroph DER. or W168)) DNA, clone pPZ]
[DB:genpept-bct1] [DE:*B. subtilis* pur operon encoding purine biosynthesis
enzymes, 12 genes.] [NT:phosphoribosylformyl glycinamidine synthetase I]
[LE:4393] [RE:5076] [DI:direct] >gp:[GI:e1182627:g2632961] [LN:BSUB0004]
[AC:Z99107:AL009126] [PN:phosphoribosylformylglycinamidine synthetase II]
[GN:purL] [FN:purine biosynthesis] [OR:*Bacillus subtilis*] [DB:genpept-bct1]
[EC:6.3.5.3] [DE:*Bacillus subtilis* complete genome (section 4 of 21):from
600701 to 813890.] [SP:P12041] [LE:101375] [RE:102058] [DI:direct]

| ORF Name | NT ID | AA ID | NT LN | AA LN | Score | P-Value |
| --- | --- | --- | --- | --- | --- | --- |
| AI7503000990_19957802_c1_752 | 1735 | 5507 | 1896 | 631 | 2764 | 9.5e−288 |

Description
gp:[GI:e1333202:g3776112] [LN:SATRXA] [AC:AJ223480] [PN:excinuclease ABC,
subunit C] [GN:uvrC] [FN:excision of ultraviolet light-induced]
[OR:*Staphylococcus aureus*] [DB:genpept-bct1] [DE:*Staphylococcus aureus* trxA
and uvrC genes and partial mutS and dhsC genes.] [NT:alternative gene name:
uvrB] [LE:2972] [RE:4753] [DI:direct]

| ORF Name | NT ID | AA ID | NT LN | AA LN | Score | P-Value |
| --- | --- | --- | --- | --- | --- | --- |
| AI7503000990_20312515_f2_242 | 1736 | 5508 | 141 | 46 | | |

Description
NO-HIT

| ORF Name | NT ID | AA ID | NT LN | AA LN | Score | P-Value |
| --- | --- | --- | --- | --- | --- | --- |

-continued

| ORF Name | NT ID | AA ID | NT LN | AA LN | Score | P-Value |
|---|---|---|---|---|---|---|
| AI7503000990_20500055_f1_218 | 1737 | 5509 | 132 | 43 | | |

Description
NO-HIT

| ORF Name | NT ID | AA ID | NT LN | AA LN | Score | P-Value |
|---|---|---|---|---|---|---|
| AI7503000990_20502217_c3_990 | 1738 | 5510 | 1626 | 541 | 718 | 6.1e−71 |

Description
pir:[LN:G69875] [AC:G69875] [PN:hypothetical protein yllA] [GN:yllA]
[OR:*Bacillus subtilis*] [DB:pir2] >gp:[GI:e1185102:g2633883] [LN:BSUB0008]
[AC:Z99111:AL009126] [GN:yllA] [FN:unknown] [OR:*Bacillus subtilis*]
[DB:genpept-bct1] [DE:*Bacillus subtilis* complete genome (section 8 of 21):
from 1394791 to 1603020.] [LE:182988] [RE:184607] [DI:direct]

| ORF Name | NT ID | AA ID | NT LN | AA LN | Score | P-Value |
|---|---|---|---|---|---|---|
| AI7503000990_2067627_c2_849 | 1739 | 5511 | 129 | 42 | | |

Description
NO-HIT

| ORF Name | NT ID | AA ID | NT LN | AA LN | Score | P-Value |
|---|---|---|---|---|---|---|
| AI7503000990_20890875_c2_801 | 1740 | 5512 | 147 | 48 | | |

Description
NO-HIT

| ORF Name | NT ID | AA ID | NT LN | AA LN | Score | P-Value |
|---|---|---|---|---|---|---|
| AI7503000990_209840_f1_44 | 1741 | 5513 | 195 | 64 | | |

Description
NO-HIT

| ORF Name | NT ID | AA ID | NT LN | AA LN | Score | P-Value |
|---|---|---|---|---|---|---|
| AI7503000990_20994212_f1_151 | 1742 | 5514 | 207 | 68 | 71 | 0.022 |

Description
pir:[LN:D69872] [AC:D69872] [PN:hypothetical protein ylaF] [GN:ylaF]
[OR:*Bacillus subtilis*] [DB:pir2] >gp:[GI:e1185066:g2633847] [LN:BSUB0008]
[AC:Z99111:AL009126] [GN:ylaF] [FN:unknown] [OR:*Bacillus subtilis*]
[DB:genpept-bct1] [DE:*Bacillus subtilis* complete genome (section 8 of 21):
from 1394791 to 1603020.] [LE:150435] [RE:150623] [DI:complement]
>gp:[GI:e324391:g2224765] [LN:BSZ97025] [AC:Z97025] [GN:ylaF] [OR:*Bacillus
subtilis*] [DB:genpept-bct1] [DE:*Bacillus subtilis* nprE,
yla[A,B,C,D,E,F,G,H,I,J,K,L,M,N,O] and pycA genes.] [LE:4694] [RE:4882]
[DI:complement]

| ORF Name | NT ID | AA ID | NT LN | AA LN | Score | P-Value |
|---|---|---|---|---|---|---|
| AI7503000990_211677_c3_989 | 1743 | 5515 | 702 | 233 | 436 | 4.7e−41 |

Description
pir:[LN:E69814] [AC:E69814] [PN:conserved hypothetical protein yfnB]
[GN:yfnB] [OR:*Bacillus subtilis*] [DB:pir2] >gp:[GI:e1182712:g2633046]
[LN:BSUB0004] [AC:Z99107:AL009126] [GN:yfnB] [FN:unknown] [OR:*Bacillus
subtilis*] [DB:genpept-bct1] [DE:*Bacillus subtilis* complete genome (section 4
of 21):from 600701 to 813890.] [NT:similar to hypothetical proteins]
[LE:203465] [RE:204172] [DI:complement] >gp:[GI:e1182723:g2633057]
[LN:BSUB0005] [AC:Z99108:AL009126] [GN:yfnB] [FN:unknown] [OR:*Bacillus
subtilis*] [DB:genpept-bct1] [DE:*Bacillus subtilis* complete genome (section 5
of 21):from 802821 to 1011250.] [NT:similar to hypothetical proteins]
[LE:1345] [RE:2052] [DI:complement] >gp:[GI:d1020926:g2116760] [LN:D86418]
[AC:D86418] [PN:YfnB] [OR:*Bacillus subtilis*] [SR:*Bacillus subtilis*
(strain:AC327) DNA] [DB:genpept-bct1] [DE:*Bacillus subtilis* genomic DNA
69–70 degree region, partial sequence.] [LE:9019] [RE:9726] [DI:direct]

| ORF Name | NT ID | AA ID | NT LN | AA LN | Score | P-Value |
|---|---|---|---|---|---|---|
| AI7503000990_21648962_c3_930 | 1744 | 5516 | 1827 | 608 | 1793 | 7.4e−185 |

Description
gp:[GI:g517205] [LN:SPU09352] [AC:U09352] [PN:67 kDa Myosin-crossreactive
streptococcal] [OR:*Streptococcus pyogenes*] [DB:genpept-bct1]
[DE:*Streptococcus pyogenes* 42 KD protein (ORF1) gene and 67

-continued

KD Myosin-crossreactive streptococcal antigen gene, complete cds.] [NT:ORF2]
[LE:1734] [RE:3506] [DI:direct]

| ORF Name | NT ID | AA ID | NT LN | AA LN | Score | P-Value |
|---|---|---|---|---|---|---|
| AI7503000990_21656327_c1_761 | 1745 | 5517 | 936 | 311 | 1464 | 5.4e−150 |

Description
gp:[GI:g2149891] [LN:SAU94706] [AC:U94706] [PN:unknown] [GN:yllC]
[OR:*Staphylococcus aureus*] [DB:genpept-bct2] [DE:*Staphylococcus aureus*
strain ATCC 8325-4 cell wall/cell division gene cluster, yllB, yllC, yllD,
pbpA, mraY, murD, div1B, ftsA and ftsZ genes, complete cds.] [LE:987]
[RE:1922] [DI:direct]

| ORF Name | NT ID | AA ID | NT LN | AA LN | Score | P-Value |
|---|---|---|---|---|---|---|
| AI7503000990_21759653_f3_666 | 1746 | 5518 | 609 | 202 | 552 | 2.4e−53 |

Description
sp:[LN:QOX3_BACSU] [AC:P34958] [GN:QOXC:IPA-39D] [OR:*BACILLUS SUBTILIS*]
[EC:1.9.3.—] [DE:SUBUNIT QOXC)] [SP:P34958] [DB:swissprot] >pir:[LN:C38129]
[AC:C38129:S39694:G69687] [PN:bo-type ubiquinol oxidase, chain III
qoxC:cytochrome aa3 quinol oxidase (subunit III) qoxC] [GN:qoxC]
[CL:cytochrome-c oxidase chain III] [OR:*Bacillus subtilis*] [EC:1.10.3.—]
[DB:pir2] >gp:[GI:g143398] [LN:BACQOXA] [AC:M86548] [PN:quinol oxidase]
[GN:QOXC] [OR:*Bacillus subtilis*] [SR:*Bacillus subtilis* DNA]
[DB:genpept-bct1] [DE:*Bacillus subtilis* AA3-600 quinol oxidase (QOXA, QOXB,
QOXC, QOXD) genes, complete cds.] [LE:3809] [RE:4423] [DI:direct]
>gp:[GI:g413963] [LN:BSGENR] [AC:X73124] [GN:ipa-39d qoxC] [OR:*Bacillus
subtilis*] [DB:genpept-bct1] [DE:*B. subtilis* genomic region (325 to 333).]
[SP:P34958] [LE:42261] [RE:42875] [DI:direct] >gp:[GI:e1186314:g2636350]
[LN:BSUB0020] [AC:Z99123:AL009126] [PN:cytochrome aa3 quinol oxidase
(subunit III)] [GN:qoxC] [OR:*Bacillus subtilis*] [DB:genpept-bct1]
[DE:*Bacillus subtilis* complete genome (section 20 of 21):from 3798401 to
4010550.] NT:alternate gene name:ipa-39d [SP:P34958] [LE:115087]
[RE:115701] [DI:complement]

| ORF Name | NT ID | AA ID | NT LN | AA LN | Score | P-Value |
|---|---|---|---|---|---|---|
| AI7503000990_21915911_f1_197 | 1747 | 5519 | 894 | 297 | 229 | 4.0e−19 |

Description
pir:[LN:G69858] [AC:G69858] [PN:hypothetical protein ykoC] [GN:ykoC]
[OR:*Bacillus subtilis*] [DB:pir2] >gp:[GI:e1181521:g2632041] [LN:BSAJ2571]
[AC:AJ002571] [PN:YkoC] [GN:ykoC] [FN:unknown] [OR:*Bacillus subtilis*]
[DB:genpept-bct1] [DE:*Bacillus subtilis* 168 56 kb DNA fragment between xlyA
and ykoR.] [LE:40195] [RE:40959] [DI:complement] >gp:[GI:e1183341:g2633675]
[LN:BSUB0007] [AC:Z99110:AL009126] [GN:ykoC] [FN:unknown] [OR:*Bacillus
subtilis*] [DB:genpept-bct1] [DE:*Bacillus subtilis* complete genome (section 7
of 21):from 1194391 to 1411140.] [LE:193144] [RE:193908] [DI:complement]

| ORF Name | NT ID | AA ID | NT LN | AA LN | Score | P-Value |
|---|---|---|---|---|---|---|
| AI7503000990_22000943_f1_216 | 1748 | 5520 | 222 | 73 | | |

Description
NO-HIT

| ORF Name | NT ID | AA ID | NT LN | AA LN | Score | P-Value |
|---|---|---|---|---|---|---|
| AI7503000990_22400283_c2_830 | 1749 | 5521 | 981 | 326 | 1329 | 1.1e−135 |

Description
pir:[LN:C36718] [AC:C36718:A69674] [PN:pyruvate dehydrogenase (lipoamide),
E1 beta chain precursor pdhB] [GN:pdhB] [CL:pyruvate dehydrogenase
(lipoamide) beta chain] [OR:*Bacillus subtilis*] [EC:1.2.4.1] [DB:pir2]
>gp:[GI:g143378] [LN:BACPYDHY] [AC:M57435:M31542] [PN:pyruvate decarboxylase
(E-1) beta subunit] [GN:pdhB] [OR:*Bacillus subtilis*] [SR:*B. subtilis* (strain
168) BRB1 (sacA321 metB5) cell line DNA, clone] [DB:genpept-bct1]
[EC:1.2.4.1] [DE:*B. subtilis* pyruvate dehydrogenase complex genes, complete
cds; PAL-related lipoprotein (slp) gene, complete cds, lysinedecarboxylase
(cad) gene, partial cds.] [LE:2796] [RE:3773] [DI:direct]
>gp:[GI:e1185049:g2633830] [LN:BSUB0008] [AC:Z99111:AL009126] [PN:pyruvate
dehydrogenase (E1 beta subunit)] [GN:pdhB] [OR:*Bacillus subtilis*]
[DB:genpept-bct1] [EC:1.2.4.1] [DE:*Bacillus subtilis* complete genome
(section 8 of 21):from 1394791 to 1603020.] [SP:P21882] [LE:134060]
[RE:135037] [DI:direct] >gp:[GI:g3282143] [LN:AF012285]
[AC:AF012285:AF012284:U51911] [PN:pyruvate decarboxylase E-1 beta subunit]
[GN:pdhB] [OR:*Bacillus subtilis*] [DB:genpept-bct2] [EC:1.2.4.1] [DE:*Bacillus*

-continued

*subtilis*mobA-nprE gene region.] [NT:similar to pyruvate decarboxylase (E-1) beta] [LE:34548] [RE:35525] [DI:direct]

| ORF Name | NT ID | AA ID | NT LN | AA LN | Score | P-Value |
|---|---|---|---|---|---|---|
| AI7503000990_2242938_c3_1009 | 1750 | 5522 | 933 | 310 | 1055 | 1.2e−106 |

Description
sp:[LN:YLYB_BACSU] [AC:Q45480:O31732] [GN:YLYB] [OR:*BACILLUS SUBTILIS*] [DE:HYPOTHETICAL 33.7 KD PROTEIN IN LSP-PYRR INTERGENIC REGION (ORF-X)] [SP:Q45480:O31732] [DB:swissprot] >gp:[GI:g1373157] [LN:BSU48870] [AC:U48870] [OR:*Bacillus subtilis*] [DB:genpept-bct1] [DE:*Bacillus subtilis* signal peptidase II (lsp) gene, complete cds, isoleucyl-tRNA synthetase (ileS) and pyrR genes, partial cds.] [NT:orf-X; hypothetical protein; Method:conceptual] [LE:1658] [RE:2569] [DI:direct]

| ORF Name | NT ID | AA ID | NT LN | AA LN | Score | P-Value |
|---|---|---|---|---|---|---|
| AI7503000990_22461078_c1_769 | 1751 | 5523 | 735 | 244 | 814 | 4.1e−81 |

Description
gp:[GI:g1314301] [LN:SAU41072] [AC:U41072] [PN:unknown] [GN:ORF] [OR:*Staphylococcus aureus*] [DB:genpept-bct2] [DE:*Staphylococcus aureus* isoleucyl-tRNA synthetase (ileS) gene, partial cds.] [LE:106] [RE:723] [DI:direct]

| ORF Name | NT ID | AA ID | NT LN | AA LN | Score | P-Value |
|---|---|---|---|---|---|---|
| AI7503000990_22462802_c3_1026 | 1752 | 5524 | 1203 | 400 | 1070 | 3.1e−108 |

Description
pir:[LN:D69878] [AC:D69878] [PN:pantothenate metabolism flavoprotein homolog yloI] [GN:yloI] [CL:pantothenate metabolism flavoprotein dfp] [OR:*Bacillus subtilis*] [DB:pir2] >gp:[GI:e1185161:g2633942] [LN:BSUB0009] [AC:Z99112:AL009126] [GN:yloI] [FN:unknown] [OR:*Bacillus subtilis*] [DB:genpept-bct1] [DE:*Bacillus subtilis* complete genome (section 9 of 21): from 1598421 to 1807200.] [NT:similar to pantothenate metabolism flavoprotein] [LE:43830] [RE:45050] [DI:direct] >gp:[GI:e323501:g2337799] [LN:BSY13937] [AC:Y13937] [PN:putative Dfp protein] [GN:yloI] [FN:unknown] [OR:*Bacillus subtilis*] [DB:genpept-bct1] [DE:*Bacillus subtilis* genomic DNA from the spoVM region.] [LE:5602] [RE:6822] [DI:direct]

| ORF Name | NT ID | AA ID | NT LN | AA LN | Score | P-Value |
|---|---|---|---|---|---|---|
| AI7503000990_22478427_c3_987 | 1753 | 5525 | 138 | 45 | 115 | 4.8e−07 |

Description
sp:[LN:GGI2_STAHA] [AC:P11698] [OR:*STAPHYLOCOCCUS HAEMOLYTICUS*] [DE:ANTIBACTERIAL PROTEIN 2 (GONOCOCCAL GROWTH INHIBITOR 2)] [SP:P11698] [DB:swissprot] >pir:[LN:BXSA2] [AC:S00600] [PN:antibacterial protein 2:gonococcal growth inhibitor 2] [CL:*Staphylococcus haemolyticus* antibacterial protein] [OR:*Staphylococcus haemolyticus*] [DB:pir1]

| ORF Name | NT ID | AA ID | NT LN | AA LN | Score | P-Value |
|---|---|---|---|---|---|---|
| AI7503000990_22542567_c2_855 | 1754 | 5526 | 759 | 252 | 562 | 2.1e−54 |

Description
pir:[LN:G69984] [AC:G69984] [PN:rRNA methylase homolog ysgA] [GN:ysgA] [OR:*Bacillus subtilis*] [DB:pir2] >gp:[GI:e1184114:g2635330] [LN:BSUB0015] [AC:Z99118:AL009126] [GN:ysgA] [FN:unknown] [OR:*Bacillus subtilis*] [DB:genpept-bct1] [DE:*Bacillus subtilis* complete genome (section 15 of 21): from 2795131 to 3013540.] [NT:similar to rRNA methylase] [LE:134799] [RE:135545] [DI:complement] >gp:[GI:e1165323:g1770029] [LN:BSZ75208] [AC:Z75208] [PN:hypothetical protein] [GN:ysgA] [OR:*Bacillus subtilis*] [DB:genpept-bct1] [DE:*B. subtilis* genomic sequence 89009bp.] [NT:Homology to spoU-type rRNA methyltransferases;] [LE:34362] [RE:35108] [DI:direct]

| ORF Name | NT ID | AA ID | NT LN | AA LN | Score | P-Value |
|---|---|---|---|---|---|---|
| AI7503000990_22775126_f2_411 | 1755 | 5527 | 633 | 210 | 263 | 1.0e−22 |

Description
pir:[LN:A69859] [AC:A69859] [PN:hypothetical protein ykoE] [GN:ykoE] [OR:*Bacillus subtilis*] [DB:pir2] >gp:[GI:e1181523:g2632043] [LN:BSAJ2571] [AC:AJ002571] [PN:YkoE] [GN:ykoE] [FN:unknown] [OR:*Bacillus subtilis*] [DB:genpept-bct1] [DE:*Bacillus subtilis* 168 56 kb DNA fragment between xlyA and ykoR.] [LE:42565] [RE:43164] [DI:complement] >gp:[GI:e1183343:g2633677] [LN:BSUB0007] [AC:Z99110:AL009126] [GN:ykoE] [FN:unknown] [OR:*Bacillus*

-continued subtilis] [DB:genpept-bct1] [DE:*Bacillus subtilis* complete genome (section 7 of 21):from 1194391 to 1411140.] [LE:195514] [RE:196113] [DI:complement]

| ORF Name | NT ID | AA ID | NT LN | AA LN | Score | P-Value |
|---|---|---|---|---|---|---|
| AI7503000990_22931642_c2_802 | 1756 | 5528 | 1224 | 407 | 1250 | 2.6e−127 |

Description
gp:[GI:d1024918:g2696796] [LN:AB009635] [AC:AB009635] [PN:Fmt] [GN:fmt]
[OR:*Staphylococcus aureus*] [SR:*Staphylococcus aureus* (strain:KSA8) DNA]
[DB:genpept-bct1] [DE:*Staphylococcus aureus* DNA for Fmt, complete cds.]
[LE:1234] [RE:2427] [DI:direct]

| ORF Name | NT ID | AA ID | NT LN | AA LN | Score | P-Value |
|---|---|---|---|---|---|---|
| AI7503000990_23438887_c1_748 | 1757 | 5529 | 300 | 99 | 196 | 1.3e−15 |

Description
pir:[LN:A69985] [AC:A69985] [PN:hypothetical protein yshA] [GN:yshA]
[OR:*Bacillus subtilis*] [DB:pir2] >gp:[GI:e1184110:g2635326] [LN:BSUB0015]
[AC:Z99118:AL009126] [GN:yshA] [FN:unknown] [OR:*Bacillus subtilis*]
[DB:genpept-bct1] [DE:*Bacillus subtilis* complete genome (section 15 of 21):
from 2795131 to 3013540.] [LE:129612] [RE:129869] [DI:complement]
>gp:[GI:e1165327:g1770033] [LN:BSZ75208] [AC:Z75208] [PN:hypothetical
protein] [GN:yshA] [OR:*Bacillus subtilis*] [DB:genpept-bct1] [DE:*B. subtilis*
genomic sequence 89009bp.] [NT:unknown function; putative] [LE:40038]
[RE:40295] [DI:direct]

| ORF Name | NT ID | AA ID | NT LN | AA LN | Score | P-Value |
|---|---|---|---|---|---|---|
| AI7503000990_23442177_f3_600 | 1758 | 5530 | 669 | 222 | 429 | 2.6e−40 |

Description
pir:[LN:D69864] [AC:D69864] [PN:hypothetical protein yktB] [GN:yktB]
[OR:*Bacillus subtilis*] [DB:pir2] >gp:[GI:e1185055:g2633836] [LN:BSUB0008]
[AC:Z99111:AL009126] [GN:yktB] [FN:unknown] [OR:*Bacillus subtilis*]
[DB:genpept-bct1] [DE:*Bacillus subtilis* complete genome (section 8 of 21):
from 1394791 to 1603020.] [LE:140850] [RE:141488] [DI:complement]
>gp:[GI:g3282149] [LN:AF012285] [AC:AF012285:AF012284:U51911] [PN:unknown]
[GN:yktB] [FN:unknown] [OR:*Bacillus subtilis*] [DB:genpept-bct2] [DE:*Bacillus
subtilis* mobA-nprE gene region.] [LE:41338] [RE:41976] [DI:complement]

| ORF Name | NT ID | AA ID | NT LN | AA LN | Score | P-Value |
|---|---|---|---|---|---|---|
| AI7503000990_23448838_f1_217 | 1759 | 5531 | 873 | 290 | 786 | 3.8e−78 |

Description
sp:[LN:FOLD_BACSU] [AC:P54382] [GN:FOLD] [OR:*BACILLUS SUBTILIS*]
[EC:1.5.1.5:3.5.4.9] [DE:METHENYLTETRAHYDROFOLATE CYCLOHYDROLASE,]
[SP:P54382] [DB:swissprot] >pir:[LN:E69626] [AC:E69626]
[PN:methylenetetrahydrofolate dehydrogenase (NADP+), /
methenyltetrahydrofolate cyclohydrolase,] [GN:folD]
[CL:methylenetetrahydrofolate dehydrogenase (NAD+):
methylenetetrahydrofolate dehydrogenase (NAD+) homology] [OR:*Bacillus
subtilis*] [EC:1.5.1.5:3.5.4.9] [DB:pir2] >gp:[GI:d1013251:g1303916]
[LN:BACJHG42] [AC:D84432:D82370] [PN:YqiA] [OR:*Bacillus subtilis*]
[SR:*Bacillus subtilis* (strain:JH642(trpC2 PheA1)) DNA] [DB:genpept-bct1]
[DE:*Bacillus subtilis* DNA, 283 Kb region containing skin element.]
[LE:190351] [RE:191202] [DI:direct] >gp:[GI:e1185699:g2634865] [LN:BSUB0013]
[AC:Z99116:AL009126] [PN:methyltetrahydrofolate cyclohydrolase] [GN:folD]
[FN:purines and amino acids biosynthesis] [OR:*Bacillus subtilis*]
[DB:genpept-bct1] [EC:1.5.1.5:3.5.4.9] [DE:*Bacillus subtilis* complete genome
(section 13 of 21):from 2395261 to 2613730.] [NT:alternate gene name:yqiA;]
[SP:P54382] [LE:132419] [RE:133270] [DI:complement]

| ORF Name | NT ID | AA ID | NT LN | AA LN | Score | P-Value |
|---|---|---|---|---|---|---|
| AI7503000990_23453767_f1_62 | 1760 | 5532 | 138 | 45 | | |

Description
NO-HIT

| ORF Name | NT ID | AA ID | NT LN | AA LN | Score | P-Value |
|---|---|---|---|---|---|---|
| AI7503000990_23492327_f1_37 | 1761 | 5533 | 204 | 67 | 126 | 3.3e−08 |

Description
pir:[LN:S75993] [AC:S75993] [PN:hypothetical protein] [OR:*Synechocystis*
sp.] [SR:PCC 6803, , PCC 6803] [SR:PCC 6803,] [DB:pir2]

-continued

>gp:[GI:d1011491:g1001353] [LN:SYCSLLLH] [AC:D64006:AB001339]
[PN:hypothetical protein] [GN:clpP] [OR:*Synechocystis* sp.] [SR:*Synechocystis*
sp. (strain:PCC6803) DNA] [DB:genpept-bct1] [DE:*Synechocystis* sp. PCC6803
complete genome, 25/27, 3138604–3270709.] [NT:ORF_ID:sll0498] [LE:80076]
[RE:80528] [DI:complement]

| ORF Name | NT ID | AA ID | NT LN | AA LN | Score | P-Value |
|---|---|---|---|---|---|---|
| AI7503000990_23532327_c2_829 | 1762 | 5534 | 1113 | 370 | 1432 | 1.3e–146 |

Description
sp:[LN:ODPA_BACST] [AC:P21873] [GN:PDHA] [OR:*BACILLUS STEAROTHERMOPHILUS*]
[EC:1.2.4.1] [DE:PYRUVATE DEHYDROGENASE E1 COMPONENT, ALPHA SUBUNIT,]
[SP:P21873] [DB:swissprot]

| ORF Name | NT ID | AA ID | NT LN | AA LN | Score | P-Value |
|---|---|---|---|---|---|---|
| AI7503000990_23550313_f2_329 | 1763 | 5535 | 141 | 46 | | |

Description
NO-HIT

| ORF Name | NT ID | AA ID | NT LN | AA LN | Score | P-Value |
|---|---|---|---|---|---|---|
| AI7503000990_23572178_c2_861 | 1764 | 5536 | 846 | 281 | 1070 | 3.1e–108 |

Description
sp:[LN:DHSB_BACSU] [AC:P08066] [GN:SDHB] [OR:*BACILLUS SUBTILIS*]
[EC:1.3.99.1] [DE:SUCCINATE DEHYDROGENASE IRON-SULFUR PROTEIN,] [SP:P08066]
[DB:swissprot]

| ORF Name | NT ID | AA ID | NT LN | AA LN | Score | P-Value |
|---|---|---|---|---|---|---|
| AI7503000990_23572253_c1_796 | 1765 | 5537 | 741 | 246 | 623 | 7.1e–61 |

Description
pir:[LN:B69693] [AC:B69693:JC4821] [PN:ribonuclease III,:RNase D:RNase O]
[GN:rncS:srb] [CL:ribonuclease III:double-stranded RNA-binding repeat
homology] [OR:*Bacillus subtilis*] [EC:3.1.26.3] [DB:pir2]
>gp:[GI:e1185184:g2633965] [LN:BSUB0009] [AC:Z99112:AL009126]
[PN:ribonuclease III] [GN:rncS] [OR:*Bacillus subtilis*] [DB:genpept-bct1]
[EC:3.1.26.3] [DE:*Bacillus subtilis* complete genome (section 9 of 21):from
1598421 to 1807200.] [NT:alternate gene name:rnc] [LE:66689] [RE:67438]
[DI:direct]

| ORF Name | NT ID | AA ID | NT LN | AA LN | Score | P-Value |
|---|---|---|---|---|---|---|
| AI7503000990_23632962_c2_880 | 1766 | 5538 | 810 | 269 | 270 | 1.8e–23 |

Description
sp:[LN:YFIE_BACSU] [AC:P54721] [GN:YFIE] [OR:*BACILLUS SUBTILIS*]
[DE:HYPOTHETICAL 31.5 KD PROTEIN IN GLVBC 3'REGION] [SP:P54721]
[DB:swissprot] >pir:[LN:H69802] [AC:H69802] [PN:conserved hypothetical
protein yfiE] [GN:yfiE] [OR:*Bacillus subtilis*] [DB:pir2]
>gp:[GI:e1182814:g2633148] [LN:BSUB0005] [AC:Z99108:AL009126] [GN:yfiE]
[FN:unknown] [OR:*Bacillus subtilis*] [DB:genpept-bct1] [DE:*Bacillus subtilis*
complete genome (section 5 of 21):from 802821 to 1011250.] [NT:similar to
hypothetical proteins from *B. subtilis*] [SP:P54721] [LE:94696] [RE:95553]
[DI:direct] >gp:[GI:d1009744:g1486247] [LN:D50543] [AC:D50543] [PN:unknown]
[GN:yfiE] [FN:unknown] [OR:*Bacillus subtilis*] [SR:*Bacillus subtilis*
(strain:168, haplotype:haploid) DNA] [DB:genpept-bct1] [DE:*Bacillus subtilis*
DNA for 76-degree region, complete cds.] [LE:8372] [RE:9229] [DI:direct]

| ORF Name | NT ID | AA ID | NT LN | AA LN | Score | P-Value |
|---|---|---|---|---|---|---|
| AI7503000990_23642217_c1_790 | 1767 | 5539 | 648 | 215 | 396 | 8.1e–37 |

Description
pir:[LN:C69879] [AC:C69879] [PN:hypothetical protein yloS] [GN:yloS]
[OR:*Bacillus subtilis*] [DB:pir2] >gp:[GI:e1185171:g2633952] [LN:BSUB0009]
[AC:Z99112:AL009126] [GN:yloS] [FN:unknown] [OR:*Bacillus subtilis*]
[DB:genpept-bct1] [DE:*Bacillus subtilis* complete genome (section 9 of 21):
from 1598421 to 1807200.] [LE:55709] [RE:56353] [DI:direct]
>gp:[GI:e323508:g2337809] [LN:BSY13937] [AC:Y13937] [PN:YloS protein]
[GN:yloS] [FN:unknown] [OR:*Bacillus subtilis*] [DB:genpept-bct1] [DE:*Bacillus
subtilis* genomic DNA from the spoVM region.] [LE:17481] [RE:18125]
[DI:direct]

-continued

| ORF Name | NT ID | AA ID | NT LN | AA LN | Score | P-Value |
|---|---|---|---|---|---|---|
| AI7503000990_23647178_c2_903 | 1768 | 5540 | 633 | 210 | 398 | 5.0e−37 |

Description
pir:[LN:A69880] [AC:A69880] [PN:hypothetical protein ylpC] [GN:ylpC]
[OR:Bacillus subtilis] [DB:pir2] >gp:[GI:e1185179:g2633960] [LN:BSUB0009]
[AC:Z99112:AL009126] [GN:ylpC] [FN:unknown] [OR:Bacillus subtilis]
[DB:genpept-bct1] [DE:Bacillus subtilis complete genome (section 9 of 21):
from 1598421 to 1807200.] [LE:62946] [RE:63512] [DI:direct]
>gp:[GI:e323513:g2337817] [LN:BSY13937] [AC:Y13937] [PN:YlpC protein]
[GN:ylpC] [FN:unknown] [OR:Bacillus subtilis] [DB:genpept-bct1] [DE:Bacillus
subtilis genomic DNA from the spoVM region.] [LE:24718] [RE:25284]
[DI:direct]

| ORF Name | NT ID | AA ID | NT LN | AA LN | Score | P-Value |
|---|---|---|---|---|---|---|
| AI7503000990_23650293_c1_785 | 1769 | 5541 | 627 | 208 | 693 | 2.7e−68 |

Description
pir:[LN:B69878] [AC:B69878] [PN:guanylate kinase homolog yloD] [GN:yloD]
[CL:guanylate kinase:guanylate kinase homology] [OR:Bacillus subtilis]
[DB:pir2] >gp:[GI:e1185159:g2633940] [LN:BSUB0009] [AC:Z99112:AL009126]
[GN:yloD] [FN:unknown] [OR:Bacillus subtilis] [DB:genpept-bct1] [DE:Bacillus
subtilis complete genome (section 9 of 21):from 1598421 to 1807200.]
[NT:similar to guanylate kinase] [LE:42808] [RE:43542] [DI:direct]
>gp:[GI:e323500:g2337797] [LN:BSY13937] [AC:Y13937] [PN:putative Gmk
protein] [GN:yloD] [FN:unknown] [OR:Bacillus subtilis] [DB:genpept-bct1]
[DE:Bacillus subtilis genomic DNA from the spoVM region.] [LE:4580]
[RE:5314] [DI:direct]

| ORF Name | NT ID | AA ID | NT LN | AA LN | Score | P-Value |
|---|---|---|---|---|---|---|
| AI7503000990_23695900_c2_812 | 1770 | 5542 | 1551 | 516 | 1490 | 9.5e−153 |

Description
gp:[GI:g4097534] [LN:LLU64311] [AC:U64311] [PN:phosphoribosylpyrophosphate
amidotransferase] [GN:purF] [OR:Lactococcus lactis] [DB:genpept-bct2]
[EC:2.4.2.14] [DE:Lactococcus lactis
phosphoribosylaminoimidazolesuccinocarboxamidesynthetase (purC),
phosphoribosylformylglycinamidine synthetase I (purQ),
phosphoribosylformylglycinamidine synthetase II (purL),
and phosphoribosylpyrophosphate amidotransferase (purF) genes, complete cds;
and unknown gene.] [NT:PRPP ATase] [LE:4921] [RE:6441] [DI:direct]

| ORF Name | NT ID | AA ID | NT LN | AA LN | Score | P-Value |
|---|---|---|---|---|---|---|
| AI7503000990_23730340_c1_716 | 1771 | 5543 | 1422 | 473 | 2270 | 2.1e−235 |

Description
pir:[LN:S19723] [AC:S19723] [PN:dihydrolipoamide dehydrogenase,:pyruvate
dehydrogenase complex chain E3] [GN:pdhD] [CL:dihydrolipoamide
dehydrogenase dihydrolipoamide dehydrogenase homology] [OR:Staphylococcus
aureus] [EC:1.8.1.4] [DB:pir1] >gp:[GI:g48874] [LN:SAPDHDNA]
[AC:X58434:S73625] [PN:dihydrolipoamide dehydrogenase:subunit E3] [GN:pdhD]
[OR:Staphylococcus aureus] [DB:genpept-bct1] [EC:1.8.1.4] [DE:S. aureus pdhB,
pdhC and pdhD genes for pyruvate decarboxylase, dihydrolipoamide
acetyltransferase and dihydrolipoamidedehydrogenase.] [LE:1853] [RE:3259]
[DI:direct]

| ORF Name | NT ID | AA ID | NT LN | AA LN | Score | P-Value |
|---|---|---|---|---|---|---|
| AI7503000990_23836036_c2_887 | 1772 | 5544 | 192 | 63 | 153 | 1.2e−09 |

Description
sp:[LN:CARB_BACCL] [AC:P46537] [GN:PYRAB] [OR:BACILLUS CALDOLYTICUS]
[EC:6.3.5.5] [DE:(EC 6.3.5.5) (CARBAMOYL-PHOSPHATE SYNTHETASE AMMONIA
CHAIN)] [SP:P46537] [DB:swissprot] >pir:[LN:I40169] [AC:I40169:S34321]
[PN:carbamoyl-phosphate synthase (glutamine-hydrolyzing),] [GN:pyrAb]
[CL:carbamoyl-phosphate synthase (glutamine-hydrolyzing) large chain:biotin
carboxylase homology:carbamoyl-phosphate synthase (glutamine-hydrolyzing)
large chain homology] [OR:Bacillus caldolyticus] [EC:6.3.5.5] [DB:pir2]
>gp:[GI:g312443] [LN:BCPYR] [AC:X73308] [PN:carbamoyl-phosphate synthase]
[GN:PyrAb] [OR:Bacillus caldolyticus] [DB:genpept-bct1] [EC:6.3.5.5]
[DE:B. caldolyticus pyrimidine biosynthesis genes.] [SP:P46537] [LE:3658]
[RE:6855] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000990_23928937_c3_953 | 1773 | 5545 | 141 | 46 | | |

Description
NO-HIT

| ORF Name | NT ID | AA ID | NT LN | AA LN | Score | P-Value |
|---|---|---|---|---|---|---|
| AI7503000990_24025253_f1_219 | 1774 | 5546 | 321 | 106 | 198 | 1.3e−14 |

Description
pir:[LN:T00323] [AC:T00323] [PN:chitinase, B] [OR:*Clostridium paraputrificum*] [EC:3.2.1.14] [DB:pir3] >gp:[GI:d1024701:g2696017] [LN:AB001874] [AC:AB001874] [PN:chitinase B] [GN:chiB] [OR:*Clostridium paraputrificum*] [SR:*Clostridium paraputrificum* (strain:M21) DNA] [DB:genpept-bct1] [EC:3.2.1.14] [DE:*Clostridium paraputrificum* gene for chitinase B, complete cds.] [LE:1] [RE:2496] [DI:direct]

| ORF Name | NT ID | AA ID | NT LN | AA LN | Score | P-Value |
|---|---|---|---|---|---|---|
| AI7503000990_24025467_c2_863 | 1775 | 5547 | 522 | 173 | 238 | 4.5e−20 |

Description
sp:[LN:YSNB_BACSU] [AC:P94559] [GN:YSNB] [OR:*BACILLUS SUBTILIS*] [DE:HYPOTHETICAL 19.2 KD PROTEIN IN RPH-ILVB INTERGENIC REGION] [SP:P94559] [DB:swissprot] >pir:[LN:D69986] [AC:D69986] [PN:conserved hypothetical protein ysnB] [GN:ysnB] [CL:conserved hypothetical protein MG207: phosphoesterase core homology] [OR:*Bacillus subtilis*] [DB:pir2] >gp:[GI:e1184084:g2635300] [LN:BSUB0015] [AC:Z99118:AL009126] [GN:ysnB] [FN:unknown] [OR:*Bacillus subtilis*] [DB:genpept-bct1] [DE:*Bacillus subtilis* complete genome (section 15 of 21):from 2795131 to 3013540.] [NT:similar to hypothetical proteins] [SP:P94559] [LE:103990] [RE:104505] [DI:complement] >gp:[GI:e1165358:g1770061] [LN:BSZ75208] [AC:Z75208] [PN:hypothetical protein] [GN:ysnB] [OR:*Bacillus subtilis*] [DB:genpept-bct1] [DE:*B. subtilis* genomic sequence 89009bp.] [NT:homology to HI0260 of *Haemophilus influenzae*;] [SP:P94559] [LE:65402] [RE:65917] [DI:direct]

| ORF Name | NT ID | AA ID | NT LN | AA LN | Score | P-Value |
|---|---|---|---|---|---|---|
| AI7503000990_24220002_f1_67 | 1776 | 5548 | 129 | 42 | | |

Description
NO-HIT

| ORF Name | NT ID | AA ID | NT LN | AA LN | Score | P-Value |
|---|---|---|---|---|---|---|
| AI7503000990_24240676_f3_477 | 1777 | 5549 | 246 | 81 | | |

Description
NO-HIT

| ORF Name | NT ID | AA ID | NT LN | AA LN | Score | P-Value |
|---|---|---|---|---|---|---|
| AI7503000990_24256551_c3_923 | 1780 | 5552 | 1071 | 356 | 938 | 3.0e−94 |

Description
gp:[GI:d1023423:g2463562] [LN:AB007500] [AC:AB007500:D28879] [PN:MRAY] [GN:mraY] [OR:*Staphylococcus aureus*] [SR:*Staphylococcus aureus* (strain:NCTC8325) DNA] [DB:genpept-bct1] [DE:*Staphylococcus aureus* genes for penicillin-binding protein 1, MraY, MurD, partial and complete cds.] [LE:3120] [RE:4085] [DI:direct] >gp:[GI:g4104230] [LN:AF034153] [AC:AF034153] [PN:phospho-N-acetylmuramoyl-pentapeptide] [GN:mraY] [OR:*Staphylococcus aureus*] [DB:genpept-bct2] [DE:*Staphylococcus aureus* phospho-N-acetylmuramoyl-pentapeptidetranslocase (mraY) gene, complete cds.] [LE:28] [RE:993] [DI:direct]

| ORF Name | NT ID | AA ID | NT LN | AA LN | Score | P-Value |
|---|---|---|---|---|---|---|
| AI7503000990_24256250_f3_467 | 1779 | 5551 | 126 | 41 | | |

Description
NO-HIT

| ORF Name | NT ID | AA ID | NT LN | AA LN | Score | P-Value |
|---|---|---|---|---|---|---|
| AI7503000990_24256551_c3_923 | 1780 | 5552 | 1071 | 356 | 938 | 3.0e−94 |

Description
sp:[LN:PUR5_BACSU] [AC:P12043] [GN:PURM:ATH] [OR:*BACILLUS SUBTILIS*] [EC:6.3.3.1] [DE:(PHOSPHORIBOSYL-AMINOIMIDAZOLE SYNTHETASE) (AIR SYNTHASE)]

-continued

[SP:P12043] DB:swissprot] >pir:[LN:AJBSCL] [AC:H29326:A69685]
[PN:phosphoribosylformylglycinamidine
cyclo-ligase,:phosphoribosylaminoimidazole synthetase] [GN:purM]
[CL:phosphoribosylformylglycinamidine cyclo-ligase:
phosphoribosylformylglycinamidine cyclo-ligase homology] [OR:*Bacillus
subtilis*] [EC:6.3.3.1] [DB:pir1] [MP:18 min] >gp:[GI:g143371] [LN:BACPURF]
[AC:J02732:K00047] [OR:*Bacillus subtilis*] [SR:*B. subtilis* (strain DE1
(prototroph DER. or W168)) DNA, clone pPZ] [DB:genpept-bct1] [DE:*B. subtilis*
pur operon encoding purine biosynthesis enzymes, 12 genes.]
[NT:phosphoribosyl aminoimidazole synthetase (PUR-M)] [LE:8796] [RE:9836]
[DI:direct] >gp:[GI:e1182630:g2632964] [LN:BSUB0004] [AC:Z99107:AL009126]
[PN:phosphoribosylaminoimidazole synthetase] [GN:purM] [FN:purine
biosynthesis] [OR:*Bacillus subtilis*] [DB:genpept-bct1] [EC:6.3.3.1]
[DE:*Bacillus subtilis* complete genome (section 4 of 21):from 600701
to 813890.] [SP:P12043] [LE:105778] [RE:106818] [DI:direct]

| ORF Name | NT ID | AA ID | NT LN | AA LN | Score | P-Value |
|---|---|---|---|---|---|---|
| AI7503000990_24257877_c2_854 | 1781 | 5553 | 129 | 42 | | |

Description
NO-HIT

| ORF Name | NT ID | AA ID | NT LN | AA LN | Score | P-Value |
|---|---|---|---|---|---|---|
| AI7503000990_24261068_c1_758 | 1782 | 5554 | 147 | 48 | 215 | 1.2e−17 |

Description
gp:[GI:g3212079] [LN:AF068633] [AC:AF068633] [PN:phenol soluble modulin beta
1] [FN:inflammatory protein] [OR:*Staphylococcus epidermidis*]
[DB:genpept-bct2] [DE:*Staphylococcus epidermidis* phenol soluble modulin beta
1 and phenolsoluble modulin beta 2 genes, complete cds.] [NT:PSM beta 1]
[LE:669] [RE:803] [DI:direct] >gp:[GI:g3212080] [LN:AF068633] [AC:AF068633]
[PN:phenol soluble modulin beta 2] [FN:inflammatory protein]
[OR:*Staphylococcus epidermidis*] [DB:genpept-bct2] [DE:*Staphylococcus
epidermidis* phenol soluble modulin beta 1 and phenol soluble modulin beta 2
genes, complete cds.] [NT:PSM beta 2] [LE:859] [RE:993] [DI:direct]

| ORF Name | NT ID | AA ID | NT LN | AA LN | Score | P-Value |
|---|---|---|---|---|---|---|
| AI7503000990_24261068_c3_988 | 1783 | 5555 | 147 | 48 | 215 | 1.2e−17 |

Description
gp:[GI:g3212079] [LN:AF068633] [AC:AF068633] [PN:phenol soluble modulin beta
1] [FN:inflammatory protein] [OR:*Staphylococcus epidermidis*]
[DB:genpept-bct2] [DE:*Staphylococcus epidermidis* phenol soluble modulin beta
1 and phenol soluble modulin beta 2 genes, complete cds.] [NT:PSM beta 1]
[LE:669] [RE:803] [DI:direct] >gp:[GI:g3212080] [LN:AF068633] [AC:AF068633]
[PN:phenol soluble modulin beta 2] [FN:inflammatory protein]
[OR:*Staphylococcus epidermidis*] [DB:genpept-bct2] [DE:*Staphylococcus
epidermidis* phenol soluble modulin beta 1 and phenol soluble modulin beta 2
genes, complete cds.] [NT:PSM beta 2] [LE:859] [RE:993] [DI:direct]

| ORF Name | NT ID | AA ID | NT LN | AA LN | Score | P-Value |
|---|---|---|---|---|---|---|
| AI7503000990_24275137_f1_21 | 1784 | 5556 | 132 | 43 | | |

Description
NO-HIT

| ORF Name | NT ID | AA ID | NT LN | AA LN | Score | P-Value |
|---|---|---|---|---|---|---|
| AI7503000990_24297217_c1_780 | 1785 | 5557 | 3114 | 1037 | 3756 | 0.0 |

Description
sp:[LN:CARB_BACCL] [AC:P46537] [GN:PYRAB] [OR:*BACILLUS CALDOLYTICUS*]
[EC:6.3.5.5] [DE:(EC 6.3.5.5) (CARBAMOYL-PHOSPHATE SYNTHETASE AMMONIA
CHAIN)] [SP:P46537] [DB:swissprot] >pir:[LN:I40169] [AC:I40169:S34321]
[PN:carbamoyl-phosphate synthase (glutamine-hydrolyzing),] [GN:pyrAb]
[CL:carbamoyl-phosphate synthase (glutamine-hydrolyzing) large chain:biotin
carboxylase homology:carbamoyl-phosphate synthase (glutamine-hydrolyzing)
large chain homology] [OR:*Bacillus caldolyticus*] [EC:6.3.5.5] [DB:pir2]
>gp:[GI:g312443] [LN:BCPYR] [AC:X73308] [PN:carbamoyl-phosphate synthase]
[GN:PyrAb] [OR:*Bacillus caldolyticus*] [DB:genpept-bct1] [EC:6.3.5.5]
[DE:*B. caldolyticus* pyrimidine biosynthesis genes.] [SP:P46537] [LE:3658]
[RE:6855] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000990_24330337_f3_557 | 1786 | 5558 | 957 | 318 | 555 | 1.1e−53 |

Description
pir:[LN:H69984] [AC:H69984] [PN:conserved hypothetical protein ysgB]
[GN:ysgB ] [OR:*Bacillus subtilis*] [DB:pir2] >gp:[GI:e1184111:g2635327]
[LN:BSUB0015] [AC:Z99118:AL009126] [GN:ysgB] [FN:unknown] [OR:*Bacillus subtilis*] [DB:genpept-bct1] [DE:*Bacillus subtilis* complete genome (section
15 of 21):from 2795131 to 3013540.] [NT:similar to hypothetical proteins]
[LE:130003] [RE:130944] [DI:direct] >gp:[GI:e1165326:g1770032] [LN:BSZ75208]
[AC:Z75208] [PN:hypothetical protein] [GN:ysgB] [OR:*Bacillus subtilis*]
[DB:genpept-bct1] [DE:*B. subtilis* genomic sequence 89009bp.] [NT:unknown
function; putative] [LE:38963] [RE:39904] [DI:complement]

| ORF Name | NT ID | AA ID | NT LN | AA LN | Score | P-Value |
|---|---|---|---|---|---|---|
| AI7503000990_24351577_c1_677 | 1787 | 5559 | 171 | 56 | | |

Description
NO-HIT

| ORF Name | NT ID | AA ID | NT LN | AA LN | Score | P-Value |
|---|---|---|---|---|---|---|
| AI7503000990_24355342_c1_799 | 1788 | 5560 | 1014 | 338 | 1265 | 6.6e−129 |

Description
sp:[LN:SR54_BACSU] [AC:P37105] [GN:FFH] [OR:*BACILLUS SUBTILIS*] [DE:SIGNAL
RECOGNITION PARTICLE PROTEIN (FIFTY-FOUR HOMOLOG)] [SP:P37105]
[DB:swissprot] >pir:[LN:B47154] [AC:B47154:H69621] [PN:signal recognition
particle chain ffh] [GN:ffh] [CL:signal recognition particle 54 K protein]
[OR:*Bacillus subtilis*] [DB:pir2] >gp:[GI:e1185189:g2633970] [LN:BSUB0009]
[AC:Z99112:AL009126] [PN:signal recognition particle] [GN:ffh] [OR:*Bacillus subtilis*] [DB:genpept-bct1] [DE:*Bacillus subtilis* complete genome (section 9
of 21):from 1598421 to 1807200.] [LE:73153] [RE:74493] [DI:direct]
>gp:[GI:d1022545:g2309080] [LN:D14356] [AC:D14356] [PN:Ffh] [GN:ffh]
[OR:*Bacillus subtilis*] [SR:*Bacillus subtilis* (strain:168) DNA]
[DB:genpept-bct1] [DE:*Bacillus subtilis* orf1, ffh, rpsP genes for ORF1, Ffh
and 30S ribosomal protein S16, complete cds.] [LE:711] [RE:2051] [DI:direct]

| ORF Name | NT ID | AA ID | NT LN | AA LN | Score | P-Value |
|---|---|---|---|---|---|---|
| AI7503000990_24406291_c2_902 | 1789 | 5561 | 417 | 138 | 369 | 5.9e−34 |

Description
pir:[LN:D69879] [AC:D69879] [PN:alkaline-shock protein homolog yloU]
[GN:yloU] [OR:*Bacillus subtilis*] [DB:pir2] >gp:[GI:e1185174:g2633955]
[LN:BSUB0009] [AC:Z99112:AL009126] [GN:yloU] [FN:unknown] [OR:*Bacillus subtilis*] [DB:genpept-bct1] [DE:*Bacillus subtilis* complete genome (section 9
of 21):from 1598421 to 1807200.] [NT:similar to alkaline-shock protein]
[LE:57043] [RE:57405] [DI:direct] >gp:[GI:e323527:g2337812] [LN:BSY13937]
[AC:Y13937] [PN:putative Asp23 protein] [GN:yloU] [FN:unknown] [OR:*Bacillus subtilis*] [DB:genpept-bct1] [DE:*Bacillus subtilis* genomic DNA from the spoVM
region.] [LE:18815] [RE:19177] [DI:direct]

| ORF Name | NT ID | AA ID | NT LN | AA LN | Score | P-Value |
|---|---|---|---|---|---|---|
| AI7503000990_24406563_c1_742 | 1790 | 5562 | 141 | 46 | | |

Description
NO-HIT

| ORF Name | NT ID | AA ID | NT LN | AA LN | Score | P-Value |
|---|---|---|---|---|---|---|
| AI7503000990_24407313_f3_590 | 1791 | 5563 | 126 | 41 | | |

Description
NO-HIT

| ORF Name | NT ID | AA ID | NT LN | AA LN | Score | P-Value |
|---|---|---|---|---|---|---|
| AI7503000990_24407327_c3_1017 | 1792 | 5564 | 612 | 203 | 621 | 1.2e−60 |

Description
sp:[LN:PYRE_BACSU] [AC:P25972] [GN:PYRE:PYRX] [OR:*BACILLUS SUBTILIS*]
[EC:2.4.2.10] [DE:OROTATE PHOSPHORIBOSYLTRANSFERASE, (OPRT) (OPRTASE)]
[SP:P25972] [DB:swissprot] >pir:[LN:F69686] [AC:F69686:A30492] [PN:orotate
phosphoribosyltransferase,] [GN:pyrE] [CL:orotate
phosphoribosyltransferase:orotate phosphoribosyltransferase homology]
[OR:*Bacillus subtilis*] [EC:2.4.2.10] [DB:pir1] >gp:[GI:e1185148:g2633929]
[LN:BSUB0009] [AC:Z99112:AL009126] [PN:orotate phosphoribosyltransferase]

-continued

[GN:pyrE] [FN:pyrimidine biosynthesis] [OR:*Bacillus subtilis*]
[DB:genpept-bct1] [EC:2.4.2.10] [DE:*Bacillus subtilis* complete genome
(section 9 of 21):from 1598421 to 1807200.] [NT:alternate gene name:pyrX]
[SP:P25972] [LE:30299] [RE:30949] [DI:direct] >gp:[GI:g143394] [LN:BACPYROP]
[AC:M59757] [PN:OMP-PRPP transferase] [GN:pyrE] [OR:*Bacillus subtilis*]
[DB:genpept-bct2] [DE:*Bacillus subtilis* ORF1A (pyrR), putative
membrane-bound uracilpermease (pyrP), aspartate transcarbamylase (pyrB),
dihydroorotase (pyrC), glutaminase of carbamyl phosphate synthetase
(pyrAA), carbamyl phosphate synthetase (pyrAB), dihydroorotase
dehydrogenase (pyrD), OMP decarboxylase (pyrF), and OMP-PRPP transferase
(pyrE) genes, complete cds; and unknown gene.] [LE:11703] [RE:12353]
[DI:direct]

| ORF Name | NT ID | AA ID | NT LN | AA LN | Score | P-Value |
| --- | --- | --- | --- | --- | --- | --- |
| AI7503000990_24407760_c1_773 | 1793 | 5565 | 123 | 40 | | |

Description
NO-HIT

| ORF Name | NT ID | AA ID | NT LN | AA LN | Score | P-Value |
| --- | --- | --- | --- | --- | --- | --- |
| AI7503000990_24407936_c2_896 | 1794 | 5566 | 1122 | 373 | 1380 | 4.3e−141 |

Description
sp:[LN:YLON_BACSU] [AC:O34617] [GN:YLON] [OR:*BACILLUS SUBTILIS*]
[DE:HYPOTHETICAL 41.6 KD PROTEIN IN FMT-SPOVM INTERGENIC REGION] [SP:O34617]
[DB:swissprot] >pir:[LN:F69878] [AC:F69878] [PN:conserved hypothetical
protein yloN] [GN:yloN] [CL:conserved hypothetical protein HI0365]
[OR:*Bacillus subtilis*] [DB:pir2] >gp:[GI:e1185166:g2633947] [LN:BSUB0009]
[AC:Z99112:AL009126] [GN:yloN] [FN:unknown] [OR:*Bacillus subtilis*]
[DB:genpept-bct1] [DE:*Bacillus subtilis* complete genome (section 9 of 21):
from 1598421 to 1807200.] [NT:similar to hypothetical proteins] [SP:O34617]
[LE:50265] [RE:51356] [DI:direct] >gp:[GI:e323524:g2337804] [LN:BSY13937]
[AC:Y13937] [PN:YloN protein] [GN:yloN] [FN:unknown] [OR:*Bacillus subtilis*]
[DB:genpept-bct1] [DE:*Bacillus subtilis* genomic DNA from the spoVM region.]
[SP:O34617] [LE:12037] [RE:13128] [DI:direct]

| ORF Name | NT ID | AA ID | NT LN | AA LN | Score | P-Value |
| --- | --- | --- | --- | --- | --- | --- |
| AI7503000990_24412812_c3_986 | 1795 | 5567 | 225 | 74 | | |

Description
NO-HIT

| ORF Name | NT ID | AA ID | NT LN | AA LN | Score | P-Value |
| --- | --- | --- | --- | --- | --- | --- |
| AI7503000990_24415885_c3_960 | 1796 | 5568 | 1227 | 408 | 869 | 6.1e−87 |

Description
gp:[GI:g4096797] [LN:SCU40157] [AC:U40157] [OR:*Staphylococcus carnosus*]
[DB genpept-bct2] [DE:*Staphylococcus carnosus* condensing-enzyme-like protein
(orf1) and spoVE-like protein (orf2) genes, complete cds.] [NT:orf2; unknown
function; similar to spoVE, RodA,] [LE:1676] [RE:2779] [DI:direct]

| ORF Name | NT ID | AA ID | NT LN | AA LN | Score | P-Value |
| --- | --- | --- | --- | --- | --- | --- |
| AI7503000990_24422077_c3_1013 | 1797 | 5569 | 1101 | 366 | 1196 | 1.4e−121 |

Description
sp:[LN:CARA_BACCL] [AC:P52557] [GN:PYRAA] [OR:*BACILLUS CALDOLYTICUS*]
[EC:6.3.5.5] [DE:(EC 6.3.5.5) (CARBAMOYL-PHOSPHATE SYNTHETASE GLUTAMINE
CHAIN)] [SP:P52557] [DB:swissprot] >pir:[LN:I40168] [AC:I40168:S34320]
[PN:carbamoyl-phosphate synthase (glutamine-hydrolyzing),] [GN:pyrAa]
[CL:carbamoyl-phosphate synthase (glutamine-hydrolyzing) small
chain:carbamoyl-phosphate synthase (glutamine-hydrolyzing) small chain
homology:trpG homology] [OR:*Bacillus caldolyticus*] [EC:6.3.5.5] [DB:pir2]
>gp:[GI:g312442] [LN:BCPYR] [AC:X73308] [PN:carbamoyl-phosphate synthase]
[GN:PyrAa] [OR:*Bacillus caldolyticus*] [DB:genpept-bct1] [EC:6.3.5.5]
[DE:*B. caldolyticus* pyrimidine biosynthesis genes.] [SP:P52557] [LE:2571]
[RE:3665] [DI:direct]

| ORF Name | NT ID | AA ID | NT LN | AA LN | Score | P-Value |
| --- | --- | --- | --- | --- | --- | --- |
| AI7503000990_24424038_c1_791 | 1798 | 5570 | 1692 | 563 | 1538 | 7.8e−158 |

Description
pir:[LN:E69879] [AC:E69879] [PN:conserved hypothetical protein yloV]
[GN:yloV] [CL:*Mycoplasma genitalium* hypothetical protein MG369]

[OR:*Bacillus subtilis*] [DB:pir2] >gp:[GI:e1185175:g2633956] [LN:BSUB0009]
[AC:Z99112:AL009126] [GN:yloV] [FN:unknown] [OR:*Bacillus subtilis*]
[DB:genpept-bct1] [DE:*Bacillus subtilis* complete genome (section 9 of 21):
from 1598421 to 1807200.] [NT:similar to hypothetical proteins] [LE:57421]
[RE:59082] [DI:direct] >gp:[GI:e323510:g2337813] [LN:BSY13937] [AC:Y13937]
[PN:YloV protein] [GN:yloV] [FN:unknown] [OR:*Bacillus subtilis*]
[DB:genpept-bct1] [DE:*Bacillus subtilis* genomic DNA from the spoVM region.]
[LE:19193] [RE:20854] [DI:direct]

| ORF Name | NT ID | AA ID | NT LN | AA LN | Score | P-Value |
|---|---|---|---|---|---|---|
| AI7503000990_24475252_f2_371 | 1799 | 5571 | 159 | 52 | | |

Description
NO-HIT

| ORF Name | NT ID | AA ID | NT LN | AA LN | Score | P-Value |
|---|---|---|---|---|---|---|
| AI7503000990_24484828_c2_832 | 1800 | 5572 | 552 | 183 | 311 | 8.2e−28 |

Description
gp:[GI:g4981179] [LN:AE001739] [AC:AE001739:AE000512] [PN:conserved
hypothetical protein] [GN:TM0656] [OR:*Thermotoga maritima*] [DB:genpept-bct2]
[DE:*Thermotoga maritima* section 51 of 136 of the complete genome.]
[NT:similar to SP:P38522 GB:U00096 PID:1742120] [LE:1379] [RE:1909]
[DI:complement]

| ORF Name | NT ID | AA ID | NT LN | AA LN | Score | P-Value |
|---|---|---|---|---|---|---|
| AI7503000990_24485950_c3_951 | 1801 | 5573 | 537 | 178 | 91 | 0.015 |

Description
gp:[GI:g5306139] [LN:AF160864] [AC:AF160864] [PN:NADH dehydrogenase subunit
2] [GN:nad2] [OR:Mitochondrion *Tetrahymena pyriformis*] [SR:*Tetrahymena
pyriformis*] [DB:genpept] [EC:1.6.5.3] [DE:*Tetrahymena pyriformis*
mitochondrial DNA, complete genome.] [LE:10108] [RE:10644] [DI:complement]

| ORF Name | NT ID | AA ID | NT LN | AA LN | Score | P-Value |
|---|---|---|---|---|---|---|
| AI7503000990_24609637_c3_1001 | 1802 | 5574 | 798 | 265 | 916 | 6.4e−92 |

Description
gp:[GI:g4009492] [LN:AF068904] [AC:AF068904] [PN:YlmD] [GN:ylmD]
[OR:*Staphylococcus aureus*] [DB:genpept-bct2] [DE:*Staphylococcus aureus* cell
division protein FtsZ (ftsZ) gene, partial cds; YlmD (ylmD), YlmE (ylmE),
YlmF (ylmF), YlmG (ylmG), and YlmH (ylmH) genes, complete cds; and cell
division protein DivIVA (divIVA) gene, partial cds.] [NT:similar to *Bacillus
subtilis* YlmD] [LE:437] [RE:1228] [DI:direct]

| ORF Name | NT ID | AA ID | NT LN | AA LN | Score | P-Value |
|---|---|---|---|---|---|---|
| AI7503000990_24610885_f2_352 | 1803 | 5575 | 423 | 140 | | |

Description
NO-HIT

| ORF Name | NT ID | AA ID | NT LN | AA LN | Score | P-Value |
|---|---|---|---|---|---|---|
| AI7503000990_24632827_c1_786 | 1804 | 5576 | 963 | 320 | 917 | 5.06e−92 |

Description
pir:[LN:A69626] [AC:A69626] [PN:methionyl-tRNA formyltransferase, fmt]
[GN:fmt] [CL:methionyl-tRNA formyltransferase:phosphoribosylglycinamide
formyltransferase homology] [OR:*Bacillus subtilis*] [EC:2.1.2.9] [DB:pir2]
>gp:[GI:e1185164:g2633945] [LN:BSUB0009] [AC:Z99112:AL009126]
[PN:methionyl-tRNA formyltransferase] [GN:fmt] [OR:*Bacillus subtilis*]
[DB:genpept-bct1] [EC:2.1.2.9] [DE:*Bacillus subtilis* complete genome
(section 9 of 21):from 1598421 to 1807200.] [NT:alternate gene name:yloL]
[LE:47978] [RE:48931] [DI:direct] >gp:[GI:e323503:g2337802] [LN:BSY13937]
[AC:Y13937] [PN:putative Fmt protein] [GN:yloL] [FN:unknown] [OR:*Bacillus
subtilis*] [DB:genpept-bct1] [DE:*Bacillus subtilis* genomic DNA from the spoVM
region.] [LE:9750] [RE:10703] [DI:direct]

| ORF Name | NT ID | AA ID | NT LN | AA LN | Score | P-Value |
|---|---|---|---|---|---|---|
| AI7503000990_24642042_c2_853 | 1805 | 5577 | 561 | 186 | 255 | 7.1e−22 |

-continued

Description
pir:[LN:C69875] [AC:C69875] [PN:hypothetical protein ylbN] [GN:ylbN]
[OR:*Bacillus subtilis*] [DB:pir2] >gp:[GI:e334782:g2340010] [LN:BS16823KB]
[AC:Z98682] [PN:YlbN protein] [GN:ylbN] [OR:*Bacillus subtilis*]
[DB:genpept-bct1] [DE:*Bacillus subtilis* genomic DNA 23.9 kB fragment.]
[LE:20393] [RE:20911] [DI:direct] >gp:[GI:e1185097:g2633878] [LN:BSUB0008]
[AC:Z99111:AL009126] [GN:ylbN] [FN:unknown] [OR:*Bacillus subtilis*]
[DB:genpept-bct1] [DE:*Bacillus subtilis* complete genome (section 8 of 21):
from 1394791 to 1603020.] [LE:179876] [RE:180394] [DI:direct]

| ORF Name | NT ID | AA ID | NT LN | AA LN | Score | P-Value |
|---|---|---|---|---|---|---|
| AI7503000990_24642817_c2_862 | 1806 | 5578 | 810 | 269 | 1197 | 1.1e−121 |

Description
sp:[LN:MURI_STAHA] [AC:P52974] [GN:DGA] [OR:*STAPHYLOCOCCUS HAEMOLYTICUS*]
[EC:5.1.1.3] [DE:GLUTAMATE RACEMASE,] [SP:P52974] [DB:swissprot]
>gp:[GI:g520574] [LN:SHU12405] [AC:U12405] [PN:glutamate racemase] [GN:dga]
[OR:*Staphylococcus haemolyticus*] [DB:genpept-bct1] [DE:*Staphylococcus
haemolyticus* Y176 glutamate racemase (dga) gene complete cds.] [LE:263]
[RE:1063] [DI:direct]

| ORF Name | NT ID | AA ID | NT LN | AA LN | Score | P-Value |
|---|---|---|---|---|---|---|
| AI7503000990_24643836_c3_943 | 1807 | 5579 | 633 | 210 | 227 | 6.6e−19 |

Description
pir:[LN:D69870] [AC:D69870:A36718] [PN:conserved hypothetical protein
ykyA:hypothetical protein (aceA 5′ region)] [GN:ykyA] [OR:*Bacillus
subtilis*] [DB:pir2] >gp:[GI:e1185047:g2633828] [LN:BSUB0008]
[AC:Z99111:AL009126] [GN:ykyA] [FN:unknown] [OR:*Bacillus subtilis*]
[DB:genpept-bct1] [DE:*Bacillus subtilis* complete genome (section 8 of 21):
from 1394791 to 1603020.] [NT:alternate gene name:ykrC; similar to
hypothetical] [LE:131900] [RE:132517] [DI:direct] >gp:[GI:g3282141]
[LN:AF012285] [AC:AF012285:AF012284:U51911] [PN:unknown] [GN:ykrC]
[FN:unknown] [OR:*Bacillus subtilis*] [DB:genpept-bct2] [DE:*Bacillus subtilis*
mobA-nprE gene region.] [NT:similar to Orf5 encoded by GenBank Accession]
[LE:32388] [RE:33005] [DI:direct]

| ORF Name | NT ID | AA ID | NT LN | AA LN | Score | P-Value |
|---|---|---|---|---|---|---|
| AI7503000990_24645025_c3_1012 | 1808 | 5580 | 1284 | 427 | 1287 | 3.1e−131 |

Description
sp:[LN:PYRC_BACCL] [AC:P46538] [GN:PYRC] [OR:*BACILLUS CALDOLYTICUS*]
[EC:3.5.2.3] [DE:DIHYDROOROTASE, (DHOASE)] [SP:P46538] [DB:swissprot]
>pir:[LN:I40167] [AC:I40167:S34319] [PN:dihydroorotase,] [GN:pyrC]
[CL:*Bacillus dihydroorotase:Bacillus dihydroorotase* homology] [OR:*Bacillus
caldolyticus*] [EC:3.5.2.3] [DB:pir2] >gp:[GI:g312441] [LN:BCPYR] [AC:X73308]
[PN:*dihydroorotase*] [GN:PyrC] [OR:*Bacillus caldolyticus*] [DB:genpept-bct1]
[EC:3.5.2.3] [DE:*B. caldolyticus* pyrimidine biosynthesis genes.] [SP:P46538]
[LE:1285] [RE:2568] [DI:direct]

| ORF Name | NT ID | AA ID | NT LN | AA LN | Score | P-Value |
|---|---|---|---|---|---|---|
| AI7503000990_24648412_c1_798 | 1809 | 5581 | 402 | 133 | 302 | 7.4e−27 |

Description
sp:[LN:YLXM_BACSU] [AC:P37104] [GN:YLXM] [OR:*BACILLUS SUBTILIS*]
[DE:HYPOTHETICAL 13.2 KD PROTEIN IN FFH 5′REGION] [SP:P37104] [DB:swissprot]
>pir:[LN:A47154] [AC:A47154:A69882] [PN:conserved hypothetical protein
ylxM] [GN:ylxM] [OR:*Bacillus subtilis*] [DB:pir2] >gp:[GI:e1185188:g2633969]
[LN:BSUB0009] [AC:Z99112:AL009126] [GN:ylxM] [FN:unknown] [OR:*Bacillus
subtilis*] [DB:genpept-bct1] [DE:*Bacillus subtilis* complete genome (section 9
of 21):from 1598421 to 1807200.] [NT:similar to hypothetical proteins]
[LE:72807] [RE:73139] [DI:direct] >gp:[GI:d1023083:g2424968] [LN:D14356]
[AC:D14356] [PN:ORF1] [GN:orf1] [OR:*Bacillus subtilis*] [SR:*Bacillus subtilis*
(strain:168) DNA] [DB:genpept-bct1] [DE:*Bacillus subtilis* orf1, ffh, rpsP
genes for ORF1, Ffh and 30S ribosomal protein S16, complete cds.] [LE:365]
[RE:697] [DI:direct]

| ORF Name | NT ID | AA ID | NT LN | AA LN | Score | P-Value |
|---|---|---|---|---|---|---|
| AI7503000990_24652178_c2_847 | 1810 | 5582 | 477 | 158 | 174 | 2.7e−13 |

Description
pir:[LN:F69930] [AC:F69930] [PN:conserved hypothetical protein yozB]
[GN:yozB] [OR:*Bacillus subtilis*] [DB:pir2] >gp:[GI:e1185386:g2634307]
[LN:BSUB0011] [AC:Z99114:AL009126] [GN:yozB] [FN:unknown] [OR:*Bacillus -continued subtilis] [DB:genpept-bct1] [DE:*Bacillus subtilis* complete genome (section
11 of 21):from 2000171 to 2207900.] [NT:similar to hypothetical proteins]
[LE:85155] [RE:85691] [DI:complement]

| ORF Name | NT ID | AA ID | NT LN | AA LN | Score | P-Value |
|---|---|---|---|---|---|---|
| AI7503000990_24730340_c3_937 | 1811 | 5583 | 672 | 223 | 731 | 2.6e−72 |

Description
sp:[LN:YKQB_BACSU] [AC:P39760] [GN:YKQB] [OR:*BACILLUS SUBTILIS*]
[DE:HYPOTHETICAL 24.3 KD PROTEIN IN KINC-ADEC INTERGENIC REGION (ORF4)]
[SP:P39760] [DB:swissprot] >pir:[LN:A69862] [AC:A69862:PC6016]
[PN:conserved hypothetical protein ykqB] [GN:ykqB] [CL:conserved
hypothetical protein MG323] [OR:*Bacillus subtilis*] [DB:pir2]
>gp:[GI:d1007628:g520844] [LN:BACAMOKOOO] [AC:D37799] [PN:orf4] [OR:*Bacillus
subtilis*] [SR:*Bacillus subtilis* (sub_species:*Marburg*, strain:168]
[DB:genpept-bct1] [DE:*Bacillus subtilis* genes for ampS, mreBH, orf1, kinC,
orf3, orf4 and orf5.] [LE:5175] [RE:5840] [DI:direct]
>gp:[GI:e1185041:g2633822] [LN:BSUB0008] [AC:Z99111:AL009126] [GN:ykqB]
[FN:unknown] [OR:*Bacillus subtilis*] [DB:genpept-bct1] [DE:*Bacillus subtilis*
complete genome (section 8 of 21):from 1394791 to 1603020.] [NT:alternate
gene name:ylxV, yzaC; similar to] [SP:P39760] [LE:125146] [RE:125811]
[DI:direct] >gp:[GI:g3282136] [LN:AF012285] [AC:AF012285:AF012284:U51911]
[PN:unknown] [GN:ykqA] [FN:unknown] [OR:*Bacillus subtilis*] [DB:genpept-bct2]
[DE:*Bacillus subtilis* mobA-nprE gene region.] [NT:similar to product of orf4
encoded by GenBank] [LE:25634] [RE:26299] [DI:direct]

| ORF Name | NT ID | AA ID | NT LN | AA LN | Score | P-Value |
|---|---|---|---|---|---|---|
| AI7503000990_24801713_c3_946 | 1812 | 5584 | 1314 | 437 | 1906 | 7.9e−197 |

Description
sp:[LN:ODP2_STAAU] [AC:Q59821] [GN:PDHC] [OR:*STAPHYLOCOCCUS AUREUS*]
[EC:2.3.1.12] [DE:COMPLEX, (E2)] [SP:Q59821] [DB:swissprot] >pir:[LN:S19722]
[AC:S19722] [PN:dihydrolipoamide S-acetyltransferase, chain E2]
[CL:dihydrolipoamide acetyltransferase:lipoyl/biotin-binding homology]
[OR:*Staphylococcus aureus*] [EC:2.3.1.12] [DB:pir2] >gp:[GI:g581570]
[LN:SAPDHDNA] [AC:X58434:S73625] [PN:dihydrolipoamide acetyltransferase:
subunit E2] [GN:pdhC] [OR:*Staphylococcus aureus*] [DB:genpept-bct1]
[EC:2.3.1.12] [DE:*S. aureus* pdhB, pdhC and pdhD genes for pyruvate
decarboxylase, dihydrolipoamide acetyltransferase and
dihydrolipoamidedehydrogenase.] [SP:Q59821] [LE:557] [RE:1849] [DI:direct]

| ORF Name | NT ID | AA ID | NT LN | AA LN | Score | P-Value |
|---|---|---|---|---|---|---|
| AI7503000990_24806587_c2_848 | 1813 | 5585 | 1056 | 351 | 399 | 3.9e−37 |

Description
pir:[LN:H69873] [AC:H69873] [PN:conserved hypothetical protein ylbC]
[GN:ylbC] [OR:*Bacillus subtilis*] [DB:pir2] >gp:[GI:e334771:g2339999]
[LN:BS16823KB] [AC:Z98682] [PN:YlbC protein] [GN:ylbC] [OR:*Bacillus
subtilis*] [DB:genpept-bct1] [DE:*Bacillus subtilis* genomic DNA 23.9 kB
fragment.] [LE:11510] [RE:12550] [DI:direct] >gp:[GI:e1185086:g2633867]
[LN:BSUB0008] [AC:Z99111:AL009126] [GN:ylbC] [FN:unknown] [OR:*Bacillus
subtilis*] [DB:genpept-bct1] [DE:*Bacillus subtilis* complete genome (section 8
of 21):from 1394791 to 1603020.] [NT:similar to hypothetical proteins from
*B. subtilis*] [LE:170993] [RE:1720331 [DI:direct]

| ORF Name | NT ID | AA ID | NT LN | AA LN | Score | P-Value |
|---|---|---|---|---|---|---|
| AI7503000990_24851577_c3_971 | 1814 | 5586 | 564 | 187 | 405 | 9.0e−38 |

Description
pir:[LN:E69874] [AC:E69874] [PN:conserved hypothetical protein ylbH]
[GN:ylbH] [OR:*Bacillus subtilis*] [DB:pir2] >gp:[GI:e334776:g2340004]
[LN:BS16823KB] [AC:Z98682] [PN:YlbH protein] [GN:ylbH] [OR:*Bacillus
subtilis*] [DB:genpept-bct1] [DE:*Bacillus subtilis* genomic DNA 23.9 kB
fragment.] [LE:14650] [RE:15144] [DI:direct] >gp:[GI:e1185091:g2633872]
[LN:BSUB0008] [AC:Z99111:AL009126] [GN:ylbH] [FN:unknown] [OR:*Bacillus
subtilis*] [DB:genpept-bct1] [DE:*Bacillus subtilis* complete genome (section 8
of 21):from 1394791 to 1603020.] [NT:similar to hypothetical proteins]
[LE:174133] [RE:174627] [DI:direct]

| ORF Name | NT ID | AA ID | NT LN | AA LN | Score | P-Value |
|---|---|---|---|---|---|---|
| AI7503000990_25425202_c1_749 | 1815 | 5587 | 522 | 173 | 196 | 1.3e−15 |

Description
pir:[LN:B69985] [AC:B69985] [PN:hypothetical protein yshB] [GN:yshB]

-continued

[OR:*Bacillus subtilis*] [DB:pir2] >gp:[GI:e1184109:g2635325] [LN:BSUB0015]
[AC:Z99118:AL009126] [GN:yshB] [FN:unknown] [OR:*Bacillus subtilis*]
[DB:genpept-bct1] [DE:*Bacillus subtilis* complete genome (section 15 of 21):
from 2795131 to 3013540.] [LE:129072] [RE:129605] [DI:complement]
>gp:[GI:e1165328:g1770034] [LN:BSZ75208] [AC:Z75208] [PN:hypothetical
protein] [GN:yshB] [OR:*Bacillus subtilis*] [DB:genpept-bct1] [DE:*B. subtilis*
genomic sequence 89009bp.] [NT:unknown function; putative] [LE:40302]
[RE:40835] [DI:direct]

| ORF Name | NT ID | AA ID | NT LN | AA LN | Score | P-Value |
|---|---|---|---|---|---|---|
| AI7503000990_25475250_c3_985 | 1816 | 5588 | 1827 | 608 | 2503 | 4.3e−260 |

Description
pir:[LN:A27763] [AC:A27763:C69704] [PN:succinate dehydrogenase,
flavoprotein:fumarate reductase:fumaric hydrogenase:succinic dehydrogenase]
[GN:sdhA:sdhB] [CL:fumarate reductase flavoprotein:3-oxosteroid
1-dehydrogenase homology:fumarate reductase flavoprotein homology]
[OR:*Bacillus subtilis*] [EC:1.3.99.1] [DB:pir2]

| ORF Name | NT ID | AA ID | NT LN | AA LN | Score | P-Value |
|---|---|---|---|---|---|---|
| AI7503000990_25509640_f1_185 | 1817 | 5589 | 240 | 79 | 75 | 0.0084 |

Description
sp:[LN:YRUB_CLOPA] [AC:P23171] [OR:*CLOSTRIDIUM PASTEURIANUM*] [DE:(ORF B)]
[SP:P23171] [DB:swissprot] >pir:[LN:S29118] [AC:S29118] [PN:hypothetical
protein 2] [OR:*Clostridium pasteurianum*] [DB:pir2] >gp:[GI:g144907]
[LN:CLORUB] [AC:M60116] [OR:*Clostridium pasteurianum*] [SR:*C. pasteurianum*
(strain ATCC 6013) DNA] [DB:genpept-bct1] [DE:*C. pasteurianum* open reading
frame A, B, C, and rubredoxin gene, complete cds.] [NT:open reading frame B]
[LE:1126] [RE:1353] [DI:direct]

| ORF Name | NT ID | AA ID | NT LN | AA LN | Score | P-Value |
|---|---|---|---|---|---|---|
| AI7503000990_25604677_c1_736 | 1818 | 5590 | 450 | 149 | 322 | 5.6e−29 |

Description
pir:[LN:C69874] [AC:C69874] [PN:conserved hypothetical protein ylbF]
[GN:ylbF] [OR:*Bacillus subtilis*] [DB:pir2] >gp:[GI:e334774:g2340002]
[LN:BS16823KB] [AC:Z98682] [PN:YlbF protein] [GN:ylbF] [OR:*Bacillus
subtilis*] [DB:genpept-bct1] [DE:*Bacillus subtilis* genomic DNA 23.9 kB
fragment.] [LE:13551] [RE:14000] [DI:direct] >gp:[GI:e1185089:g2633870]
[LN:BSUB0008] [AC:Z99111:AL009126] [GN:ylbF] [FN:unknown] [OR:*Bacillus
subtilis*] [DB:genpept-bct1] [DE:*Bacillus subtilis* complete genome (section 8
of 21):from 1394791 to 1603020.] [NT:similar to hypothetical proteins]
[LE:173034] [RE:173483] [DI:direct]

| ORF Name | NT ID | AA ID | NT LN | AA LN | Score | P-Value |
|---|---|---|---|---|---|---|
| AI7503000990_25635962_c3_1008 | 1819 | 5591 | 486 | 161 | 274 | 6.9e−24 |

Description
gp:[GI:e244971:g1340128] [LN:SA1234] [AC:X97985] [OR:*Staphylococcus aureus*]
[DB:genpept-bct1] [DE:*S. aureus* orfs 1,2,3 & 4.] [NT:ORF1] [LE:537] [RE:1304]
[DI:direct]

| ORF Name | NT ID | AA ID | NT LN | AA LN | Score | P-Value |
|---|---|---|---|---|---|---|
| AI7503000990_25816552_c3_1004 | 1820 | 5592 | 777 | 258 | 984 | 4.0e−99 |

Description
gp:[GI:g4009496] [LN:AF068904] [AC:AF068904] [PN:YlmH] [GN:ylmH]
[OR:*Staphylococcus aureus*] [DB genpept-bct2] [DE *Staphylococcus aureus* cell
division protein FtsZ (ftsZ) gene, partial cds; YlmD (ylmD), YlmE (ylmE),
YlmF (ylmF), YlmG (ylmG), and YlmH (ylmH) genes, complete cds; and cell
division protein DivIVA (divIVA) gene, partial cds.] [NT:similar to *Bacillus
subtilis* YlmH] [LE:2865] [RE:3671] [DI:direct]

| ORF Name | NT ID | AA ID | NT LN | AA LN | Score | P-Value |
|---|---|---|---|---|---|---|
| AI7503000990_25818811_c2_841 | 1821 | 5593 | 153 | 50 | 162 | 5.1e−12 |

Description
gp:[GI:g1022725] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF2] [LE:394] [RE:1083] [DI:complement] >gp:[GI:g295162] [LN:STAMECRA]
[AC:L14017] [OR:*Staphylococcus aureus*] [SR:*Staphylococcus aureus* (strain COL) DNA] [DB:genpept-bct1] [DE:*Staphylococcus aureus* methicillin-resistance protein (mecR) gene and unknown ORF, complete cds.] [NT:unknown ORF1; putative] [LE:1492] [RE:2181] [DI:complement]

| ORF Name | NT ID | AA ID | NT LN | AA LN | Score | P-Value |
|---|---|---|---|---|---|---|
| AI7503000990__25939030__f2__399 | 1822 | 5594 | 183 | 60 | | |

Description
NO-HIT

| ORF Name | NT ID | AA ID | NT LN | AA LN | Score | P-Value |
|---|---|---|---|---|---|---|
| AI7503000990__25972207__f1__6 | 1823 | 5595 | 126 | 41 | | |

Description
NO-HIT

| ORF Name | NT ID | AA ID | NT LN | AA LN | Score | P-Value |
|---|---|---|---|---|---|---|
| AI7503000990__25976401__f3__533 | 1824 | 5596 | 150 | 49 | | |

Description
NO-HIT

| ORF Name | NT ID | AA ID | NT LN | AA LN | Score | P-Value |
|---|---|---|---|---|---|---|
| AI7503000990__26354550__c1__740 | 1825 | 5597 | 192 | 63 | | |

Description
NO-HIT

| ORF Name | NT ID | AA ID | NT LN | AA LN | Score | P-Value |
|---|---|---|---|---|---|---|
| AI7503000990__26423305__c1__767 | 1826 | 5598 | 336 | 111 | 386 | 9.3e−36 |

Description
gp:[GI:g4009495] [LN:AF068904] [AC:AF068904] [PN:YlmG] [GN:ylmG] [OR:*Staphylococcus aureus*] [DB:genpept-bct2] [DE:*Staphylococcus aureus* cell division protein FtsZ (ftsZ) gene, partial cds; YlmD (ylmD), YlmE (ylmE), YlmF (ylmF), YlmG (ylmG), and YlmH (ylmH) genes, complete cds; and cell division protein DivIVA (divIVA) gene, partial cds.] [NT:similar to *Bacillus subtilis* YlmG] [LE:2492] [RE:2782] [DI:direct]

| ORF Name | NT ID | AA ID | NT LN | AA LN | Score | P-Value |
|---|---|---|---|---|---|---|
| AI7503000990__26597077__c2__875 | 1827 | 5599 | 1398 | 465 | 1113 | 8.5e−113 |

Description
gp:[GI:g2149896] [LN:SAU94706] [AC:U94706] [PN:cell division protein] [GN:div1B] [OR:*Staphylococcus aureus*] [DB:genpept-bct2] [DE:*Staphylococcus aureus* strain ATCC 8325-4 cell wall/cell division gene cluster, yllB, yllC, yllD, pbpA, mraY, murD, div1B, ftsA and ftsZ genes, complete cds.] [LE:7179] [RE:8498] [DI:direct]

| ORF Name | NT ID | AA ID | NT LN | AA LN | Score | P-Value |
|---|---|---|---|---|---|---|
| AI7503000990__26598402__c3__1011 | 1828 | 5600 | 1314 | 437 | 1251 | 2.0e−127 |

Description
sp:[LN:PYRP_BACCL] [AC:P41006] [GN:PYRP] [OR:*BACILLUS CALDOLYTICUS*] [DE:URACIL PERMEASE (URACIL TRANSPORTER)] [SP:P41006] [DB:swissprot] >pir:[LN:S38893] [AC:S38893] [PN:uracil transport protein:uracil permease] [CL:uracil transport protein uraA] [OR:*Bacillus caldolyticus*] [DB:pir2] >gp:[GI:g431231] [LN:BCPYRQP] [AC:X76083] [PN:uracil permease] [GN:pyrP] [OR:*Bacillus caldolyticus*] [DB:genpept-bct1] [DE:*B. caldolyticus* (DSM405) pyrR, pyrP and pyrB (partial) genes.] [SP:P41006] [LE:1490] [RE:2788] [DI:direct]

| ORF Name | NT ID | AA ID | NT LN | AA LN | Score | P-Value |
|---|---|---|---|---|---|---|
| AI7503000990__26614167__c1__795 | 1829 | 5601 | 240 | 79 | 238 | 4.5e−20 |

Description
sp:[LN:ACP_BACSU] [AC:P80643:P51832] [GN:ACPA:ACPP] [OR:*BACILLUS SUBTILIS*] [DE:ACYL CARRIER PROTEIN (ACP)] [SP:P80643:P51832] [DB:swissprot] >pir:[LN:JC4822] [AC:JC4822:A69582 ] [PN:acyl carrier protein:8.5 K protein] [GN:acpA:srb] [CL:acyl carrier protein:acyl carrier protein homology] [OR:*Bacillus subtilis*] [DB:pir2] >gp:[GI:e1185183:g2633964] [LN:BSUB0009] [AC:Z99112:AL009126] [PN:acyl carrier protein] [GN:acpA] [FN:fatty acid -continued biosynthesis] [OR:*Bacillus subtilis*] [DB:genpept-bct1] [DE:*Bacillus subtilis*
complete genome (section 9 of 21):from 1598421 to 1807200.] [NT:alternate
gene name:acpP] [SP:P80643] [LE:66316] [RE:66549] [DI:direct]
>gp:[GI:d1011632:g1237013] [LN:D64116] [AC:D64116] [PN:ORF2] [GN:orf2]
[OR:*Bacillus subtilis*] [SR:*Bacillus subtilis* DNA] [DB:genpept-bct1]
[DE:*Bacillus subtilis* genes for ORF1, ORF2, ORF3, ORF4 and Srb, partial and
complete cds.] [LE:140] [RE:373] [DI:direct]

| ORF Name | NT ID | AA ID | NT LN | AA LN | Score | P-Value |
|---|---|---|---|---|---|---|
| AI7503000990__26828187__f1__147 | 1830 | 5602 | 504 | 167 | 187 | 1.1e−14 |

Description
pir:[LN:B69873] [AC:B69873] [PN:hypothetical protein ylaL] [GN:ylaL]
[OR:*Bacillus subtilis*] [DB:pir2] >gp:[GI:e1185072:g2633853] [LN:BSUB0008]
[AC:Z99111:AL009126] [GN:ylaL] [FN:unknown] [OR:*Bacillus subtilis*]
[DB:genpept-bct1] [DE:*Bacillus subtilis* complete genome (section 8 of 21):
from 1394791 to 1603020.] [LE:155412] [RE:155897] [DI:complement]
>gp:[GI:e324323:g2224771] [LN:BSZ97025] [AC:Z97025] [GN:ylaL] [OR:*Bacillus
subtilis*] [DB:genpept-bct1] [DE:*Bacillus subtilis* nprE,
yla[A,B,C,D,E,F,G,H,I,J,K,L,M,N,O] and pycA genes.] [LE:9671] [RE:10156]
[DI:complement]

| ORF Name | NT ID | AA ID | NT LN | AA LN | Score | P-Value |
|---|---|---|---|---|---|---|
| AI7503000990__2751260__f3__673 | 1831 | 5603 | 153 | 50 | | |

Description
NO-HIT

| ORF Name | NT ID | AA ID | NT LN | AA LN | Score | P-Value |
|---|---|---|---|---|---|---|
| AI7503000990__2766500__c3__938 | 1832 | 5604 | 153 | 50 | 113 | 2.8e−06 |

Description
gp:[GI:g1022726] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000990__2789801__f2__436 | 1833 | 5605 | 366 | 121 | 163 | 1.2e−11 |

Description
pir:[LN:D70070] [AC:D70070] [PN:transcription regulator homolog ywtF]
[GN:ywtF] [CL:*Bacillus subtilis* probable transcription regulator yvhJ]
[OR:*Bacillus subtilis* ] [DB:pir2]

| ORF Name | NT ID | AA ID | NT LN | AA LN | Score | P-Value |
|---|---|---|---|---|---|---|
| AI7503000990__2835285__f3__466 | 1834 | 5606 | 147 | 48 | | |

Description
NO-HIT

| ORF Name | NT ID | AA ID | NT LN | AA LN | Score | P-Value |
|---|---|---|---|---|---|---|
| AI7503000990__29319086__c1__739 | 1835 | 5607 | 519 | 172 | 467 | 2.4e−44 |

Description
pir:[LN:F69874] [AC:F69874] [PN:lipopolysaccharide core biosynthesis
homolog ylbI] [GN:ylbI] [CL:lipopolysaccharide core biosynthesis protein
kdtB] [OR:*Bacillus subtilis*] [DB:pir2] >gp:[GI:e334777:g2340005]
[LN:BS16823KB] [AC:Z98682] [PN:YlbI protein] [GN:ylbI] [OR:*Bacillus
subtilis*] [DB:genpept-bct1] [DE:*Bacillus subtilis* genomic DNA 23.9 kB
fragment.] [LE:15208] [RE:15693] [DI:direct] >gp:[GI:e1185092:g2633873]
[LN:BSUB0008] [AC:Z99111:AL009126] [GN:ylbI] [FN:unknown] [OR:*Bacillus
subtilis*] [DB:genpept-bct1] [DE:*Bacillus subtilis* complete genome (section 8
of 21):from 1394791 to 1603020.] [NT:similar to lipopolysaccharide core
biosynthesis] [LE:174691] [RE:175176] [DI:direct]

| ORF Name | NT ID | AA ID | NT LN | AA LN | Score | P-Value |
|---|---|---|---|---|---|---|
| AI7503000990__29320217__f2__271 | 1836 | 5608 | 207 | 68 | | |

Description
NO-HIT

-continued

| ORF Name | NT ID | AA ID | NT LN | AA LN | Score | P-Value |
|---|---|---|---|---|---|---|
| AI7503000990_29384818_c2_845 | 1837 | 5609 | 3465 | 1154 | 3900 | 0.0 |

Description
pir:[LN:F69685] [AC:F69685] [PN:pyruvate carboxylase pycA] [GN:pycA]
[CL:pyruvate carboxylase biotin carboxylase homology:lipoyl/biotin-binding
homology] [OR:*Bacillus subtilis*] [DB:pir2] >gp:[GI:e1185076:g2633857]
[LN:BSUB0008] [AC:Z99111:AL009126] [PN:pyruvate carboxylase] [GN:pycA]
[OR:*Bacillus subtilis*] [DB:genpept-bct1] [EC:6.4.1.1] [DE:*Bacillus subtilis*
complete genome (section 8 of 21):from 1394791 to 1603020.] [NT:alternate
gene name:ylaP] [LE:158800] [RE:162246] [DI:direct]

| ORF Name | NT ID | AA ID | NT LN | AA LN | Score | P-Value |
|---|---|---|---|---|---|---|
| AI7503000990_29410908_c2_867 | 1838 | 5610 | 129 | 42 | | |

Description
NO-HIT

| ORF Name | NT ID | AA ID | NT LN | AA LN | Score | P-Value |
|---|---|---|---|---|---|---|
| AI7503000990_29488551_f2_398 | 1839 | 5611 | 234 | 77 | 59 | 0.020 |

Description
gp:[GI:g453389] [LN:BCU05814] [AC:U05814] [PN:cytochrome C oxidase subunit
III] [GN:COIII] [FN:electron transport] [OR:*Kinetoplast Blastocrithidia
culicis*] [SR:*Blastocrithidia culicis*] [DB:genpept-inv1] [DE:*Blastocrithidia
culicis* ATCC30268 kinetoplast NADH dehydrogenase subunit 7 (ND7) gene,
partial cds, and cytochrome C oxidase subunit III (COIII) gene, complete
cds.] [LE:223] [RE:1089] [DI:direct]

| ORF Name | NT ID | AA ID | NT LN | AA LN | Score | P-Value |
|---|---|---|---|---|---|---|
| AI7503000990_30656300_c3_1030 | 1840 | 5612 | 1353 | 450 | 912 | 1.7e−91 |

Description
sp:[LN:SUN_BACSU] [AC:P94464] [GN:SUN:FMU] [OR:*BACILLUS SUBTILIS*] [DE:SUN
PROTEIN] [SP:P94464] [DB:swissprot] >pir:[LN:E69878] [AC:E69878]
[PN:RNA-binding Sun protein homolog yloM] [GN:yloM] [CL:hypothetical
protein HI0624] [OR:*Bacillus subtilis*] [DB:pir2] >gp:[GI:e1185165:g2633946]
[LN:BSUB0009] [AC:Z99112:AL009126] [GN:yloM] [FN:unknown] [OR:*Bacillus
subtilis*] [DB:genpept-bct1] [DE:*Bacillus subtilis* complete genome (section 9
of 21):from 1598421 to 1807200.] [NT:alternate gene name:sun; similar to
RNA-binding] [SP:P94464] [LE:48918] [RE:50261] [DI:direct]
>gp:[GI:e323504:g2337803] [LN:BSY13937] [AC:Y13937] [PN:putative Fmu
protein] [GN:yloM] [FN:unknown] [OR:*Bacillus subtilis*] [DB:genpept-bct1]
[DE:*Bacillus subtilis* genomic DNA from the spoVM region.] [SP:P94464]
[LE:10690] [RE:12033] [DI:direct]

| ORF Name | NT ID | AA ID | NT LN | AA LN | Score | P-Value |
|---|---|---|---|---|---|---|
| AI7503000990_30663955_c2_809 | 1841 | 5613 | 1152 | 383 | 767 | 3.9e−76 |

Description
sp:[LN:PURK_BACSU] [AC:P12045] [GN:PURK] [OR:*BACILLUS SUBTILIS*]
[EC:4.1.1.21] [DE:(AIR CARBOXYLASE) (AIRC)] [SP:P12045] [DB:swissprot]
>pir:[LN:DCBSPK] [AC:B29326:G69684] [PN:phosphoribosylaminoimidazole
carboxylase, carbon dioxide-fixation chain:phosphoribosylaminoimidazole
carboxylase chain II] [GN:purK] [CL:phosphoribosylaminoimidazole
carboxylase carbon dioxide-fixation chain:phosphoribosylaminoimidazole
carboxylase carbon dioxide-fixation chain homology] [OR:*Bacillus subtilis*]
[EC:4.1.1.21] [DB:pir1] [MP:18 min] >gp:[GI:g143365] [LN:BACPURF]
[AC:J02732:K00047] [OR:*Bacillus subtilis*] [SR:*B. subtilis* (strain DE1
(prototroph DER. or W168)) DNA, clone pPZ] [DB:genpept-bct1] [DE:*B. subtilis*
pur operon encoding purine biosynthesis enzymes, 12 genes.]
[NT:phosphoribosyl aminoimidazole carboxylase II] [LE:920] [RE:2059]
[DI:direct] >gp:[GI:e1182623:g2632957] [LN:BSUB0004] [AC:Z99107:AL009126]
[PN:phosphoribosylaminoimidazole carboxylase II] [GN:purK] [FN:purine
biosynthesis] [OR:*Bacillus subtilis*] [DB:genpept-bct1] [EC:4.1.1.21]
[DE:*Bacillus subtilis* complete genome (section 4 of 21):from 600701
to 813890.] [SP:P12045] [LE:97902] [RE:99041] [DI:direct]

| ORF Name | NT ID | AA ID | NT LN | AA LN | Score | P-Value |
|---|---|---|---|---|---|---|
| AI7503000990_30745680_f2_431 | 1842 | 5614 | 2007 | 668 | 2279 | 2.3e−236 |

Description
sp:[LN:QOX1_BACSU] [AC:P34956] [GN:QOXB:IPA-38D] [OR:*BACILLUS SUBTILIS*]

-continued

[EC:1.9.3.—] [DE:SUBUNIT QOXB) (OXIDASE AA(3) SUBUNIT 1)] [SP:P34956]
[DB:swissprot] >pir:[LN:B38129] [AC:B38129:S39693:F69687] [PN:bo-type
ubiquinol oxidase, chain I:cytochrome aa3 quinol oxidase chain I:quinol
oxidase aa3-600] [GN:qoxB] [CL:cytochrome-c oxidase chain I:cytochrome-c
oxidase chain I homology] [OR:*Bacillus subtilis*] [EC:1.10.3.—] [DB:pir2]
>gp:[GI:g143397] [LN:BACQOXA] [AC:M86548] [PN:quinol oxidase] [GN:QOXB]
[OR:*Bacillus subtilis*] [SR:*Bacillus subtilis* DNA] [DB:genpept-bct1]
[DE:*Bacillus subtilis* AA3-600 quinol oxidase (QOXA, QOXB, QOXC, QOXD) genes,
complete cds.] [LE:1846] [RE:3795] [DI:direct] >gp:[GI:g413962] [LN:BSGENR]
[AC:X73124] [GN:ipa-38d qoxB] [OR:*Bacillus subtilis*] [DB:genpept-bct1]
[DE:*B. subtilis* genomic region (325 to 333).] [SP:P34956] [LE:40298]
[RE:42247] [DI:direct] >gp:[GI:e1186315:g2636351] [LN:BSUB0020]
[AC:Z99123:AL009126] [PN:cytochrome aa3 quinol oxidase (subunit I)]
[GN:qoxB] [OR:*Bacillus subtilis*] [DB:genpept-bct1] [DE:*Bacillus subtilis*
complete genome (section 20 of 21):from 3798401 to 4010550.] [NT:alternate
gene name:ipa-38d] [SP:P34956] [LE:115715] [RE:117664] [DI:complement]

| ORF Name | NT ID | AA ID | NT LN | AA LN | Score | P-Value |
|---|---|---|---|---|---|---|
| AI7503000990__31272062__f1__183 | 1843 | 5615 | 171 | 56 | | |

Description
NO-HIT

| ORF Name | NT ID | AA ID | NT LN | AA LN | Score | P-Value |
|---|---|---|---|---|---|---|
| AI7503000990__32242890__f2__397 | 1844 | 5616 | 1701 | 566 | 1986 | 2.6e−205 |

Description
sp:[LN:YKQC__BACSU] [AC:Q45493] [GN:YKQC] [OR:*BACILLUS SUBTILIS*]
[DE:HYPOTHETICAL 61.5 KD PROTEIN IN ADEC-PDHA INTERGENIC REGION] [SP:Q45493]
[DB:swissprot] >pir:[LN:B69862] [AC:B69862] [PN:conserved hypothetical
protein ykqC] [GN:ykqC] [CL:conserved hypothetical protein MG139]
[OR:*Bacillus subtilis*] [DB:pir2] >gp:[GI:e1185043:g2633824] [LN:BSUB0008]
[AC:Z99111:AL009126] [GN:ykqC] [FN:unknown] [OR:*Bacillus subtilis*]
[DB:genpept-bct1] [DE:*Bacillus subtilis* complete genome (section 8 of 21):
from 1394791 to 1603020.] [NT:similar to hypothetical proteins] [SP:Q45493]
[LE:127733] [RE:129400] [DI:complement] >gp:[GI:g3282138] [LN:AF012285]
[AC:AF012285:AF012284:U51911] [PN:unknown] [GN:ykqC] [FN:unknown]
[OR:*Bacillus subtilis*] [DB:genpept-bct2] [DE:*Bacillus subtilis* mobA-nprE
gene region.] [NT:similar to aminopeptidase AMPS with Swiss-Prot] [LE:28221]
[RE:29888] [DI:complement]

| ORF Name | NT ID | AA ID | NT LN | AA LN | Score | P-Value |
|---|---|---|---|---|---|---|
| AI7503000990__32667138__f1__135 | 1845 | 5617 | 177 | 58 | | |

Description
NO-HIT

| ORF Name | NT ID | AA ID | NT LN | AA LN | Score | P-Value |
|---|---|---|---|---|---|---|
| AI7503000990__32756__f3__601 | 1846 | 5618 | 1401 | 466 | 748 | 4.0e−74 |

Description
pir:[LN:S62667] [AC:S62667] [PN:Nramp1 protein] [CL:natural
resistance-associated macrophage protein 1] [OR:*Oryza sativa*] [SR:, rice]
[DB:pir2]

| ORF Name | NT ID | AA ID | NT LN | AA LN | Score | P-Value |
|---|---|---|---|---|---|---|
| AI7503000990__3314128__f2__238 | 1847 | 5619 | 234 | 77 | | |

Description
NO-HIT

| ORF Name | NT ID | AA ID | NT LN | AA LN | Score | P-Value |
|---|---|---|---|---|---|---|
| AI7503000990__33153__c2__834 | 1848 | 5620 | 900 | 299 | 454 | 5.8e−43 |

Description
gp:GI:g4981938] [LN:AE001791] [AC:AE001791:AE000512]
[PN:spermidine/putrescine ABC transporter, permease] [GN:TM1377]
[OR:*Thermotoga maritima*] [DB:genpept-bct2] [DE:*Thermotoga maritima* section
103 of 136 of the complete genome.] [NT:similar to GB:L42023 SP:P45170
PID:1007357] [LE:8884] [RE:9672] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000990_33367325_c1_706 | 1849 | 5621 | 168 | 55 | | |

Description
NO-HIT

| ORF Name | NT ID | AA ID | NT LN | AA LN | Score | P-Value |
|---|---|---|---|---|---|---|
| AI7503000990_33594187_c1_728 | 1850 | 5622 | 303 | 100 | 150 | 7.1e−10 |

Description
gp:[GI:g2668605] [LN:AF015453] [AC:AF015453] [PN:unknown] [OR:*Lactobacillus rhamnosus*] [DB:genpept-bct2] [DE:*Lactobacillus* rhamnosus 6-phospho-beta-glucosidase homolog gene, partial cds; GNTR transcriptional regulator homolog and surface located protein genes, complete cds.] [NT:3.0E-ORF-1] [LE:2236] [RE:>3603] [DI:complement]

| ORF Name | NT ID | AA ID | NT LN | AA LN | Score | P-Value |
|---|---|---|---|---|---|---|
| AI7503000990_33595178_f3_476 | 1851 | 5623 | 129 | 42 | | |

Description
NO-HIT

| ORF Name | NT ID | AA ID | NT LN | AA LN | Score | P-Value |
|---|---|---|---|---|---|---|
| AI7503000990_33651636_c3_981 | 1852 | 5624 | 1776 | 951 | 1528 | 9.0e−157 |

Description
pir:[LN:C69985] [AC:C69985] [PN:probable DNA-dependent DNA polymerase beta chain yshC] [GN:yshC] [OR:*Bacillus subtilis*] [DB:pir2]
>gp:[GI:e1184108:g2635324] [LN:BSUB0015] [AC:Z99118:AL009126] [GN:yshC] [FN:unknown] [OR:*Bacillus subtilis*] [DB:genpept-bct1] [DE:*Bacillus subtilis* complete genome (section 15 of 21):from 2795131 to 3013540.] [NT:similar to DNA polymerase beta] [LE:127286] [RE:128998] [DI:complement]
>gp:[GI:e1165329:g1770035] [LN:BSZ75208] [AC:Z75208] [PN:hypothetical protein] [GN:yshC] [OR:*Bacillus subtilis*] [DB:genpept-bct1] [DE:*B. subtilis* genomic sequence 89009bp.] [NT:unknown function; putative] [LE:40909] [RE:42621] [DI:direct]

| ORF Name | NT ID | AA ID | NT LN | AA LN | Score | P-Value |
|---|---|---|---|---|---|---|
| AI7503000990_34017812_f3_480 | 1853 | 5625 | 1722 | 573 | 1369 | 6.3e−140 |

Description
pir:[LN:G69877] [AC:G69877] [PN:fibronectin-binding protein homolog yloA] [GN:yloA] [OR:*Bacillus subtilis*] [DB:pir2] >gp:[GI:e332190:g2462963] [LN:BSPYREYLO] [AC:AJ000974] [PN:putative fibronectin-binding protein] [GN:yloA] [OR:*Bacillus subtilis*] [DB:genpept-bct1] [DE:*Bacillus subtilis* pyrE to yloA gene region.] [NT:protein A-like] [LE:6297] [RE:8015] [DI:complement] >gp:[GI:e1185156:g2633937] [LN:BSUB0009] [AC:Z99112:AL009126] [GN:yloA] [FN:unknown] [OR:*Bacillus subtilis*] [DB:genpept-bct1] [DE:*Bacillus subtilis* complete genome (section 9 of 21): from 1598421 to 1807200.] [NT:similar to fibronectin-binding protein] [LE:37110] [RE:38828] [DI:complement]

| ORF Name | NT ID | AA ID | NT LN | AA LN | Score | P-Value |
|---|---|---|---|---|---|---|
| AI7503000990_34100626_f3_494 | 1854 | 5626 | 159 | 52 | | |

Description
NO-HIT

| ORF Name | NT ID | AA ID | NT LN | AA LN | Score | P-Value |
|---|---|---|---|---|---|---|
| AI7503000990_34175686_c1_686 | 1855 | 5627 | 513 | 170 | 502 | 4.7e−48 |

Description
sp:[LN:PUR6_BACSU] [AC:P12044] [GN:PURE] [OR:*BACILLUS SUBTILIS*] [EC:4.1.1.21] [DE:(EC 4.1.1.21) (AIR CARBOXYLASE) (AIRC)] [SP:P12044] [DB:swissprot] >pir:[LN:DEBSPE] [AC:A29326:D69684] [PN:phosphoribosylaminoimidazole carboxylase, catalytic chain:phosphoribosylaminoimidazole carboxylase chain I] [GN:purE] [CL:phosphoribosylaminoimidazole carboxylase catalytic chain:phosphoribosylaminoimidazole carboxylase catalytic chain homology] [OR:*Bacillus subtilis*] [EC:4.1.1.21] [DB:pir1] [MP: 18 min] >gp:[GI:g143364] [LN:BACPURF] [AC:J02732:K00047] [OR:*Bacillus subtilis*] [SR:*B. subtilis* (strain DE1 (prototroph DER. or W168)) DNA, clone pPZ] [DB:genpept-bct1] [DE:*B. subtilis* pur operon encoding purine biosynthesis enzymes, 12 genes.] [NT:phosphoribosyl aminoimidazole carboxylase I] [LE:439] [RE:927]

-continued

[DI:direct] >gp:[GI:e1182622:g2632956] [LN:BSUB0004] [AC:Z99107:AL009126]
[PN:phosphoribosylaminoimidazole carboxylase I] [GN:purE] [FN:purine
biosynthesis] [OR:*Bacillus subtilis*] [DB:genpept-bct1] [EC:4.1.1.21]
[DE:*Bacillus subtilis* complete genome (section 4 of 21):from 600701
to 813890.] [SP:P12044] [LE:97421] [RE:97909] [DI:direct]

| ORF Name | NT ID | AA ID | NT LN | AA LN | Score | P-Value |
|---|---|---|---|---|---|---|
| AI7503000990_34407750_f2_368 | 1856 | 5628 | 162 | 53 | 119 | 1.8e−07 |

Description
pir:[LN:G69872] [AC:G69872] [PN:hypothetical protein ylaI] [GN:ylaI]
[OR:*Bacillus subtilis*] [DB:pir2] >gp:[GI:e1185069:g2633850] [LN:BSUB0008]
[AC:Z99111:AL009126] [GN:ylaI] [FN:unknown] [OR:*Bacillus subtilis*]
[DB:genpept-bct1] [DE:*Bacillus subtilis* complete genome (section 8 of 21):
from 1394791 to 1603020.] [LE:153004] [RE:153213] [DI:complement]
>gp:[GI:e324322:g2224768] [LN:BSZ97025] [AC:Z97025] [GN:ylaI] [OR:*Bacillus
subtilis*] [DB:genpept-bct1] [DE:*Bacillus subtilis* nprE,
yla[A,B,C,D,E,F,G,H,I,J,K,L,M,N,O] and pycA genes.] [LE:7263] [RE:7472]
[DI:complement]

| ORF Name | NT ID | AA ID | NT LN | AA LN | Score | P-Value |
|---|---|---|---|---|---|---|
| AI7503000990_34642213_c2_877 | 1857 | 5629 | 615 | 204 | 681 | 5.1e−67 |

Description
gp:[GI:g4009494] [LN:AF068904] [AC:AF068904] [PN:YlmF] [GN:ylmF]
[OR:*Staphylococcus aureus*] [DB:genpept-bct2] [DE:*Staphylococcus aureus* cell
division protein FtsZ (ftsZ) gene, partial cds; YlmD (ylmD), YlmE (ylmE),
YlmF (ylmF), YlmG (ylmG), and YlmH (ylmH) genes, complete cds; and cell
division protein DivIVA (divIVA) gene, partial cds.] [NT:similar to *Bacillus
subtilis* YlmF] [LE:1926] [RE:2480] [DI:direct]

| ORF Name | NT ID | AA ID | NT LN | AA LN | Score | P-Value |
|---|---|---|---|---|---|---|
| AI7503000990_34644125_c2_876 | 1858 | 5630 | 1416 | 471 | 1792 | 9.5e−185 |

Description
sp:[LN:FTSA_STAAU] [AC:O07325] [GN:FTSA] [OR:*STAPHYLOCOCCUS AUREUS*] [DE:CELL
DIVISION PROTEIN FTSA] [SP:O07325] [DB:swissprot] >gp:[GI:g2149897]
[LN:SAU94706] [AC:U94706] [PN:cell division protein] [GN:ftsA]
[OR:*Staphylococcus aureus*] [DB:genpept-bct2] [DE:*Staphylococcus aureus*
strain ATCC 8325-4 cell wall/cell division gene cluster, yllB, yllC, yllD,
pbpA, mraY, murD, div1B, ftsA and ftsZ genes, complete cds.] [LE:8604]
[RE:10019] [DI:direct]

| ORF Name | NT ID | AA ID | NT LN | AA LN | Score | P-Value |
|---|---|---|---|---|---|---|
| AI7503000990_34646937_c3_983 | 1859 | 5631 | 336 | 111 | 512 | 4.1e−49 |

Description
gp:[GI:e1333201:g3776111] [LN:SATRXA] [AC:AJ223480] [PN:thioredoxin]
[GN:trxA] [FN:thiol:disulfide interchange] [OR:*Staphylococcus aureus*]
[DB:genpept-bct1] [DE:*Staphylococcus aureus* trxA and uvrC genes and partial
mutS and dhsC genes.] [LE:2334] [RE:2648] [DI:direct]

| ORF Name | NT ID | AA ID | NT LN | AA LN | Score | P-Value |
|---|---|---|---|---|---|---|
| AI7503000990_34650452_c1_782 | 1860 | 5632 | 225 | 74 | 87 | 0.00078 |

Description
gp:[GI:g488925] [LN:A13473] [AC:A13473] [PN:41 kd antigen] [OR:*Plasmodium
falciparum*] [SR:malaria parasite *P. falciparum*] [DB:genpept-pat]
[DE:*P. falciparum* gene for 41 kd antigen, clone 41-14.] [LE:<1] [RE:>532]
[DI:direct]

| ORF Name | NT ID | AA ID | NT LN | AA LN | Score | P-Value |
|---|---|---|---|---|---|---|
| AI7503000990_35285902_c2_859 | 1861 | 5633 | 150 | 49 | 46 | 0.042 |

Description
sp:[LN:PGH2_MUSVI] [AC:O62725] [GN:PTGS2:COX2] [OR:*MUSTELA VISON*]
[SR:,AMERICAN MINK] [EC:1.14.99.1] [DE:SYNTHASE 2) (PGH SYNTHASE 2) (PGHS-2)
(PHS II)] [SP:O62725] [DB:swissprot] >gp:[GI:g2959708] [LN:AF047841]
[AC:AF047841] [PN:prostaglandin synthase 2] [OR:*Mustela vison*] [SR:American
mink] [DB:genpept-mam] [DE:*Mustela vison* prostaglandin synthase 2 mRNA,
complete cds.] [NT:cyclooxygenase 2] [LE:11] [RE:1825] [DI:direct]

-continued

| ORF Name | NT ID | AA ID | NT LN | AA LN | Score | P-Value |
|---|---|---|---|---|---|---|
| AI7503000990_353427_f2_302 | 1862 | 5634 | 165 | 54 | | |

Description
NO-HIT

| ORF Name | NT ID | AA ID | NT LN | AA LN | Score | P-Value |
|---|---|---|---|---|---|---|
| AI7503000990_35365635_c2_846 | 1863 | 5635 | 156 | 51 | | |

Description
NO-HIT

| ORF Name | NT ID | AA ID | NT LN | AA LN | Score | P-Value |
|---|---|---|---|---|---|---|
| AI7503000990_35947191_c2_835 | 1864 | 5636 | 1155 | 384 | 149 | 6.3e−07 |

Description
gp:[GI:g1633572] [LN:KSU52064] [AC:U52064] [OR:Kaposi's sarcoma-associated herpesvirus] [SR:Kaposi's sarcoma-associated herpesvirus - Human herpesvirus 8] [DB:genpept-vrl] [DE:Kaposi's sarcoma-associated herpes-like virus ORF73 homolog gene, complete cds.] [NT:Herpesvirus saimiri ORF73 homolog] [LE:1] [RE:3489] [DI:direct] >gp:[GI:g1718329] [LN:KSU75698] [AC:U75698] [OR:Kaposi's sarcoma-associated herpesvirus] [SR:Kaposi's sarcoma-associated herpesvirus - Human herpesvirus 8] [DB:genpept-vrl] [DE:Kaposi's sarcoma-associated herpesvirus long unique region, 80 putative ORF's and kaposin gene, complete cds.] [NT:ORF 73; extensive acidic domains, potential leucine] [LE:123809] [RE:127297] [DI:complement]

| ORF Name | NT ID | AA ID | NT LN | AA LN | Score | P-Value |
|---|---|---|---|---|---|---|
| AI7503000990_35978392_c1_788 | 1865 | 5637 | 2007 | 668 | 949 | 2.0e−95 |

Description
pir:[LN:H69878] [AC:H69878] [PN:protein kinase homolog yloP] [GN:yloP] [CL:protein kinase homology] [OR:*Bacillus subtilis*] [DB:pir2] >gp:[GI:e1185168:g2633949] [LN:BSUB0009] [AC:Z99112:AL009126] [GN:yloP] [FN:unknown] [OR:*Bacillus subtilis*] [DB:genpept-bct1] [DE:*Bacillus subtilis* complete genome (section 9 of 21):from 1598421 to 1807200.] [NT:similar to protein kinase] [LE:52121] [RE:54067] [DI:direct] >gp:[GI:e323506:g2337806] [LN:BSY13937] [AC:Y13937] [PN:putative Pkn2 protein] [GN:yloP] [FN:unknown] [OR:*Bacillus subtilis*] [DB:genpept-bct1] [DE:*Bacillus subtilis* genomic DNA from the spoVM region.] [LE:13893] [RE:15839] [DI:direct]

| ORF Name | NT ID | AA ID | NT LN | AA LN | Score | P-Value |
|---|---|---|---|---|---|---|
| AI7503000990_35980062_f2_357 | 1866 | 5638 | 162 | 53 | | |

Description
NO-HIT

| ORF Name | NT ID | AA ID | NT LN | AA LN | Score | P-Value |
|---|---|---|---|---|---|---|
| AI7503000990_36129451_c1_702 | 1867 | 5639 | 288 | 95 | 408 | 4.3e−38 |

Description
sp:[LN:PTHP_STACA] [AC:P23534] [GN:PTSH] [OR:*STAPHYLOCOCCUS CARNOSUS*] [DE:PHOSPHOCARRIER PROTEIN HPR (HISTIDINE-CONTAINING PROTEIN)] [SP:P23534] [DB:swissprot] >pir:[LN:A42374] [AC:S15367:A42374] [PN:phosphotransferase system phosphohistidine-containing protein:phosphotransferase system HPr] [CL:phosphotransferase system phosphohistidine-containing protein:phosphotransferase system phosphohistidine-containing protein homology] [OR:*Staphylococcus carnosus*] [DB:pir1] >gp:[GI:g46908] [LN:SCPTSH] [AC:X60766] [PN:Histidine-containing protein (HPr)] [GN:ptsH] [OR:*Staphylococcus carnosus*] [DB:genpept-bct1] [DE:*S. carnosus* ptsH gene for histidine-containing protein (HPr).] [SP:P23534] [LE:270] [RE:536] [DI:direct]

| ORF Name | NT ID | AA ID | NT LN | AA LN | Score | P-Value |
|---|---|---|---|---|---|---|
| AI7503000990_36141893_c3_1039 | 1868 | 5640 | 1248 | 415 | 1166 | 2.1e−118 |

Description
gp:[GI:e1185186:g2633967] [LN:BSUB0009] [AC:Z99112:AL009126] [PN:signal recognition particle (docking protein)] [GN:ftsY] [FN:involved in secretion of extracellular proteins] [OR:*Bacillus subtilis*] [DB:genpept-bct1] [DE:*Bacillus subtilis* complete genome (section 9 of 21):from 1598421 to 1807200.] [NT:alternate gene name:srb] [SP:P51835] [LE:71119] [RE:72108]

-continued

[DI:direct]

| ORF Name | NT ID | AA ID | NT LN | AA LN | Score | P-Value |
|---|---|---|---|---|---|---|
| AI7503000990_36142817_c1_717 | 1869 | 5641 | 1149 | 382 | 925 | 7.1e−93 |

Description
pir:[LN:A70180] [AC:A70180] [PN:spermidine/putrescine ABC transporter,
ATP-binding protein (potA) homolog] [CL:ATP-binding cassette homology]
[OR:*Borrelia burgdorferi*] [SR:, Lyme disease spirochete] [DB:pir2]
>gp:[GI:g2688562] [LN:AE001165] [AC:AE001165:AE000783]
[PN:spermidine/putrescine ABC transporter,] [GN:BB0642] [OR:*Borrelia
burgdorferi*] [SR:Lyme disease spirochete] [DB:genpept-bct2] [DE:*Borrelia
burgdorferi* (section 51 of 70) of the complete genome.] [NT:similar to
GB:M64519 SP:P23858 PID:147326 GB:U00096] [LE:11911] [RE:12954]
[DI:complement]

| ORF Name | NT ID | AA ID | NT LN | AA LN | Score | P-Value |
|---|---|---|---|---|---|---|
| AI7503000990_36147150_c1_757 | 1870 | 5642 | 609 | 492 | 5.4e−47 | |

Description
pir:[LN:C69986] [AC:C69986] [PN:conserved hypothetical protein ysnA]
[GN:ysnA] [CL:*Methanococcus jannaschii* conserved hypothetical protein
MJ0226] [OR:*Bacillus subtilis*] [DB:pir2] >gp:[GI:e1184085:g2635301]
[LN:BSUB0015] [AC:Z99118:AL009126] [GN:ysnA] [FN:unknown] [OR:*Bacillus
subtilis*] [DB:genpept-bct1] [DE:*Bacillus subtilis* complete genome (section
15 of 21):from 2795131 to 3013540.] [NT:similar to hypothetical proteins]
[LE:104515] [RE:105111] [DI:complement] >gp:[GI:e1165357:g1770060]
[LN:BSZ75208] [AC:Z75208] [PN:hypothetical protein] [GN:ysnA] [OR:*Bacillus
subtilis*] [DB:genpept-bct1] [DE:*B. subtilis* genomic sequence 89009bp.]
[NT:homology to ORFo197 of *Escherichia coli*; unknown] [LE:64796] [RE:65392]
[DI:direct]

| ORF Name | NT ID | AA ID | NT LN | AA LN | Score | P-Value |
|---|---|---|---|---|---|---|
| AI7503000990_36219187_c3_920 | 1871 | 5643 | 2208 | 735 | 2062 | 2.3e−213 |

Description
sp:[LN:PURL_BACSU] [AC:P12042] [GN:PURL] [OR:*BACILLUS SUBTILIS*] [EC:6.3.5.3]
[DE:SYNTHASE II)] [SP:P12042] [DB:swissprot] >pir:[LN:SYBS2G]
[AC:G29326:C69685] [PN:phosphoribosylformylglycinamidine synthase,
component II:formylglycinamide ribotide amidotransferase] [GN:purL]
[CL:phosphoribosylformylglycinamidine synthase component II] [OR:*Bacillus
subtilis*] [EC:6.3.5.3] [DB:pir1] [MP:18 min] >gp:[GI:g143369] [LN:BACPURF]
[AC:J02732:K00047] [OR:*Bacillus subtilis*] [SR:*B. subtilis* (strain DE1
(prototroph DER. or W168)) DNA, clone pPZ] [DB:genpept-bct1] [DE:*B. subtilis*
pur operon encoding purine biosynthesis enzymes, 12 genes.]
[NT:phosphoribosylformyl glycinamidine synthetase II] [LE:5060] [RE:7288]
[DI:direct] >gp:[GI:e1182628:g2632962] [LN:BSUB0004] [AC:Z99107:AL009126]
[PN:phosphoribosylformylglycinamidine synthetase I] [GN:purQ] [FN:purine
biosynthesis] [OR:*Bacillus subtilis*] [DB:genpept-bct1] [EC:6.3.5.3]
[DE:*Bacillus subtilis* complete genome (section 4 of 21):from 600701
to 813890.] [SP:P12042] [LE:102042] II[RE:104270] [DI:direct]

| ORF Name | NT ID | AA ID | NT LN | AA LN | Score | P-Value |
|---|---|---|---|---|---|---|
| AI7503000990_36445263_f2_320 | 1872 | 5644 | 147 | 48 | | |

Description
NO-HIT

| ORF Name | NT ID | AA ID | NT LN | AA LN | Score | P-Value |
|---|---|---|---|---|---|---|
| AI7503000990_36520302_c2_870 | 1873 | 5645 | 189 | 62 | 250 | 2.4e−21 |

Description
sp:[LN:YLLB_STAAU] [AC:O07319] [GN:YLLB] [OR:*STAPHYLOCOCCUS AUREUS*]
[DE:HYPOTHETICAL 17.4 KD PROTEIN] [SP:O07319] [DB:swissprot]
>gp:[GI:g2149890] [LN:SAU94706] [AC:U94706] [PN:unknown] [GN:yllB]
[OR:*Staphylococcus aureus*] [DB:genpept-bct2] [DE:*Staphylococcus aureus*
strain ATCC 8325-4 cell wall/cell division gene cluster, yllB, yllC, yllD,
pbpA, mraY, murD, div1B, ftsA and ftsZ genes, complete cds.] [LE:537]
[RE:971] [DI:direct]

| ORF Name | NT ID | AA ID | NT LN | AA LN | Score | P-Value |
|---|---|---|---|---|---|---|
| AI7503000990_36601687_c1_692 | 1874 | 5646 | 1260 | 419 | 1016 | 1.6e−102 |

-continued

Description
sp:[LN:PUR2_BACSU] [AC:P12039] [GN:PURD] [OR:*BACILLUS SUBTILIS*]
[EC:6.3.4.13] [DE:RIBONUCLEOTIDE SYNTHETASE) (PHOSPHORIBOSYLGLYCINAMIDE
SYNTHETASE)] [SP:P12039] [DB:swissprot] >pir:[LN:AJBSAG] [AC:B29183:C69684]
[PN:phosphoribosylamine--glycine ligase,:phosphoribosylglycinamide
synthetase] [GN:purD] [CL:phosphoribosylamine--glycine ligase:
phosphoribosylamine--glycine ligase homology] [OR:*Bacillus subtilis*]
[EC:6.3.4.13] [DB:pir1] [MP:18 min] >gp:[GI:g2465561] [LN:AF011544]
[AC:AF011544] [PN:phosphoribosylglycinamide synthetase] [GN:purD]
[OR:*Bacillus subtilis*] [DB:genpept-bct1] [DE:*Bacillus subtilis*
phosphoribosylaminoimidazole-carboxamideformyltransferase (purH-J) gene,
partial cds, phosphoribosylglycinamide synthetase (purD), YecA (yecA),
putative adenine deaminase (yecB), YecC (yecC), and YecD (yecD)
genes, complete cds, and putative glutamate synthase (yecE) gene,
partial cds.] [NT:identified by complementation of *E. coli* TX267,] [LE:263]
[RE:1531] [DI:direct] >gp:[GI:g143374] [LN:BACPURF] [AC:J02732:K00047]
[OR:*Bacillus subtilis*] [SR:*B. subtilis* (strain DE1 (prototroph DER. or W168))
DNA, clone pPZ] [DB:genpept-bct1] [DE:*B. subtilis* pur operon encoding purine
biosynthesis enzymes, 12 genes.] [NT:phosphoribosyl glycinamide synthetase
(PUR-D; gtg] [LE:11971] [RE:13239] [DI:direct] >gp:[GI:e1182633:g2632967]
[LN:BSUB0004] [AC:Z99107:AL009126] [PN:phosphoribosylglycinamide synthetase]
[GN:purD] [FN:purine biosynthesis] [OR:*Bacillus subtilis*] [DB:genpept-bct1]
[EC:6.3.4.13] [DE:*Bacillus subtilis* complete genome (section 4 of 21):from
600701 to 813890.] [SP:P12039] [LE:108953] [RE:110221] [DI:direct]

| ORF Name | NT ID | AA ID | NT LN | AA LN | Score | P-Value |
|---|---|---|---|---|---|---|
| AI7503000990_3912890_f3_463 | 1875 | 5647 | 222 | 73 | 246 | 6.4e−21 |

Description
sp:[LN:RL28_BACST] [AC:P23374] [GN:RPMB] [OR:*BACILLUS STEAROTHERMOPHILUS*]
[DE:50S RIBOSOMAL PROTEIN L28] [SP:P23374] [DB:swissprot] >pir:[LN:A48396]
[AC:A48396] [PN:ribosomal protein L28] [CL:*Escherichia coli* ribosomal
protein L28] [OR:*Bacillus stearothermophilus*] [DB:pir2]

| ORF Name | NT ID | AA ID | NT LN | AA LN | Score | P-Value |
|---|---|---|---|---|---|---|
| AI7503000990_3945257_f3_664 | 1876 | 5648 | 1176 | 391 | 738 | 4.6e−73 |

Description
pir:[LN:E69687] [AC:E69687:A38129:S39692] [PN:cytochrome aa3 quinol oxidase
(subunit II) qoxA:quinol oxidase aa3-600 chain qoxA] [GN:qoxA] [CL:bo-type
ubiquinol oxidase chain II precursor:cytochrome-c oxidase chain II
homology] [OR:*Bacillus subtilis*] [DB:pir2] >gp:[GI:e1186316:g2636352]
[LN:BSUB0020] [AC:Z99123:AL009126] [PN:cytochrome aa3 quinol oxidase
(subunit II)] [GN:qoxA] [OR:*Bacillus subtilis*] [DB:genpept-bct1]
[DE:*Bacillus subtilis* complete genome (section 20 of 21):from 3798401 to
4010550.] [NT:alternate gene name:ipa-37d] [LE:117692] [RE:118657]
[DI:complement]

| ORF Name | NT ID | AA ID | NT LN | AA LN | Score | P-Value |
|---|---|---|---|---|---|---|
| AI7503000990_3960881_f3_483 | 1877 | 5649 | 129 | 42 | | |

Description
NO-HIT

| ORF Name | NT ID | AA ID | NT LN | AA LN | Score | P-Value |
|---|---|---|---|---|---|---|
| AI7503000990_39808_f3_498 | 1878 | 5650 | 135 | 44 | | |

Description
NO-HIT

| ORF Name | NT ID | AA ID | NT LN | AA LN | Score | P-Value |
|---|---|---|---|---|---|---|
| AI7503000990_3992193_f3_496 | 1879 | 5651 | 177 | 58 | | |

Description
NO-HIT

| ORF Name | NT ID | AA ID | NT LN | AA LN | Score | P-Value |
|---|---|---|---|---|---|---|
| AI7503000990_4067342_c3_977 | 1880 | 5652 | 1086 | 361 | 1267 | 4.1e−129 |

Description
sp:[LN:SYFA_BACSU] [AC:P17921:P94539] [GN:PHES] [OR:*BACILLUS SUBTILIS*]
[EC:6.1.1.20] [DE:-TRNA LIGASE ALPHA CHAIN) (PHERS)] [SP:P17921:P94539]
[DB:swissprot] >pir:[LN:YFBSA] [AC:H69675:I40459:S11730]

-continued

[PN:phenylalanine--tRNA ligase, alpha chain:phenylalanyl-tRNA synthetase
alpha chain] [GN:pheS] [CL:phenylalanine--tRNA ligase alpha chain]
[OR:*Bacillus subtilis*] [EC:6.1.1.20] [DB:pir1] >gp:[GI:e1184113:g2635329]
[LN:BSUB0015] [AC:Z99118:AL009126] [PN:phenylalanyl-tRNA synthetase (alpha
subunit)] [GN:pheS] [OR:*Bacillus subtilis*] [DB:genpept-bct1] [EC:6.1.1.20]
[DE:*Bacillus subtilis* complete genome (section 15 of 21):from 2795131 to
3013540.] [SP:P17921] [LE:133410] [RE:134444] [DI:complement]
>gp:[GI:e1165324:g1770030] [LN:BSZ75208] [AC:Z75208] [PN:phenylalany-tRNA
synthetase beta subunit] [GN:pheS] [OR:*Bacillus subtilis*] [DB:genpept-bct1]
[EC:6.1.1.20] [DE:*B. subtilis* genomic sequence 89009bp.]
[NT:phenylalanyl-tRNA synthetase beta subunit] [SP:P17921] [LE:35463]
[RE:36497] [DI:direct]

| ORF Name | NT ID | AA ID | NT LN | AA LN | Score | P-Value |
|---|---|---|---|---|---|---|
| AI7503000990_4103438_c3_970 | 1881 | 5653 | 255 | 84 | 110 | 1.6e−06 |

Description
pir:[LN:D69874] [AC:D69874] [PN:conserved hypothetical protein ylbG]
[GN:ylbG] [OR:*Bacillus subtilis*] [DB:pir2] >gp:[GI:e334775:g2340003]
[LN:BS16823KB] [AC:Z98682] [PN:YlbG protein] [GN:ylbG] [OR:*Bacillus
subtilis*] [DB:genpept-bct1] [DE:*Bacillus subtilis* genomic DNA 23.9 kB
fragment.] [LE:14055] [RE:14327] [DI:direct] >gp:[GI:e1185090:g2633871]
[LN:BSUB0008] [AC:Z99111:AL009126] [GN:ylbG] [FN:unknown] [OR:*Bacillus
subtilis*] [DB:genpept-bct1] [DE:*Bacillus subtilis* complete genome (section 8
of 21):from 1394791 to 1603020.] [NT:similar to hypothetical proteins]
[LE:173538] [RE:173810] [DI:direct]

| ORF Name | NT ID | AA ID | NT LN | AA LN | Score | P-Value |
|---|---|---|---|---|---|---|
| AI7503000990_4298177_c1_776 | 1882 | 5654 | 126 | 41 | | |

Description
NO-HIT

| ORF Name | NT ID | AA ID | NT LN | AA LN | Score | P-Value |
|---|---|---|---|---|---|---|
| AI7503000990_4300332_c1_700 | 1883 | 5655 | 1329 | 442 | 98 | 0.00059 |

Description
gp:[GI:g5306148] [LN:AF160864] [AC:AF160864] [PN:orf365] [GN:orf365]
[OR:Mitochondrion *Tetrahymena pyriformis*] [SR:*Tetrahymena pyriformis*]
[DB:genpept] [DE:*Tetrahymena pyriformis* mitochondrial DNA, complete genome.]
[NT:Open reading frame ymf65 (CPGN); ATA initiation] [LE:15906] [RE:17003]
[DI:complement]

| ORF Name | NT ID | AA ID | NT LN | AA LN | Score | P-Value |
|---|---|---|---|---|---|---|
| AI7503000990_4306562_c1_760 | 1884 | 5656 | 306 | 101 | 469 | 1.5e−44 |

Description
sp:[LN:YLLB_STAAU] [AC:O07319] [GN:YLLB] [OR:*STAPHYLOCOCCUS AUREUS*]
[DE:HYPOTHETICAL 17.4 KD PROTEIN] [SP:O07319] [DB:swissprot]
>gp:GI:g2149890] [LN:SAU94706] [AC:U94706] [PN:unknown] [GN:yllB]
[OR:*Staphylococcus aureus*] [DB:genpept-bct2] [DE:*Staphylococcus aureus*
strain ATCC 8325-4 cell wall/cell division gene cluster, yllB, yllC, yllD,
pbpA, mraY, murD, div1B, ftsA and ftsZ genes, complete cds.] [LE:537]
[RE:971] [DI:direct]

| ORF Name | NT ID | AA ID | NT LN | AA LN | Score | P-Value |
|---|---|---|---|---|---|---|
| AI7503000990_4339053_c3_934 | 1885 | 5657 | 144 | 47 | | |

Description
NO-HIT

| ORF Name | NT ID | AA ID | NT LN | AA LN | Score | P-Value |
|---|---|---|---|---|---|---|
| AI7503000990_4457788_f2_344 | 1886 | 5658 | 1716 | 571 | 285 | 5.3e−21 |

Description
pir:[LN:D71623] [AC:D71623] [PN:erythrocyte membrane protein PfEMP3
PFB0095c] [GN:PFB0095c] [OR:*Plasmodium falciparum*] [DB:pir2]
>gp:[GI:g3845093] [LN:AE001371] [AC:AE001371:AE001362] [PN:erythrocyte
membrane protein PfEMP3] [GN:PFB0095c] [OR:*Plasmodium falciparum*]
[SR:malaria parasite *P. falciparum*] [DB:genpept-inv2] [DE:*Plasmodium
falciparum* chromosome 2, section 8 of 73 of the complete sequence.]

-continued

[NT:identified by sequence similarity] [LE:1407:8817] [RE:8621:8927]
[DI:complementJoin]

| ORF Name | NT ID | AA ID | NT LN | AA LN | Score | P-Value |
|---|---|---|---|---|---|---|
| AI7503000990_4509661_c1_783 | 1887 | 5659 | 411 | 136 | 168 | 1.2e−12 |

Description
gp:[GI:e1453986:g4835313] [LN:SC5H1] [AC:AL049863] [PN:hypothetical protein]
[GN:SC5H1.10c] [OR:*Streptomyces coelicolor*] [DB:genpept-bct1]
[DE:*Streptomyces coelicolor* cosmid 5H1.] [NT:SC5H1.10c, hypothetical
protein, len:160 aa;] [LE:8093] [RE:8575] [DI:complement]

| ORF Name | NT ID | AA ID | NT LN | AA LN | Score | P-Value |
|---|---|---|---|---|---|---|
| AI7503000990_4532967_c3_982 | 1888 | 5660 | 2358 | 785 | 3159 | 0.0 |

Description
gp:[GI:e1333200:g3776110] [LN:SATRXA] [AC:AJ223480] [PN:MutS-like protein]
[GN:mutS] [FN:DNA mismatch repair protein] [OR:*Staphylococcus aureus*]
[DB:genpept-bct1] [DE:*Staphylococcus aureus* trxA and uvrC genes and partial
mutS and dhsC genes.] [LE:<1] [RE:2161] [DI:direct]

| ORF Name | NT ID | AA ID | NT LN | AA LN | Score | P-Value |
|---|---|---|---|---|---|---|
| AI7503000990_4696068_c1_741 | 1889 | 5661 | 186 | 61 | 237 | 5.7e−20 |

Description
sp:[LN:RL32_BACST] [AC:P07840] [GN:RPMF] [OR:*BACILLUS STEAROTHERMOPHILUS*]
[DE:50S RIBOSOMAL PROTEIN L32 (RIBOSOMAL PROTEIN I) (BL37)] [SP:P07840]
[DB:swissprot] >pir:[LN:R5BS37] [AC:S07236] [PN:ribosomal protein
L32:ribosomal protein BL37:ribosomal protein I] [CL:*Escherichia coli*
ribosomal protein L32] [OR:*Bacillus stearothermophilus*] [DB:pir1]

| ORF Name | NT ID | AA ID | NT LN | AA LN | Score | P-Value |
|---|---|---|---|---|---|---|
| AI7503000990_4725000_c1_797 | 1890 | 5662 | 3636 | 1211 | 2426 | 6.2e−252 |

Description
pir:[LN:G69708] [AC:G69708:JC4819:PC4029] [PN:chromosome segregation SMC
protein:minichromosome stabilizing protein SMC] [GN:smc] [CL:conserved
hypothetical P115 protein] [OR:*Bacillus subtilis*] [DB:pir2]
>gp:[GI:e1185185:g2633966] [LN:BSUB0009] [AC:Z99112:AL009126] [PN:chromosome
segregation SMC protein homolg] [GN:smc] [OR:*Bacillus subtilis*]
[DB:genpept-bct1] [DE:*Bacillus subtilis* complete genome (section 9 of 21):
from 1598421 to 1807200.] [NT:alternate gene name:ylqA] [LE:67539]
[RE:71099] [DI:direct]

| ORF Name | NT ID | AA ID | NT LN | AA LN | Score | P-Value |
|---|---|---|---|---|---|---|
| AI7503000990_4725415_c2_873 | 1891 | 5663 | 2337 | 778 | 3205 | 0.0 |

Description
gp:[GI:d1023422:g2463561] [LN:AB007500] [AC:AB007500:D28879]
[PN:penicillin-binding protein 1] [GN:pbpA] [OR:*Staphylococcus aureus*]
[SR:*Staphylococcus aureus* (strain:NCTC8325) DNA] [DB:genpept-bct1]
[DE:*Staphylococcus aureus* genes for penicillin-binding protein 1, MraY, MurD,
partial and complete cds.] [LE:594] [RE:2828] [DI:direct] >gp:[GI:g2149893]
[LN:SAU94706] [AC:U94706] [PN:penicillin-binding protein 1] [GN:pbpA]
[OR:*Staphylococcus aureus*] [DB genpept-bct2] [DE:*Staphylococcus aureus*
strain ATCC 8325-4 cell wall/cell division gene cluster, yllB, yllC, yllD,
pbpA, mraY, murD, div1B, ftsA and ftsZ genes, complete cds.] [LE:2318]
[RE:4552] [DI:direct]

| ORF Name | NT ID | AA ID | NT LN | AA LN | Score | P-Value |
|---|---|---|---|---|---|---|
| AI7503000990_4741010_c3_956 | 1892 | 5664 | 846 | 281 | 650 | 9.8e−64 |

Description
sp:[LN:SUHB_BACSU] [AC:Q45499] [GN:SUHB] [OR:*BACILLUS SUBTILIS*]
[DE:EXTRAGENIC SUPPRESSOR PROTEIN SUHB HOMOLOG] [SP:Q45499] [DB:swissprot]
>pir:[LN:E69864] [AC:E69864] [PN:myo-inositol-1(or 4)-monophosphatase
homolog yktC] [GN:yktC] [CL:suppressor protein suhB] [OR:*Bacillus subtilis*]
[DB:pir2] >gp:[GI:e1185057:g2633838] [LN:BSUB0008] [AC:Z99111:AL009126]
[GN:yktC] [FN:unknown] [OR:*Bacillus subtilis*] [DB:genpept-bct1] [DE:*Bacillus
subtilis* complete genome (section 8 of 21):from 1394791 to 1603020.]
[NT:similar to myo-inositol-1(or 4)-monophosphatase] [SP:Q45499] [LE:142056]
[RE:142853] [DI:direct] >gp:[GI:g3282150] [LN:AF012285]
[AC:AF012285:AF012284:U51911] [PN:unknown] [GN:yktC] [FN:unknown]

-continued

[OR:*Bacillus subtilis*] [DB:genpept-bct2] [DE:*Bacillus subtilis* mobA-nprE gene region.] [NT:similar to *E. coli* extragenic suppressor protein] [LE:42544] [RE:43341] [DI:direct]

| ORF Name | NT ID | AA ID | NT LN | AA LN | Score | P-Value |
|---|---|---|---|---|---|---|
| AI7503000990_4741703_c2_894 | 1893 | 5665 | 2418 | 805 | 2153 | 5.3e−223 |

Description
sp:[LN:PRIA_BACSU] [AC:P94461:O34941] [GN:PRIA] [OR:*BACILLUS SUBTILIS*] [DE:PRIMOSOMAL PROTEIN N' (REPLICATION FACTOR Y)] [SP:P94461:O34941] [DB:swissprot] >pir:[LN:A69682] [AC:A69682] [PN:primosomal replication factor Y priA] [GN:priA] [CL:unassigned DEAD/H box helicases:DEAD/H box helicase homology] [OR:*Bacillus subtilis*] [DB:pir2] >gp:[GI:e1185162:g2633943] [LN:BSUB0009] [AC:Z99112:AL009126] [PN:primosomal replication factor Y (primosomal) [GN:priA] [OR:*Bacillus subtilis*] [DB:genpept-bct1] [DE:*Bacillus subtilis* complete genome (section 9 of 21): from 1598421 to 1807200.] [NT:alternate gene nam: yloJ] [SP:P94461] [LE:45047] [RE:47464] [DI:direct] >gp:[GI:e323502:g2337800] [LN:BSY13937] [AC:Y13937] [PN:putative PriA protein] [GN:yloJ] [FN:unknown] [OR:*Bacillus subtilis*] [DB:genpept-bct1] [DE:*Bacillus subtilis* genomic DNA from the spoVM region.] [SP:P94461] [LE:6819] [RE:9236] [DI:direct]

| ORF Name | NT ID | AA ID | NT LN | AA LN | Score | P-Value |
|---|---|---|---|---|---|---|
| AI7503000990_4769512_f2_349 | 1894 | 5666 | 135 | 44 | | |

Description
NO-HIT

| ORF Name | NT ID | AA ID | NT LN | AA LN | Score | P-Value |
|---|---|---|---|---|---|---|
| AI7503000990_4781517_c2_888 | 1895 | 5667 | 129 | 42 | | |

Description
NO-HIT

| ORF Name | NT ID | AA ID | NT LN | AA LN | Score | P-Value |
|---|---|---|---|---|---|---|
| AI7503000990_4859425_f2_276 | 1896 | 5668 | 141 | 46 | | |

Description
NO-HIT

| ORF Name | NT ID | AA ID | NT LN | AA LN | Score | P-Value |
|---|---|---|---|---|---|---|
| AI7503000990_4875055_f1_23 | 1897 | 5669 | 225 | 74 | 74 | 0.015 |

Description
sp:[LN:Y27B_METJA] [AC:P81234] [GN:MJ0275.1] [OR:*METHANOCOCCUS JANNASCHII*] [DE:HYPOTHETICAL PROTEIN MJ0275.1] [SP:P81234] [DB:swissprot] >gp:[GI:g2826269] [LN:U67482] [AC:U67482:L77117] [PN:*M. jannaschii* predicted coding region MJ0275.1] [GN:MJ0275.1] [OR:*Methanococcus jannaschii*] [DB:genpept-bct2] [DE:*Methanococcus jannaschii* section 24 of 150 of the complete genome.] [NT:Brute Force ORF; identified by GeneMark; putative] [LE:9344] [RE:9790] [DI:complement]

| ORF Name | NT ID | AA ID | NT LN | AA LN | Score | P-Value |
|---|---|---|---|---|---|---|
| AI7503000990_4875327_f3_587 | 1898 | 5670 | 135 | 44 | | |

Description
NO-HIT

| ORF Name | NT ID | AA ID | NT LN | AA LN | Score | P-Value |
|---|---|---|---|---|---|---|
| AI7503000990_4875452_c3_1034 | 1899 | 5671 | 645 | 214 | 521 | 4.6e−50 |

Description
gp:[GI:g4982295] [LN:AE001811] [AC:AE001811:AE000512] [PN:ribulose-phosphate 3-epimerase] [GN:TM1718] [OR:*Thermotoga maritima*] [DB:genpept-bct2] [DE:*Thermotoga maritima* section 123 of 136 of the complete genome.] [NT:similar to GB:L77117 SP:Q58093 PID:1591395 percent] [LE:2607] [RE:3269] [DI:direct]

| ORF Name | NT ID | AA ID | NT LN | AA LN | Score | P-Value |
|---|---|---|---|---|---|---|
| AI7503000990_4876542_f1_176 | 1900 | 5672 | 633 | 210 | 551 | 3.0e−53 |

-continued

Description
pir:[LN:D69862] [AC:D69862] [PN:formylmethionine deformylase homolog ykrB]
[GN:ykrB] [CL:polypeptide deformylase] [OR:*Bacillus subtilis*] [DB:pir2]
>gp:[GI:e1185046:g2633827] [LN:BSUB0008] [AC:Z99111:AL009126] [GN:ykrB]
[FN:unknown] [OR:*Bacillus subtilis*] [DB:genpept-bct1] [DE:*Bacillus subtilis*
complete genome (section 8 of 21):from 1394791 to 1603020.] [NT:similar to
formylmethionine deformylase] [LE:130810] [RE:131364] [DI:complement]
>gp:[GI:g3282140] [LN:AF012285] [AC:AF012285:AF012284:U51911] [PN:unknown]
[GN:ykrB] [FN:unknown] [OR:*Bacillus subtilis*] [DB:genpept-bct2] [DE:*Bacillus
subtilis* mobA-nprE gene region.] [NT:similar to polypeptide deformylase from
Mycoplasma] [LE:31298] [RE:31852] [DI:complement]

| ORF Name | NT ID | AA ID | NT LN | AA LN | Score | P-Value |
|---|---|---|---|---|---|---|
| AI7503000990_4877203_c1_793 | 1901 | 5673 | 936 | 311 | 661 | 6.7e−65 |

Description
pir:[LN:H69620] [AC:H69620] [PN:malonyl CoA-acyl carrier protein
transacylase fabD] [GN:fabD] [CL:[acyl-carrier-protein]
S-malonyltransferase:[acyl-carrier-protein] S-malonyltransferase homology]
[OR:*Bacillus subtilis*] [DB:pir2] >gp:[GI:e1185181:g2633962] [LN:BSUB0009]
[AC:Z99112:AL009126] [PN:malonyl CoA-acyl carrier protein transacylase]
[GN:fabD] [FN:fatty acid biosynthesis] [OR:*Bacillus subtilis*]
[DB:genpept-bct1] [EC:2.3.1.39] [DE:*Bacillus subtilis* complete genome
(section 9 of 21):from 1598421 to 1807200.] [NT:alternate gene name:ylpE]
[LE:64546] [RE:65499] [DI:direct] >gp:[GI:e323514:g2337819] [LN:BSY13937]
[AC:Y13937] [PN:putative FabD protein] [GN:ylpE] [FN:unknown] [OR:*Bacillus
subtilis*] [DB:genpept-bct1] [DE:*Bacillus subtilis* genomic DNA from the spoVM
region.] [LE:26318] [RE:27271] [DI:direct]

| ORF Name | NT ID | AA ID | NT LN | AA LN | Score | P-Value |
|---|---|---|---|---|---|---|
| AI7503000990_4899187_f3_569 | 1902 | 5674 | 1149 | 382 | 402 | 1.9e−37 |

Description
pir:[LN:B69875] [AC:B69875] [PN:conserved hypothetical protein ylbM]
[GN:ylbM] [OR:*Bacillus subtilis*] [DB:pir2] >gp:[GI:e334781:g2340009]
[LN:BS16823KB] [AC:Z98682] [PN:YlbM protein] [GN:ylbM] [OR:*Bacillus
subtilis*] [DB:genpept-bct1] [DE:*Bacillus subtilis* genomic DNA 23.9 kB
fragment.] [LE:18936] [RE:20183] [DI:complement] >gp:[GI:e1185096:g2633877]
[LN:BSUB0008] [AC:Z99111:AL009126] [GN:ylbM] [FN:unknown] [OR:*Bacillus
subtilis*] [DB:genpept-bct1] [DE:*Bacillus subtilis* complete genome (section 8
of 21):from 1394791 to 1603020.] [NT:similar to hypothetical proteins]
[LE:178419] [RE:179666] [DI:complement]

| ORF Name | NT ID | AA ID | NT LN | AA LN | Score | P-Value |
|---|---|---|---|---|---|---|
| AI7503000990_4970462_c2_904 | 1903 | 5675 | 750 | 249 | 837 | 1.5e−83 |

Description
sp:[LN:FABG_BACSU] [AC:P51831:O31733] [GN:FABG] [OR:*BACILLUS SUBTILIS*]
[EC:1.1.1.100] [DE:ACYL CARRIER PROTEIN REDUCTASE)] [SP:P51831:O31733]
[DB:swissprot] >pir:[LN:A69621] [AC:A69621:PC4176]
[PN:3-oxoacyl-[acyl-carrier-protein] reductase,:3-ketoacyl-acyl carrier
protein reductase fabG:srb protein] [GN:fabG:srb] [CL:ribitol
dehydrogenase:short-chain alcohol dehydrogenase homology] [OR:*Bacillus
subtilis*] [EC:1.1.1.100] [DB:pir2] >gp:[GI:e1185182:g2633963] [LN:BSUB0009]
[AC:Z99112:AL009126] [PN:3-ketoacyl-acyl carrier protein reductase]
[GN:fabG] [FN:fatty acid biosynthesis] [OR:*Bacillus subtilis*]
[DB:genpept-bct1] [EC:1.1.1.100] [DE:*Bacillus subtilis* complete genome
(section 9 of 21):from 1598421 to 1807200.] [NT:alternate gene name:ylpF]
[SP:P51831] [LE:65492] [RE:66232] [DI:direct]

| ORF Name | NT ID | AA ID | NT LN | AA LN | Score | P-Value |
|---|---|---|---|---|---|---|
| AI7503000990_5080260_f1_43 | 1904 | 5676 | 141 | 46 | | |

Description
NO-HIT

| ORF Name | NT ID | AA ID | NT LN | AA LN | Score | P-Value |
|---|---|---|---|---|---|---|
| AI7503000990_5096012_f3_481 | 1905 | 5677 | 231 | 76 | | |

Description
NO-HIT

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000990_5117162_c2_826 | 1906 | 5678 | 1023 | 340 | 925 | 7.1e−93 |

Description
gp:[GI:d1039221:g4514629] [LN:AB016894] [AC:AB016894] [PN:bd-type quinol oxidase subunit II] [GN:cbdB] [OR:*Bacillus stearothermophilus*] [SR:*Bacillus stearothermophilus* (strain:K1041) DNA] [DB:genpept-bct1] [DE:*Bacillus stearothermophilus* genes for bd-type quinol oxidase subunit I and subunit II, complete cds.] [NT:cytochrome bd-type quinol oxidase] [LE:1706] [RE:2734] [DI:direct]

| ORF Name | NT ID | AA ID | NT LN | AA LN | Score | P-Value |
|---|---|---|---|---|---|---|
| AI7503000990_5157963_f3_573 | 1907 | 5679 | 939 | 312 | 219 | 3.7e−22 |

Description
pir:[LN:E69827] [AC:E69827] [PN:glycerophosphodiester phosphodiesterase homolog yhdW] [GN:yhdW] [OR:*Bacillus subtilis*] [DB:pir2]
>gp:[GI:e1182963:g2633297] [LN:BSUB0006] [AC:Z99109:AL009126] [GN:yhdW] [FN:unknown] [OR:*Bacillus subtilis*] [DB:genpept-bct1] [DE:*Bacillus subtilis* complete genome (section 6 of 21):from 999501 to 1209940.] [NT:similar to glycerophosphodiester phosphodiesterase] [LE:37668] [RE:38399] [DI:complement] >gp:[GI:e1191883:g2226218] [LN:BSY14082] [AC:Y14082] [PN:hypothetical protein] [GN:yhdW] [OR:*Bacillus subtilis*] [DB:genpept-bct1] [DE:*Bacillus subtilis* chromosomal DNA, region 72 to 75 degrees:spoVR to sspB.] [NT:Similarity to glycerol diester phosphodiesterase] [LE:24316] [RE:25047] [DI:complement]

| ORF Name | NT ID | AA ID | NT LN | AA LN | Score | P-Value |
|---|---|---|---|---|---|---|
| AI7503000990_5162760_f3_514 | 1908 | 5680 | 129 | 42 | | |

Description
NO-HIT

| ORF Name | NT ID | AA ID | NT LN | AA LN | Score | P-Value |
|---|---|---|---|---|---|---|
| AI7503000990_5276712_c3_1016 | 1909 | 5681 | 708 | 235 | 659 | 1.1e−64 |

Description
sp:[LN:DCOP_LACLC] [AC:P50924] [GN:PYRF] [OR:*LACTOCOCCUS LACTIS*] [SR:,SUBSP *CREMORIS*:*STREPTOCOCCUS CREMORIS*] [EC:4.1.1.23] [DE:DECARBOXYLASE)] [SP:P50924] [DB:swissprot] >gp:[GI:e264705:g1070361] [LN:LLCPYRDB] [AC:X74207] [PN:OMP decarboxylase] [GN:pyrF] [OR:*Lactococcus lactis*] [DB:genpept-bct1] [DE:*L. lactis* pyrD and pyrF genes.] [SP:P50924] [LE:5309] [RE:6022] [DI:direct]

| ORF Name | NT ID | AA ID | NT LN | AA LN | Score | P-Value |
|---|---|---|---|---|---|---|
| AI7503000990_595312_c1_733 | 1910 | 5682 | 147 | 48 | | |

Description
NO-HIT

| ORF Name | NT ID | AA ID | NT LN | AA LN | Score | P-Value |
|---|---|---|---|---|---|---|
| AI7503000990_5974138_f1_158 | 1911 | 5683 | 204 | 67 | | |

Description
NO-HIT

| ORF Name | NT ID | AA ID | NT LN | AA LN | Score | P-Value |
|---|---|---|---|---|---|---|
| AI7503000990_5978453_c3_1029 | 1912 | 5684 | 492 | 163 | 261 | 1.6e−22 |

Description
sp:[LN:DEF_BACSU] [AC:P94462] [GN:DEF] [OR:*BACILLUS SUBTILIS*] [EC:3.5.1.31] [DE:DEFORMYLASE)] [SP:P94462] [DB:swissprot] >pir:[LN:F69613] [AC:F69613] [PN:polypeptide deformylase def] [GN:def] [CL:polypeptide deformylase] [OR:*Bacillus subtilis*] [DB:pir2] >gp:[GI:e290287:g1772499] [LN:BSPRIADFS] [AC:Y10304] [PN:polypeptide deformylase] [GN:def] [OR:*Bacillus subtilis*] [DB:genpept-bct1] [DE:*B. subtilis* priA, def, fmt, sun genes.] [SP:P94462] [LE:1762] [RE:2244] [DI:direct] >gp:[GI:e1185163:g2633944] [LN:BSUB0009] [AC:Z99112:AL009126] [PN:polypeptide deformylase] [GN:def] [OR:*Bacillus subtilis*] [DB:genpept-bct1] [EC:3.5.1.31] [DE:*Bacillus subtilis* complete genome (section 9 of 21):from 1598421 to 1807200.] [NT:alternate gene name: yloK] [SP:P94462] [LE:47491] [RE:47973] [DI:direct]
>gp:[GI:e323523:g2337801] [LN:BSY13937] [AC:Y13937] [PN:putative Def protein] [GN:yloK] [FN:unknown] [OR:*Bacillus subtilis*] [DB:genpept-bct1] [DE:*Bacillus subtilis* genomic DNA from the spoVM region.] [SP:P94462]

-continued

[LE:9263] [RE:9745] [DI:direct]

| ORF Name | NT ID | AA ID | NT LN | AA LN | Score | P-Value |
|---|---|---|---|---|---|---|
| AI7503000990_6023593_c1_730 | 1913 | 5685 | 288 | 95 | 296 | 3.2e−26 |

Description
pir:[LN:D69873] [AC:D69873] [PN:hypothetical protein ylaN] [GN:ylaN]
[OR:*Bacillus subtilis*] [DB:pir2] >gp:[GI:e1185074:g2633855] [LN:BSUB0008]
[AC:Z99111:AL009126] [GN:ylaN] [FN:unknown] [OR:*Bacillus subtilis*]
[DB:genpept-bct1] [DE:*Bacillus subtilis* complete genome (section 8 of 21):
from 1394791 to 1603020.] [LE:157027] [RE:157308] [DI:direct]
>gp:[GI:e1191897:g2224773] [LN:BSZ97025] [AC:Z97025] [GN:ylaN] [OR:*Bacillus subtilis*] [DB:genpept-bct1] [DE:*Bacillus subtilis* nprE,
yla[A,B,C,D,E,F,G,H,I,J,K,L,M,N,O] and pycA genes.] [LE:11286] [RE:11567]
[DI:direct]

| ORF Name | NT ID | AA ID | NT LN | AA LN | Score | P-Value |
|---|---|---|---|---|---|---|
| AI7503000990_6072125_c1_766 | 1914 | 5686 | 672 | 223 | 857 | 1.1e−85 |

Description
gp:[GI:g4009493] [LN:AF068904] [AC:AF068904] [PN:YlmE] [GN:ylmE]
[OR:*Staphylococcus aureus*] [DB:genpept-bct2] [DE:*Staphylococcus aureus* cell
division protein FtsZ (ftsZ) gene, partial cds; YlmD (ylmD), YlmE (ylmE),
YlmF (ylmF), YlmG (ylmG),and YlmH (ylmH) genes, complete cds; and cell
division protein DivIVA (divIVA) gene, partial cds.] [NT:similar to *Bacillus subtilis* YlmE] [LE:1246] [RE:1920] [DI:direct]

| ORF Name | NT ID | AA ID | NT LN | AA LN | Score | P-Value |
|---|---|---|---|---|---|---|
| AI7503000990_6115700_f3_647 | 1915 | 5687 | 1404 | 467 | 356 | 7.8e−64 |

Description
pir:[LN:H69858] [AC:H69858] [PN:cation ABC transporter (ATP-binding protei)
homolog ykoD] [GN:ykoD] [CL:ATP-binding cassette homology] [OR:*Bacillus subtilis*] [DB:pir2] >gp:[GI:e1181522:g2632042] [LN:BSAJ2571] [AC:AJ002571]
[PN:YkoD] [GN:ykoD] [OR:*Bacillus subtilis*] [DB:genpept-bct1] [DE:*Bacillus subtilis* 168 56 kb DNA fragment between xlyA and ykoR.] [NT:homologous to cobalt transport ATP binding protein] [LE:41106] [RE:42578] [DI:complement]
>gp:[GI:e1183342:g2633676] [LN:BSUB0007] [AC:Z99110:AL009126] [GN:ykoD]
[FN:unknown] [OR:*Bacillus subtilis*] [DB:genpept-bct1] [DE:*Bacillus subtilis*
complete genome (section 7 of 21):from 1194391 to 1411140.] [NT:similar to
cation ABC transporter (ATP-binding] [LE:194055] [RE:195527] [DI:complement]

| ORF Name | NT ID | AA ID | NT LN | AA LN | Score | P-Value |
|---|---|---|---|---|---|---|
| AI7503000990_6131693_c1_762 | 1916 | 5688 | 414 | 137 | 574 | 1.1e−55 |

Description
gp:[GI:d1023421:g2463560] [LN:AB007500] [AC:AB007500:D28879]
[OR:*Staphylococcus aureus*] [SR:*Staphylococcus aureus* (strain:NCTC8325) DNA]
[DB:genpept-bct1] [DE:*Staphylococcus aureus* genes for penicillin-binding
protein 1, MraY, MurD, partial and complete cds.] [NT:unnamed protein
product] [LE:212] [RE:613] [DI:direct] >gp:[GI:g2149892] [LN:SAU94706]
[AC:U94706] [PN:cell division protein] [GN:yllD] [OR:*Staphylococcus aureus*]
[DB:genpept-bct2] [DE:*Staphylococcus aureus* strain ATCC 8325-4 cell
wall/cell division gene cluster, yllB, yllC, yllD, pbpA, mraY, murD, div1B,
ftsA and ftsZ genes, complete cds.] [LE:1936] [RE:2337] [DI:direct]

| ORF Name | NT ID | AA ID | NT LN | AA LN | Score | P-Value |
|---|---|---|---|---|---|---|
| AI7503000990_6149077_c3_1033 | 1917 | 5689 | 891 | 296 | 708 | 7.0e−70 |

Description
pir:[LN:A69879] [AC:A69879] [PN:conserved hypothetical protein yloQ]
[GN:yloQ] [CL:conserved hypothetical protein HI1714] [OR:*Bacillus subtilis*]
[DB:pir2] >gp:[GI:e1185169:g2633950] [LN:BSUB0009] [AC:Z99112:AL009126]
[GN:yloQ] [FN:unknown] [OR:*Bacillus subtilis*] [DB:genpept-bct1] [DE:*Bacillus subtilis* complete genome (section 9 of 21):from 1598421 to 1807200.]
[NT:similar to hypothetical proteins] [LE:54082] [RE:54978] [DI:direct]
>gp:[GI:e323525:g2337807] [LN:BSY13937] [AC:Y13937] [PN:YloQ protein]
[GN:yloQ] [FN:unknown] [OR:*Bacillus subtilis*] [DB:genpept-bct1] [DE:*Bacillus subtilis* genomic DNA from the spoVM region.] [LE:15854] [RE:16750]
[DI:direct]

-continued

| ORF Name | NT ID | AA ID | NT LN | AA LN | Score | P-Value |
|---|---|---|---|---|---|---|
| AI7503000990_632762_f3_671 | 1918 | 5690 | 222 | 73 | | |

Description
NO-HIT

| ORF Name | NT ID | AA ID | NT LN | AA LN | Score | P-Value |
|---|---|---|---|---|---|---|
| AI7503000990_642_c3_1005 | 1919 | 5691 | 2784 | 927 | 4356 | 0.0 |

Description
sp:[LN:SYI_STAAU] [AC:P41972] [GN:ILES] [OR:*STAPHYLOCOCCUS AUREUS*]
[EC:6.1.1.5] [DE:(ILERS)] [SP:P41972] [DB:swissprot] >pir:[LN:S40178]
[AC:S40178] [PN:isoleucine--tRNA ligase,:isoleucyl-tRNA synthetase]
[CL:isoleucine--tRNA ligase] [OR:*Staphylococcus aureus*] [EC:6.1.1.5]
[DB:pir2] >gp:[GI:g437916] [LN:SAILES] [AC:X74219] [PN:isoleucyl-tRNA
synthetase] [GN:ileS] [OR:*Staphylococcus aureus*] [DB:genpept-bct1]
[DE:*S. aureus* gene for isoleucyl-tRNA synthetase.] [SP:P41972] [LE:91]
[RE:2844] [DI:direct]

| ORF Name | NT ID | AA ID | NT LN | AA LN | Score | P-Value |
|---|---|---|---|---|---|---|
| AI7503000990_6720452_c3_936 | 1920 | 5692 | 1356 | 451 | 1266 | 5.2e−129 |

Description
gp:[GI:d1039220:g4514628] [LN:AB016894] [AC:AB016894] [PN:bd-type quinol
oxidase subunit I] [GN:cbdA] [OR:*Bacillus stearothermophilus*] [SR:*Bacillus
stearothermophilus* (strain:K1041) DNA] [DB:genpept-bct1] [DE:*Bacillus
stearothermophilus* genes for bd-type quinol oxidase subunit I and subunit II,
complete cds.] [NT:cytochrome bd-type quinol oxidase] [LE:363] [RE:1709]
[DI:direct]

| ORF Name | NT ID | AA ID | NT LN | AA LN | Score | P-Value |
|---|---|---|---|---|---|---|
| AI7503000990_6720655_f3_530 | 1921 | 5693 | 147 | 48 | 68 | 0.045 |

Description
gp:[GI:g4049913] [LN:AF063866] [AC:AF063866] [PN:ORF MSV141 hypothetical
protein] [GN:MSV141] [OR:*Melanoplus sanguinipes* entomopoxvirus]
[DB:genpept-vrl] [DE:*Melanoplus sanguinipes* entomopoxvirus, complete
genome.] [LE:121430] [RE:121630] [DI:complement]

| ORF Name | NT ID | AA ID | NT LN | AA LN | Score | P-Value |
|---|---|---|---|---|---|---|
| AI7503000990_6834687_c2_831 | 1922 | 5694 | 309 | 102 | 209 | 5.3e−17 |

Description
pir:[LN:C69864] [AC:C69864] [PN:hypothetical protein yktA] [GN:yktA]
[OR:*Bacillus subtilis*] [DB:pir2] >gp:[GI:e1185054:g2633835] [LN:BSUB0008]
[AC:Z99111:AL009126] [GN:yktA] [FN:unknown] [OR:*Bacillus subtilis*]
[DB:genpept-bct1] [DE:*Bacillus subtilis* complete genome (section 8 of 21):
from 1394791 to 1603020.] [LE:140551] [RE:140817] [DI:direct]
>gp:[GI:g3282148] [LN:AF012285] [AC:AF012285:AF012284:U51911] [PN:unknown]
[GN:yktA] [FN:unknown] [OR:*Bacillus subtilis*] [DB:genpept-bct2] [DE:*Bacillus
subtilis* mobA-nprE gene region.] [LE:41039] [RE:41305] [DI:direct]

| ORF Name | NT ID | AA ID | NT LN | AA LN | Score | P-Value |
|---|---|---|---|---|---|---|
| AI7503000990_7225000_c3_1038 | 1923 | 5695 | 1026 | 341 | 898 | 5.2e−90 |

Description
pir:[LN:H69679] [AC:H69679] [PN:involved in fatty acid/phospholipid
synthesis plsX] [GN:plsX] [CL:phospholipid synthesis protein] [OR:*Bacillus
subtilis*] [DB:pir2] >gp:[GI:e1185180:g2633961] [LN:BSUB0009]
[AC:Z99112:AL009126] [GN:plsX] [FN:involved in fatty acid/phospholipid
synthesis] [OR:*Bacillus subtilis*] [DB:genpept-bct1] [DE:*Bacillus subtilis*
complete genome (section 9 of 21):from 1598421 to 1807200.] [NT:alternate
gene name:ylpD] [LE:63526] [RE:64527] [DI:direct] >gp:[GI:e323529:g2337818]
[LN:BSY13937] [AC:Y13937] [PN:putative PlsX protein] [GN:ylpD] [FN:unknown]
[OR:*Bacillus subtilis*] [DB:genpept-bct1] [DE:*Bacillus subtilis* genomic DNA
from the spoVM region.] [LE:25298] [RE:26299] [DI:direct]

| ORF Name | NT ID | AA ID | NT LN | AA LN | Score | P-Value |
|---|---|---|---|---|---|---|
| AI7503000990_7320465_c1_719 | 1924 | 5696 | 831 | 276 | 525 | 1.7e−50 |

Description
pir:[LN:G70179] [AC:G70179] [PN:spermidine/putrescine ABC transporter, -continued permease protein (potC) homolog] [CL:spermidine/putrescine transport system permease protein potI] [OR:*Borrelia burgdorferi*] [SR:, Lyme disease spirochete] [DB:pir2] >gp:[GI:g2688564] [LN:AE001165] [AC:AE001165:AE000783] [PN:spermidine/putrescine ABC transporter, permease] [GN:BB0640] [OR:*Borrelia burgdorferi*] [SR:Lyme disease spirochete] [DB:genpept-bct2] [DE:*Borrelia burgdorferi* (section 51 of 70) of the complete genome.] [NT:similar to GB:M64519 SP:P23859 PID:147328 GB:U00096] [LE:10307] [RE:11098] [DI:complement]

| ORF Name | NT ID | AA ID | NT LN | AA LN | Score | P-Value |
|---|---|---|---|---|---|---|
| AI7503000990_867176_c3_924 | 1925 | 5697 | 1512 | 503 | 1090 | 2.3e−110 |

Description
pir:[LN:C70468] [AC:C70468] [PN:phosphoribosylaminoimidazolecarboxamide formyltransferase] [GN:purH] [CL:purH bifunctional enzyme] [OR:*Aquifex aeolicus*] [DB:pir2] >gp:[GI:g2984204] [LN:AE000765] [AC:AE000765:AE000657] [PN:phosphoribosylaminoimidazolecarboxamide] [GN:purH] [OR:*Aquifex aeolicus*] [DB:genpept-bct2] [DE:*Aquifex aeolicus* section 97 of 109 of the complete genome.] [LE:7599] [RE:9119] [DI:complement]

| ORF Name | NT ID | AA ID | NT LN | AA LN | Score | P-Value |
|---|---|---|---|---|---|---|
| AI7503000990_892141_f2_303 | 1926 | 5698 | 396 | 131 | 281 | 1.2e−24 |

Description
gp:[GI:e1487496:g5042304] [LN:MMU242955] [AC:AJ242955] [PN:hypothetical protein (P4(21)n)] [GN:P4(21)n] [OR:*Mus musculus*] [SR:house mouse] [DB:genpept-rod] [DE:*Mus musculus* partial mRNA for hypothetical protein (P4(21)n gene).] [NT:similar with amyh_yeast glucoamylase S1/S2] [LE:<1] [RE:1203] [DI:direct] >gp:[GI:d1042681:g5103287] [LN:AB028868] [AC:AB028868] [GN:P4(21)n] [OR:*Mus musculus*] [SR:*Mus musculus* mRNA] [DB:genpept] [DE:*Mus musculus* P4(21)n mRNA, partial cds.] [NT:The protein is similar with AMYH_YEAST GLUCOAMYLASE] [LE:<1] [RE:1203] [DI:direct]

| ORF Name | NT ID | AA ID | NT LN | AA LN | Score | P-Value |
|---|---|---|---|---|---|---|
| AI7503000990_892312_c3_980 | 1927 | 5699 | 156 | 51 | | |

Description
NO-HIT

| ORF Name | NT ID | AA ID | NT LN | AA LN | Score | P-Value |
|---|---|---|---|---|---|---|
| AI7503000990_968785_f2_361 | 1928 | 5700 | 939 | 312 | 1274 | 7.4e−130 |

Description
gp:[GI:g3320606] [LN:AF072726] [AC:AF072726] [PN:putative heme A synthase] [GN:ctaA] [OR:*Staphylococcus aureus*] [DB:genpept-bct2] [DE:*Staphylococcus aureus* putative heme A synthase (ctaA) gene, complete cds.] [NT:CtaA] [LE:139] [RE:1050] [DI:direct]

| ORF Name | NT ID | AA ID | NT LN | AA LN | Score | P-Value |
|---|---|---|---|---|---|---|
| AI7503000990_968811_c1_753 | 1929 | 5701 | 651 | 216 | 599 | 2.5e−58 |

Description
sp:[LN:DHSC_BACSU] [AC:P08064] [GN:SDHC] [OR:*BACILLUS SUBTILIS*] [DE:SUCCINATE DEHYDROGENASE CYTOCHROME B-558 SUBUNIT] [SP:P08064] [DB:Swissprot] >pir:[LN:DEBSSC] [AC:A29843:I39972:E69704] [PN:succinate dehydrogenase, cytochrome b558:fumarate reductase C protein] [GN:sdhC:sdhA] [CL:succinate dehydrogenase cytochrome b558] [OR:*Bacillus subtilis*] [EC:1.3.99.1] [DB:pir1] [MP:70] >gp:[GI:g143525] [LN:BACSDHAB] [AC:M13470:M15107] [OR:*Bacillus subtilis*] [SR:*B. subtilis* DNA, clone pKIM4] [DB:genpept-bct1] [DE:*B. subtilis* succinate dehydrogenase complex encoding cytochrome b-558 subunit, complete cds, and flavoprotein subunit, 5' end.] [NT:succinate dehydrogenase cytochrome b-558 subunit] [LE:265] [RE:873] [DI:direct] >gp:[GI:e1184094:g2635310] [LN:BSUB0015] [AC:Z99118:AL009126] [PN:succinate dehydrogenase (cytochrome b558)] [GN:sdhC] [OR:*Bacillus subtilis*] [DB:genpept-bct1] [DE:*Bacillus subtilis* complete genome (section 15 of 21):from 2795131 to 3013540.] [SP:P08064] [LE:112102] [RE:112710] [DI:complement] >gp:[GI:e1165347:g1770051] [LN:BSZ75208] [AC:Z75208] [PN:cytochrome b558 subunit of succinate] [GN:sdhC] [OR:*Bacillus subtilis*] [DB:genpept-bct1] [EC:1.3.99.1] [DE:*B. subtilis* genomic sequence 89009bp.] [SP:P08064] [LE:57197] [RE:57805] [DI:direct]

| ORF Name | NT ID | AA ID | NT LN | AA LN | Score | P-Value |
|---|---|---|---|---|---|---|
| AI7503000990_969052_f2_434 | 1930 | 5702 | 129 | 42 | | |

Description
NO-HIT

| ORF Name | NT ID | AA ID | NT LN | AA LN | Score | P-Value |
|---|---|---|---|---|---|---|
| AI7503000990_9881927_f1_75 | 1931 | 5703 | 180 | 59 | | |

Description
NO-HIT

| ORF Name | NT ID | AA ID | NT LN | AA LN | Score | P-Value |
|---|---|---|---|---|---|---|
| AI7503000990_990702_c1_765 | 1932 | 5704 | 1185 | 394 | 1809 | 1.5e−186 |

Description
sp:[LN:FTSZ_STAAU] [AC:P45498] [GN:FTSZ] [OR:*STAPHYLOCOCCUS AUREUS*] [DE:CELL
DIVISION PROTEIN FTSZ] [SP:P45498] [DB:swissprot] >pir:[LN:S58814]
[AC:S58814] [PN:cell division protein ftsZ] [CL:cell division protein ftsZ]
[OR:*Staphylococcus aureus*] [DB:pir1] >gp:[GI:g458428] [LN:SAU06462]
[AC:U06462] [PN:FtsZ] [GN:ftsZ] [OR:*Staphylococcus aureus*] [DB:genpept-bct1]
[DE:*Staphylococcus aureus* SA4 FtsZ (ftsZ) gene, complete cds.] [LE:27]
[RE:1199] [DI:direct] >gp:[GI:g2149898] [LN:SAU94706] [AC:U94706] [PN:cell
division protein] [GN:ftsZ] [OR:*Staphylococcus aureus*] [DB:genpept-bct2]
[DE:*Staphylococcus aureus* strain ATCC 8325-4 cell wall/cell division gene
cluster, yllB, yllC, yllD, pbpA, mraY, murD, div1B, ftsA and ftsZ genes,
complete cds.] [LE:10052] [RE:11224] [DI:direct]

| ORF Name | NT ID | AA ID | NT LN | AA LN | Score | P-Value |
|---|---|---|---|---|---|---|
| AI7503000990_9923437_f2_345 | 1933 | 5705 | 141 | 46 | | |

Description
NO-HIT

| ORF Name | NT ID | AA ID | NT LN | AA LN | Score | P-Value |
|---|---|---|---|---|---|---|
| AI7503000990_9925910_c2_813 | 1934 | 5706 | 597 | 198 | 430 | 2.0e−40 |

Description
sp:[LN:PUR3_BACSU] [AC:P12040] [GN:PURN] [OR:*BACILLUS SUBTILIS*] [EC:2.1.2.2]
[DE:TRANSFORMYLASE) (5'-PHOSPHORIBOSYLGLYCINAMIDE TRANSFORMYLASE)]
[SP:P12040] [DB:swissprot] >pir:[LN:XYBSGF] [AC:I29326:B69685]
[PN:phosphoribosylglycinamide formyltransferase,] [GN:purN]
[CL:phosphoribosylglycinamide formyltransferase:phosphoribosylglycinamide
formyltransferase homology] [OR:*Bacillus subtilis*] [EC:2.1.2.2] [DB:pir1]
[MP:18 min] >gp:[GI:g143372] [LN:BACPURF] [AC:J02732:K00047] [OR:*Bacillus
subtilis*] [SR:*B. subtilis* (strain DE1 (prototroph DER. or W168)) DNA, clone
pPZ] [DB:genpept-bct1] [DE:*B. subtilis* pur operon encoding purine
biosynthesis enzymes, 12 genes.] [NT:phosphoribosyl glycinamide
formyltransferase] [LE:9833] [RE:10420] [DI:direct]
>gp:[GI:e1182631:g2632965] [LN:BSUB0004] [AC:Z99107:AL009126]
[PN:phosphoribosylglycinamide formyltransferase] [GN:purN] [FN:purine
biosynthesis] [OR:*Bacillus subtilis*] [DB:genpept-bct1] [EC:2.1.2.2]
[DE:*Bacillus subtilis* complete genome (section 4 of 21):from 600701
to 813890.] [SP:P12040] [LE:106815] [RE:107402] [DI:direct]

| ORF Name | NT ID | AA ID | NT LN | AA LN | Score | P-Value |
|---|---|---|---|---|---|---|
| AI7503000990_9933463_c3_933 | 1935 | 5707 | 1188 | 395 | 897 | 6.6e−90 |

Description
sp:[LN:YWBD_BACSU] [AC:P39587] [GN:YWBD:IPA-19D] [OR:*BACILLUS SUBTILIS*]
[DE:HYPOTHETICAL 44.4 KD PROTEIN IN EPR-GALK INTERGENIC REGION] [SP:P39587]
[DB:swissprot] >pir:[LN:S39674] [AC:S39674:B70051] [PN:ywbD]
protein:hypothetical protein ipa-19d] [GN:ywbD] [CL:probable
methyltransferase b0967] [OR:*Bacillus subtilis*] [DB:pir2] >gp:[GI:g413943]
[LN:BSGENR] [AC:X73124] [GN:ipa-19d] [OR:*Bacillus subtilis*]
[DB:genpept-bct1] [DE:*B. subtilis* genomic region (325 to 333).] [SP:P39587]
[LE:20551] [RE:21741] [DI:direct] >gp:[GI:e1186335:g2636371] [LN:BSUB0020]
[AC:Z99123:AL009126] [GN:ywbD] [FN:unknown] [OR:*Bacillus subtilis*]
[DB:genpept-bct1] [DE:*Bacillus subtilis* complete genome (section 20 of 21):
from 3798401 to 4010550.] [NT:alternate gene name:ipa-19d; similar to]
[SP:P39587] [LE:136218] [RE:137408] [DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000990__9954640__f3__487 | 1936 | 5708 | 228 | 75 | 117 | 3.0e−07 |

Description
gp:[GI:g2196686] [LN:EFU25090] [AC:U25090] [PN:pyrimidine biosynthesis
protein Ab] [GN:pyrAb] [OR:*Enterococcus faecalis*] [DB:genpept-bct1]
[DE:*Enterococcus faecalis* plasmid pKV48 pyrimidine biosynthesis protein Ab
(pyrAb) gene, partial cds.] [LE:<1] [RE:>253] [DI:direct]

| ORF Name | NT ID | AA ID | NT LN | AA LN | Score | P-Value |
|---|---|---|---|---|---|---|
| AI7503000991__10928__f1__70 | 1937 | 5709 | 1242 | 413 | 238 | 1.4e−17 |

Description
pir:[LN:T03492] [AC:T03492] [PN:hypothetical protein] [OR:*Rhodobacter
capsulatus*] [DB:pir2] [MP:1] >gp:[GI:g3128293] [LN:AF010496] [AC:AF010496]
[PN:hypothetical protein] [OR:*Rhodobacter capsulatus*] [DB:genpept-bct2]
[DE:*Rhodobacter capsulatus* strain SB1003, partial genome.] [LE:54291]
[RE:55613] [DI:complement]

| ORF Name | NT ID | AA ID | NT LN | AA LN | Score | P-Value |
|---|---|---|---|---|---|---|
| AI7503000991__10948587__c1__430 | 1938 | 5710 | 822 | 273 | 757 | 4.5e−75 |

Description
gp:[GI:g4160468] [LN:AF109909] [AC:AF109909] [PN:putative protein] [GN:ykoY]
[OR:*Bacillus megaterium*] [DB:genpept-bct2] [DE:*Bacillus megaterium*
polyhydroxyalkanoate gene cluster, complete sequence.] [NT:similar to toxic
anion resistance protein] [LE:277] [RE:1092] [DI:direct]

| ORF Name | NT ID | AA ID | NT LN | AA LN | Score | P-Value |
|---|---|---|---|---|---|---|
| AI7503000991__11210760__f2__261 | 1939 | 5711 | 162 | 53 | | |

Description
NO-HIT

| ORF Name | NT ID | AA ID | NT LN | AA LN | Score | P-Value |
|---|---|---|---|---|---|---|
| AI7503000991__11220301__c2__523 | 1940 | 5712 | 126 | 41 | 108 | 3.4e−06 |

Description
pir:[LN:QQSA8T] [AC:A04493] [PN:hypothetical protein B-189]
[OR:*Staphylococcus aureus*] [DB:pir1]

| ORF Name | NT ID | AA ID | NT LN | AA LN | Score | P-Value |
|---|---|---|---|---|---|---|
| AI7503000991__1180328__c3__606 | 1941 | 5713 | 816 | 271 | 372 | 2.8e−34 |

Description
pir:[LN:H70003] [AC:H70003] [PN:probable prolyl aminopeptidase,
ytxM:cytosol aminopeptidase V:Pro-X aminopeptidase:proline
aminopeptidase:proline iminopeptidase] [GN:ytxM] [OR:*Bacillus subtilis*]
[EC:3.4.11.5] [DB:pir2] >gp:[GI:e1185954:g2635565] [LN:BSUB0016]
[AC:Z99119:AL009126] [GN:ytxM] [FN:unknown] [OR:*Bacillus subtilis*]
[DB:genpept-bct1] [DE:*Bacillus subtilis* complete genome (section 16 of 21):
from 2997771 to 3213410.] [NT:alternate gene name:ytfB; similar to prolyl]
[LE:151061] [RE:151885] [DI:complement] >gp:[GI:g2293147] [LN:AF008220]
[AC:AF008220] [PN:YtxM] [GN:ytxM] [OR:*Bacillus subtilis*] [DB:genpept-bct2]
[DE:*Bacillus subtilis* rrnB-dnaB genomic region.] [NT:similarity with
2-hydroxy-6-oxo-2,4-heptadienoate] [LE:28542] [RE:29366] [DI:direct]

| ORF Name | NT ID | AA ID | NT LN | AA LN | Score | P-Value |
|---|---|---|---|---|---|---|
| AI7503000991__12239817__c2__520 | 1942 | 5714 | 168 | 55 | | |

Description
NO-HIT

| ORF Name | NT ID | AA ID | NT LN | AA LN | Score | P-Value |
|---|---|---|---|---|---|---|
| AI7503000991__12681510__f3__365 | 1943 | 5715 | 825 | 274 | 702 | 3.0e−69 |

Description
pir:[LN:F69841] [AC:F69841] [PN:conserved hypothetical protein yitU]
[GN:yitU] [OR:*Bacillus subtilis*] [DB:pir2] >gp:[GI:e261990:g1620926]
[LN:BS168NPRB] [AC:Z79580] [GN:putative orf] [FN:unknown] [OR:*Bacillus
subtilis*] [DB:genpept-bct1] [DE:*B. subtilis* nprB gene.] [LE:4492] [RE:5304]
[DI:complement] >gp:[GI:e1183116:g2633450] [LN:BSUB0006]
[AC:Z99109:AL009126] [GN:yitU] [FN:unknown] [OR:*Bacillus subtilis*]

-continued

[DB:genpept-bct1] [DE:*Bacillus subtilis* complete genome (section 6 of 21):
from 999501 to 1209940.] [NT:similar to hypothetical proteins] [LE:190463]
[RE:191275] [DI:complement] >gp:[GI:e1173548:g2145415] [LN:BSY09476]
[AC:Y09476] [PN:YitU] [OR:*Bacillus subtilis*] [DB:genpept-bct1]
[DE:*B. subtilis* 54 kb genomic DNA fragment.] [NT:putative ORF] [LE:47689]
[RE:48501] [DI:complement]

| ORF Name | NT ID | AA ID | NT LN | AA LN | Score | P-Value |
|---|---|---|---|---|---|---|
| AI7503000991__12750290_c1__400 | 1944 | 5716 | 1122 | 373 | 1233 | 1.6e−125 |

Description
pir:[LN:B69669] [AC:B69669:S15233:D38447] [PN:oligopeptide transport
ATP-binding protein oppD:sporulation initiation protein spo0KD]
[GN:spo0KD:oppD] [CL:inner membrane protein malK:ATP-binding cassette
homology] [OR:*Bacillus subtilis*] [DB:pir2] >gp:[GI:e1183166:g2633500]
[LN:BSUB0007] [AC:Z99110:AL009126] [PN:oligopeptide ABC transporter
(ATP-binding)] [GN:oppD] [FN:required for initiation of sporulation,]
[OR:*Bacillus subtilis*] [DB:genpept-bct1] [DE:*Bacillus subtilis* complete
genome (section 7 of 21):from 1194391 to 1411140.] [NT:alternate gene name:
spo0KD] [LE:28537] [RE:29613] [DI:direct]

| ORF Name | NT ID | AA ID | NT LN | AA LN | Score | P-Value |
|---|---|---|---|---|---|---|
| AI7503000991__13089052_f3__290 | 1945 | 5717 | 240 | 79 | 112 | 1.0e−06 |

Description
pir:[LN:A60998] [AC:A60998] [PN:replication protein REP] [OR:*Staphylococcus
aureus*] [DB:pir2] >gp:[GI:g295834] [LN:SAPOX2000] [AC:X55798]
[OR:*Staphylococcus aureus*] [DB:genpept-bct1] [DE:*S. aureus* plasmid pOX2000.]
[NT:ORF 154] [LE:587] [RE:1051] [DI:direct]

| ORF Name | NT ID | AA ID | NT LN | AA LN | Score | P-Value |
|---|---|---|---|---|---|---|
| AI7503000991__13829403_f1__46 | 1946 | 5718 | 129 | 42 | | |

Description
NO-HIT

| ORF Name | NT ID | AA ID | NT LN | AA LN | Score | P-Value |
|---|---|---|---|---|---|---|
| AI7503000991__13848387_f2__141 | 1947 | 5719 | 240 | 79 | 131 | 9.8e−09 |

Description
pir:[LN:S75993] [AC:S75993] [PN:hypothetical protein] [OR:*Synechocystis*
sp.] [SR:PCC 6803, , PCC 6803] [SR:PCC 6803,] [DB:pir2]
>gp:[GI:d1011491:g1001353] [LN:SYCSLLLH] [AC:D64006:AB001339]
[PN:hypothetical protein] [GN:clpP] [OR:*Synechocystis* sp.] [SR:*Synechocystis*
sp. (strain:PCC6803) DNA] [DB:genpept-bct1] [DE:*Synechocystis* sp. PCC6803
complete genome, 25/27, 3138604–3270709.] [NT:ORF__ID:s110498] [LE:80076]
[RE:80528] [DI:complement]

| ORF Name | NT ID | AA ID | NT LN | AA LN | Score | P-Value |
|---|---|---|---|---|---|---|
| AI7503000991__1445930_f2__152 | 1948 | 5720 | 621 | 206 | 103 | 0.0023 |

Description
pir:[LN:A70417] [AC:A70417] [PN:hypothetical protein aq__1349] [GN:aq__1349]
[OR:*Aquifex aeolicus*] [DB:pir2] >gp:[GI:g2983776] [LN:AE000736]
[AC:AE000736:AE000657] [PN:putative protein] [GN:aq__1349] [OR:*Aquifex
aeolicus*] [DB:genpept-bct2] [DE:*Aquifex aeolicus* section 68 of 109 of the
complete genome.] [LE:1950] [RE:2756] [DI:direct]

| ORF Name | NT ID | AA ID | NT LN | AA LN | Score | P-Value |
|---|---|---|---|---|---|---|
| AI7503000991__14460882_c1__443 | 1949 | 5721 | 1722 | 573 | 1304 | 4.9e−133 |

Description
gp:[GI:g1022726] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000991__14460887_f1__3 | 1950 | 5722 | 153 | 50 | 115 | 1.7e−06 |

Description
gp:[GI:g1022726] [LN:SHU35635] [AC:U35635] [PN:unknown] [OR:*Staphylococcus*

-continued

*haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000991__14484553_c2__467 | 1951 | 5723 | 1356 | 451 | 1726 | 9.3e−178 |

Description
sp:[LN:G6PA__BACST] [AC:P13375] [GN:PGIA] [OR:*BACILLUS STEAROTHERMOPHILUS*]
[EC:5.3.1.9] [DE:ISOMERASE A)] [SP:P13375] [DB:swissprot] >pir:[LN:NUBSSA]
[AC:S15936:S06196] [PN:glucose-6-phosphate isomerase, A:phosphoglucose
isomerase:phosphohexose isomerase] [CL:glucose-6-phosphate isomerase]
[OR:*Bacillus stearothermophilus*] [EC:5.3.1.9] [DB:pir1] >gp:[GI:g40046]
[LN:BSPGIA] [AC:X16639] [OR:*Bacillus stearothermophilus*] [DB:genpept-bct1]
[DE:*Bacillus stearothermophilus* pgiA gene for phosphoglucoisomeraseisoenzyme
A (EC 5.3.1.9).] [NT:phosphoglucose isomerase A (AA 1–449)] [SP:P13375]
[LE:95] [RE:1444] [DI:direct]

| ORF Name | NT ID | AA ID | NT LN | AA LN | Score | P-Value |
|---|---|---|---|---|---|---|
| AI7503000991__14648512_c3__585 | 1952 | 5724 | 126 | 41 | | |

Description
NO-HIT

| ORF Name | NT ID | AA ID | NT LN | AA LN | Score | P-Value |
|---|---|---|---|---|---|---|
| AI7503000991__14656432_c3__582 | 1953 | 5725 | 168 | 55 | 78 | 0.033 |

Description
gp:[GI:g3158514] [LN:CELT04D1] [AC:AF067617] [GN:T04D1.2] [OR:*Caenorhabditis elegans*] [DB:genpept-inv1] [DE:*Caenorhabditis elegans* cosmid T04D1.]
[LE:10425:10567:11420:12480] [RE:10517:10646:11689:12789] [DI:directJoin]

| ORF Name | NT ID | AA ID | NT LN | AA LN | Score | P-Value |
|---|---|---|---|---|---|---|
| AI7503000991__14884437_c1__437 | 1954 | 5726 | 165 | 54 | | |

Description
NO-HIT

| ORF Name | NT ID | AA ID | NT LN | AA LN | Score | P-Value |
|---|---|---|---|---|---|---|
| AI7503000991__15038450_c2__469 | 1955 | 5727 | 135 | 44 | | |

Description
NO-HIT

| ORF Name | NT ID | AA ID | NT LN | AA LN | Score | P-Value |
|---|---|---|---|---|---|---|
| AI7503000991__16683437_f1__5 | 1956 | 5728 | 1023 | 340 | 571 | 2.3e−55 |

Description
pir:[LN:A69863] [AC:A69863] [PN:conserved hypothetical protein ykrP]
[GN:ykrP] [OR:*Bacillus subtilis*] [DB:pir2] >gp:[GI:e1184942:g2633723]
[LN:BSUB0008] [AC:Z99111:AL009126] [GN:ykrP] [FN:unknown] [OR:*Bacillus subtilis*] [DB:genpept-bct1] [DE:*Bacillus subtilis* complete genome (section 8 of 21):from 1394791 to 1603020.] [NT:similar to hypothetical proteins]
[LE:22614] [RE:23636] [DI:complement]

| ORF Name | NT ID | AA ID | NT LN | AA LN | Score | P-Value |
|---|---|---|---|---|---|---|
| AI7503000991__16832562_f1__67 | 1957 | 5729 | 804 | 267 | 320 | 4.5e−36 |

Description
pir:[LN:H69843] [AC:H69843] [PN:hypothetical protein yjbH] [GN:yjbH]
[OR:*Bacillus subtilis*] [DB:pir2] >gp:[GI:e1183175:g2633509] [LN:BSUB0007]
[AC:Z99110:AL009126] [GN:yjbH] [FN:unknown] [OR:*Bacillus subtilis*]
[DB:genpept-bct1] [DE:*Bacillus subtilis* complete genome (section 7 of 21):
from 1194391 to 1411140.] [LE:38695] [RE:39522] [DI:complement]

| ORF Name | NT ID | AA ID | NT LN | AA LN | Score | P-Value |
|---|---|---|---|---|---|---|
| AI7503000991__187683_c1__417 | 1958 | 5730 | 228 | 75 | 256 | 1.3e−23 |

Description
sp:[LN:BIN3__STAAU] [AC:P20384] [GN:BIN3] [OR:*STAPHYLOCOCCUS AUREUS*]
[DE:POTENTIAL DNA-INVERTASE BIN3 (TRANSPOSON TN552)] [SP:P20384]

-continued

[DB:swissprot] >gp:[GI:g398182] [LN:SABINR3] [AC:X16298] [OR:*Staphylococcus aureus*] [DB:genpept-bct1] [DE:*Staphylococcus aureus* plasmid pI9789 DNA with binR and bin3 genes, derived from transposon TN552.] [NT:bin3 product] [SP:P20384] [LE:1049] [RE:1657] [DI:direct]

| ORF Name | NT ID | AA ID | NT LN | AA LN | Score | P-Value |
|---|---|---|---|---|---|---|
| AI7503000991__195177__c2__521 | 1959 | 5731 | 141 | 46 | 127 | 2.6e−08 |

Description
pir:[LN:S42239] [AC:S42239] [PN:hypothetical protein 3] [OR:*Staphylococcus aureus*] [DB:pir2] >gp:[GI:g501834] [LN:PNS1CG] [AC:M16217] [OR:Plasmid pNS1] [SR:Plasmid pNS1 from *Staphylococcus aureus*, plasmid pTP5 DNA] [DB:genpept-bct1] [DE:Plasmid pNS1 (from *Staphylococcus aureus*) encoding tetracycline-resistance (tet), complete genome.] [NT:ORF C; putative] [LE:1870] [RE:2409] [DI:direct]

| ORF Name | NT ID | AA ID | NT LN | AA LN | Score | P-Value |
|---|---|---|---|---|---|---|
| AI7503000991__19531626__f3__304 | 1960 | 5732 | 126 | 41 | | |

Description
NO-HIT

| ORF Name | NT ID | AA ID | NT LN | AA LN | Score | P-Value |
|---|---|---|---|---|---|---|
| AI7503000991__19547938__c2__498 | 1961 | 5733 | 372 | 123 | 224 | 7.4e−18 |

Description
sp:[LN:G6PD_LEUME] [AC:P11411] [GN:ZWF] [OR:*LEUCONOSTOC MESENTEROIDES*] [EC:1.1.1.49] [DE:GLUCOSE-6-PHOSPHATE 1-DEHYDROGENASE, (G6PD)] [SP:P11411] [DB swissprot]

| ORF Name | NT ID | AA ID | NT LN | AA LN | Score | P-Value |
|---|---|---|---|---|---|---|
| AI7503000991__19566553__c1__428 | 1962 | 5734 | 159 | 52 | | |

Description
NO-HIT

| ORF Name | NT ID | AA ID | NT LN | AA LN | Score | P-Value |
|---|---|---|---|---|---|---|
| AI7503000991__1960952__c2__473 | 1963 | 5735 | 906 | 301 | 575 | 8.7e−56 |

Description
pir:[LN:C69837] [AC:C69837] [PN:5-oxo-1,2,5-tricarboxilic-3-penten acid de homolog yisK] [GN:yisK] [CL:2-hydroxyhepta-2,4-diene-1,7-dioate isomerase] [OR:*Bacillus subtilis*] [DB:pir2] >gp:[GI:e1183077:g2633411] [LN:BSUB0006] [AC:Z99109:AL009126] [GN:yisK] [FN:unknown] [OR:*Bacillus subtilis*] [DB:genpept-bct1] [DE:*Bacillus subtilis* complete genome (section 6 of 21): from 999501 to 1209940.] [NT:similar to 5-oxo-1,2,5-tricarboxilic-3-penten acid] [LE:152216] [RE:153121] [DI:direct] >gp:[GI:e1173509:g2145376] [LN:BSY09476] [AC:Y09476] [PN:YisK] [OR:*Bacillus subtilis*] [DB:genpept-bct1] [DE:*B. subtilis* 54 kb genomic DNA fragment.] [NT:putative - Homology with oxo-tricarboxilic-pentene] [LE:9442] [RE:10347] [DI:direct]

| ORF Name | NT ID | AA ID | NT LN | AA LN | Score | P-Value |
|---|---|---|---|---|---|---|
| AI7503000991__19610442__f1__56 | 1964 | 5736 | 246 | 81 | 219 | 4.6e−18 |

Description
gp:[GI:d1045996:g5360820] [LN:D86934] [AC:D86934] [PN:transposase] [OR:*Staphylococcus aureus*] [SR:*Staphylococcus aureus* (strain:N315) DNA, clone_lib:library of N31] [DB:genpept] [DE:*Staphylococcus aureus* genes, mec region, partial and complete cds.] [NT:ORF N026; putative] [LE:19527] [RE:19751] [DI:direct]

| ORF Name | NT ID | AA ID | NT LN | AA LN | Score | P-Value |
|---|---|---|---|---|---|---|
| AI7503000991__19790902__c2__493 | 1965 | 5737 | 813 | 270 | 919 | 3.1e−92 |

Description
pir:[LN:F69844] [AC:F69844] [PN:conserved hypothetical protein yjbN] [GN:yjbN] [CL:conserved hypothetical protein HI0072] [OR:*Bacillus subtilis*] [DB:pir2] >gp:[GI:e1183181:g2633515] [LN:BSUB0007] [AC:Z99110:AL009126] [GN:yjbN] [FN:unknown] [OR:*Bacillus subtilis*] [DB:genpept-bct1] [DE:*Bacillus subtilis* complete genome (section 7 of 21):from 1194391 to 1411140.] [NT:similar to hypothetical proteins] [LE:42741] [RE:43541] [DI:direct]

-continued

| ORF Name | NT ID | AA ID | NT LN | AA LN | Score | P-Value |
|---|---|---|---|---|---|---|
| AI7503000991_20517062_c2_478 | 1966 | 5738 | 1002 | 333 | 961 | 1.1e−96 |

Description
pir:[LN:F69842] [AC:F69842] [PN:3-oxoacyl-acyl-carrier protein synthase homolog yjaX] [GN:yjaX] [CL:3-oxoacyl-[acyl-carrier-protein] synthase III] [OR:*Bacillus subtilis*] [DB:pir2] >gp:[GI:e1183136:g2633470] [LN:BSUB0006] [AC:Z99109:AL009126] [GN:yjaX] [FN:unknown] [OR:*Bacillus subtilis*] [DB:genpept-bct1] [DE:*Bacillus subtilis* complete genome (section 6 of 21): from 999501 to 1209940.] [NT:similar to 3-oxoacyl- acyl-carrier protein] [LE:208189] [RE:209127] [DI:direct] >gp:[GI:e1183153:g2633487] [LN:BSUB0007] [AC:Z99110:AL009126] [GN:yjaX] [FN:unknown] [OR:*Bacillus subtilis*] [DB:genpept-bct1] [DE:*Bacillus subtilis* complete genome (section 7 of 21): from 1194391 to 1411140.] [NT:similar to 3-oxoacyl- acyl-carrier protein] [LE:13299] [RE:14237] [DI:direct]

| ORF Name | NT ID | AA ID | NT LN | AA LN | Score | P-Value |
|---|---|---|---|---|---|---|
| AI7503000991_20585302_f2_149 | 1967 | 5739 | 126 | 41 | | |

Description
NO-HIT

| ORF Name | NT ID | AA ID | NT LN | AA LN | Score | P-Value |
|---|---|---|---|---|---|---|
| AI7503000991_20739037_c1_452 | 1968 | 5740 | 426 | 141 | 690 | 5.7e−68 |

Description
gp:[GI:g2267243] [LN:SEU71377] [AC:U71377] [PN:putative transcriptional regulator AtlR] [OR:*Staphylococcus epidermidis*] [DB:genpept-bct1] [DE:*Staphylococcus epidermidis* autolysin AtlE and putative transcriptional regulator AtlR genes, complete cds.] [LE:6867] [RE:7286] [DI:complement]

| ORF Name | NT ID | AA ID | NT LN | AA LN | Score | P-Value |
|---|---|---|---|---|---|---|
| AI7503000991_2125903_f3_313 | 1969 | 5741 | 1239 | 412 | 197 | 6.2e−13 |

Description
pir:[LN:D71112] [AC:D71112] [PN:hypothetical protein PH0667] [GN:PH0667] [OR:*Pyrococcus horikoshii*] [DB:pir2] >gp:[GI:d1030701:g3257075] [LN:AP000003] [AC:AP000003:AB009484:AB009485:AB009486:AB009487:AB009488:AB009489] [PN:413aa long hypothetical protein] [GN:PH0667] [OR:*Pyrococcus horikoshii*] [SR:*Pyrococcus horikoshii* (strain:OT3) DNA] [DB:genpept-bct1] [DE:*Pyrococcus horikoshii* OT3 genomic DNA, 544001–777000 nt. position(3/7).] [LE:51915] [RE:53156] [DI:complement]

| ORF Name | NT ID | AA ID | NT LN | AA LN | Score | P-Value |
|---|---|---|---|---|---|---|
| AI7503000991_21571937_f3_380 | 1970 | 5742 | 213 | 70 | 54 | 0.015 |

Description
pir:[LN:F71120] [AC:F71120] [PN:hypothetical protein PH0733] [GN:PH0733] [OR:*Pyrococcus horikoshii*] [DB:pir2] >gp:[GI:d1030767:g3257141] [LN:AP000003] [AC:AP000003:AB009484:AB009485:AB009486:AB009487:AB009488:AB009489] [PN:150aa long hypothetical protein] [GN:PH0733] [OR:*Pyrococcus horikoshii*] [SR:*Pyrococcus horikoshii* (strain:OT3) DNA] [DB:genpept-bct1] [DE:*Pyrococcus horikoshii* OT3 genomic DNA, 544001–777000 nt. position(3/7).] [LE:107943] [RE:108395] [DI:complement]

| ORF Name | NT ID | AA ID | NT LN | AA LN | Score | P-Value |
|---|---|---|---|---|---|---|
| AI7503000991_21594202_f2_167 | 1971 | 5743 | 1176 | 391 | 1674 | 3.0e−172 |

Description
gp:[GI:e1301685:g3256224] [LN:SAY14370] [AC:Y14370] [GN:ypfP] [OR:*Staphylococcus aureus*] [DB:genpept-bct1] [DE:*Staphylococcus aureus* RF3, murE, ypfP genes.] [LE:5160] [RE:6335] [DI:direct]

| ORF Name | NT ID | AA ID | NT LN | AA LN | Score | P-Value |
|---|---|---|---|---|---|---|
| AI7503000991_21753125_c2_481 | 1972 | 5744 | 1194 | 397 | 664 | 2.0e−79 |

Description
pir:[LN:S16649] [AC:S16649:S18271:E69618:I40001] [PN:dipeptide ABC transporter (permease):dciAC protein] [GN:dppC:dciAC] [CL:oligopeptide permease protein oppB] [OR:*Bacillus subtilis*] [DB:pir2]

-continued

>gp:[GI:e1181495:g2632015] [LN:BSAJ2571] [AC:AJ002571] [PN:DppC] [GN:dppC]
[FN:ABC-type dipeptide transport system] [OR:*Bacillus subtilis*]
[DB:genpept-bct1] [DE:*Bacillus subtilis* 168 56 kb DNA fragment between xlyA
and ykoR.] [LE:14301] [RE:15263] [DI:direct] >gp:[GI:e1183314:g2633648]
[LN:BSUB0007] [AC:Z99110:AL009126] [PN:dipeptide ABC transporter (permease)]
[GN:dppC] [OR:*Bacillus siibtilis*] [DB:genpept-bct1] [DE:*Bacillus subtilis*
complete genome (section 7 of 21):from 1194391 to 1411140.] [NT:alternate
gene name:dciAC] [LE:167250] [RE:168212] [DI:direct]

| ORF Name | NT ID | AA ID | NT LN | AA LN | Score | P-Value |
| --- | --- | --- | --- | --- | --- | --- |
| AI7503000991__22272583__f3__291 | 1973 | 5745 | 123 | 40 | 86 | 0.0040 |

Description
gp:[GI:g4098413] [LN:LOU77495] [AC:U77495] [PN:putative integrase] [GN:int]
[OR:*Leuconostoc oenos* bacteriophage 10MC] [DB:genpept-phg] [DE:*Leuconostoc
oenos* bacteriophage 10MC putative integrase (int) gene, complete cds.]
[NT:site-specific recombinase] [LE:119] [RE:1165] [DI:direct]

| ORF Name | NT ID | AA ID | NT LN | AA LN | Score | P-Value |
| --- | --- | --- | --- | --- | --- | --- |
| AI7503000991__22456512__f3__286 | 1974 | 5746 | 147 | 48 | | |

Description
NO-HIT

| ORF Name | NT ID | AA ID | NT LN | AA LN | Score | P-Value |
| --- | --- | --- | --- | --- | --- | --- |
| AI7503000991__22462787__c1__392 | 1975 | 5747 | 525 | 174 | 535 | 1.5e−51 |

Description
sp:[LN:LEPH_STAAU] [AC:P72364] [GN:SPSA] [OR:*STAPHYLOCOCCUS AUREUS*]
[DE:INACTIVE SIGNAL PEPTIDASE IA] [SP:P72364] [DB:swissprot]
>gp:[GI:g1595809] [LN:SAU65000] [AC:U65000] [PN:type-I signal peptidase
SpsA] [GN:spsA] [OR:*Staphylococcus aureus*] [DB:genpept-bct2]
[DE:*Staphylococcus aureus* type-I signal peptidase SpsA (spsA) gene,
and type-I signal peptidase SpsB (spsB) gene, complete cds.] [NT:inactive
signal peptidase homologue; protein lacks] [LE:40] [RE:564] [DI:direct]

| ORF Name | NT ID | AA ID | NT LN | AA LN | Score | P-Value |
| --- | --- | --- | --- | --- | --- | --- |
| AI7503000991__22665887__c3__598 | 1976 | 5748 | 129 | 42 | 120 | 2.4e−07 |

Description
pir:[LN:D69838] [AC:D69838] [PN:conserved hypothetical protein yisU]
[GN:yisU] [OR:*Bacillus subtilis*] [DB:pir2] >gp:[GI:e1183088:g2633422]
[LN:BSUB0006] [AC:Z99109:AL009126] [GN:yisU] [FN:unknown] [OR:*Bacillus
subtilis*] [DB:genpept-bct1] [DE:*Bacillus subtilis* complete genome (section 6
of 21):from 999501 to 1209940.] [NT:similar to hypothetical proteins]
[LE:165981] [RE:166643] [DI:complement] >gp:[GI:e1173520:g2145387]
[LN:BSY09476] [AC:Y09476] [PN:YisU] [OR:*Bacillus subtilis*] [DB:genpept-bct1]
[DE:*B. subtilis* 54 kb genomic DNA fragment.] [NT:putative] [LE:23207]
[RE:23869] [DI:complement]

| ORF Name | NT ID | AA ID | NT LN | AA LN | Score | P-Value |
| --- | --- | --- | --- | --- | --- | --- |
| AI7503000991__22703588__f2__137 | 1977 | 5749 | 954 | 317 | 803 | 6.0e−80 |

Description
sp:[LN:MENA_BACSU] [AC:P39582] [GN:MENA:IPA-6D] [OR:*BACILLUS SUBTILIS*]
[EC:2.5.1.—] [DE:(DHNA-OCTAPRENYLTRANSFERASE)] [SP:P39582] [DB:swissprot]
>pir:[LN:S39661] [AC:S39661:B70050] [PN:menaquinone biosynthesis protein
homolog ywaB:protein ipa-6d] [GN:ywaB] [CL:quinone biosynthesis homolog
ywaB] [OR:*Bacillus subtilis*] [DB:pir2] >gp:[GI:g413930] [LN:BSGENR]
[AC:X73124] [GN:ipa-6d] [OR:*Bacillus subtilis*] [DB:genpept-bct1]
[DE:*B. subtilis* genomic region (325 to 333).] [SP:P39582] [LE:5904] [RE:6839]
[DI:direct] >gp:[GI:e1186348:g2636384] [LN:BSUB0020] [AC:Z99123:AL009126]
[GN:ywaB] [FN:unknown] [OR:*Bacillus subtilis*] [DB:genpept-bct1] [DE:*Bacillus
subtilis* complete genome (section 20 of 21):from 3798401 to 4010550.]
[NT:alternate gene name:ipa-6d; similar to quinone] [SP:P39582] [LE:151120]
[RE:152055] [DI:complement]

| ORF Name | NT ID | AA ID | NT LN | AA LN | Score | P-Value |
| --- | --- | --- | --- | --- | --- | --- |
| AI7503000991__23438827__c3__566 | 1978 | 5750 | 129 | 42 | | |

Description
NO-HIT

-continued

| ORF Name | NT ID | AA ID | NT LN | AA LN | Score | P-Value |
|---|---|---|---|---|---|---|
| AI7503000991_23535910_c1_391 | 1979 | 5751 | 603 | 200 | 499 | 9.8e−48 |

Description
gp:[GI:g4185300] [LN:AF089862] [AC:AF089862] [PN:unknown] [OR:*Staphylococcus carnosus*] [DB:genpept-bct2] [DE:*Staphylococcus carnosus* type-I signal peptidase SipA (sipA) and type-I signal peptidase SipB (sipB) genes, complete cds; and unknown gene.] [NT:Orf1; similar to *Bacillus subtilis* yhjE] [LE:271] [RE:948] [DI:direct]

| ORF Name | NT ID | AA ID | NT LN | AA LN | Score | P-Value |
|---|---|---|---|---|---|---|
| AI7503000991_23593932_f2_166 | 1980 | 5752 | 126 | 41 | | |

Description
NO-HIT

| ORF Name | NT ID | AA ID | NT LN | AA LN | Score | P-Value |
|---|---|---|---|---|---|---|
| AI7503000991_23611563_c3_600 | 1981 | 5753 | 141 | 46 | | |

Description
NO-HIT

| ORF Name | NT ID | AA ID | NT LN | AA LN | Score | P-Value |
|---|---|---|---|---|---|---|
| AI7503000991_23625637_c2_526 | 1982 | 5754 | 183 | 60 | | |

Description
NO-HIT

| ORF Name | NT ID | AA ID | NT LN | AA LN | Score | P-Value |
|---|---|---|---|---|---|---|
| AI7503000991_23634641_c1_398 | 1983 | 5755 | 1248 | 415 | 1475 | 3.7e−151 |

Description
pir:[LN:G69842] [AC:G69842] [PN:3-oxoacyl-[acyl-carrier-protein] synthase,] [GN:yjaY] [CL:3-oxoacyl-[acyl-carrier-protein] synthase I: 3-oxoacyl-[acyl-carrier-protein] synthase I homology] [OR:*Bacillus subtilis*] [EC:2.3.1.41] [DB:pir2] >gp:[GI:e1183137:g2633471] [LN:BSUB0006] [AC:Z99109:AL009126] [GN:yjaY] [FN:unknown] [OR:*Bacillus subtilis*] [DB:genpept-bct1] [DE:*Bacillus subtilis* complete genome (section 6 of 21): from 999501 to 1209940.] [NT:similar to 3-oxoacyl- acyl-carrier protein] [LE:209150] [RE:210391] [DI:direct] >gp:[GI:e1183154:g2633488] [LN:BSUB0007] [AC:Z99110:AL009126] [GN:yjaY] [FN:unknown] [OR:*Bacillus subtilis*] [DB:genpept-bct1] [DE:*Bacillus subtilis* complete genome (section 7 of 21): from 1194391 to 1411140.] [NT:similar to 3-oxoacyl- acyl-carrier protein] [LE:14260] [RE:15501] [DI:direct]

| ORF Name | NT ID | AA ID | NT LN | AA LN | Score | P-Value |
|---|---|---|---|---|---|---|
| AI7503000991_23678800_c3_561 | 1984 | 5756 | 399 | 132 | 395 | 1.0e−36 |

Description
pir:[LN:H69841] [AC:H69841] [PN:conserved hypothetical protein yitW] [GN:yitW] [CL:conserved hypothetical protein MJ1129] [OR:*Bacillus subtilis*] [DB:pir2] >gp:[GI:e261991:g1620928] [LN:BS168NPRB] [AC:Z79580] [GN:putative orf] [FN:unknown] [OR:*Bacillus subtilis*] [DB:genpept-bct1] [DE:*B. subtilis* nprB gene.] [LE:6256] [RE:6564] [DI:direct] >gp:[GI:e1183118:g2633452] [LN:BSUB0006] [AC:Z99109:AL009126] [GN:yitW] [FN:unknown] [OR:*Bacillus subtilis*] [DB:genpept-bct1] [DE:*Bacillus subtilis* complete genome (section 6 of 21):from 999501 to 1209940.] [NT:similar to hypothetical proteins] [LE:192227] [RE:192535] [DI:direct] >gp:[GI:e1173550:g2145417] [LN:BSY09476] [AC:Y09476] [PN:YitW] [OR:*Bacillus subtilis*] [DB:genpept-bct1] [DE:*B. subtilis* 54 kb genomic DNA fragment.] [NT:putative orf] [LE:49453] [RE:49761] [DI:direct]

| ORF Name | NT ID | AA ID | NT LN | AA LN | Score | P-Value |
|---|---|---|---|---|---|---|
| AI7503000991_2392300_f2_176 | 1985 | 5757 | 138 | 45 | | |

Description
NO-HIT

| ORF Name | NT ID | AA ID | NT LN | AA LN | Score | P-Value |
|---|---|---|---|---|---|---|
| AI7503000991_24022191_f2_232 | 1986 | 5758 | 222 | 73 | 97 | 3.9e−05 |

-continued

Description
pir:[LN:G69854] [AC:G69854] [PN:hypothetical protein yjzD] [GN:yjzD]
[OR:*Bacillus subtilis*] [DB:pir2] >gp:[GI:e1183130:g2633464] [LN:BSUB0006]
[AC:Z99109:AL009126] [GN:yjzD] [FN:unknown] [OR:*Bacillus subtilis*]
[DB:genpept-bct1] [DE:*Bacillus subtilis* complete genome (section 6 of 21):
from 999501 to 1209940.] [LE:204697] [RE:204882] [DI:complement]
>gp:[GI:e1183147:g2633481] [LN:BSUB0007] [AC:Z99110:AL009126] [GN:yjzD]
[FN:unknown] [OR:*Bacillus subtilis*] [DB:genpept-bct1] [DE:*Bacillus subtilis*
complete genome (section 7 of 21):from 1194391 to 1411140.] [LE:9807]
[RE:9992] [DI:complement] >gp:[GI:d1023798:g2564027] [LN:D86376] [AC:D86376]
[OR:*Bacillus subtilis*] [SR:*Bacillus subtilis* (strain:CU741) DNA]
[DB:genpept-bct1] [DE:*Bacillus subtilis* ArgF and med genes, partial and
complete cds.] [NT:unnamed protein product] [LE:1027] [RE:1212]
[DI:complement]

| ORF Name | NT ID | AA ID | NT LN | AA LN | Score | P-Value |
| --- | --- | --- | --- | --- | --- | --- |
| AI7503000991__24024142__c2__496 | 1987 | 5759 | 315 | 104 | 93 | 0.00010 |

Description
gp:[GI:g2654481] [LN:BFU89914] [AC:U89914] [PN:hypothetical 10.1 kDa
protein] [OR:*Bacillus firmus*] [DB:genpept-bct2] [DE:*Bacillus firmus*
hypothetical 34.0 kDa protein, hypothetical 8.9 kDa protein, hypothetical
10.1 kDa protein, hypothetical 21.0 kDa protein, putative thiosulfate
sulfur transferase, hypothetical 16.1 kDa transcriptional regulator and
hypothetical 18.2 kDa protein genes, complete cds, and Na+/H+ antiporter
homolog gene, partial cds.] [NT:orf4] [LE:1601] [RE:1882] [DI:direct]

| ORF Name | NT ID | AA ID | NT LN | AA LN | Score | P-Value |
| --- | --- | --- | --- | --- | --- | --- |
| AI7503000991__24070137__c3__602 | 1988 | 5760 | 150 | 49 | | |

Description
NO-HIT

| ORF Name | NT ID | AA ID | NT LN | AA LN | Score | P-Value |
| --- | --- | --- | --- | --- | --- | --- |
| AI7503000991__24105342__c1__448 | 1989 | 5761 | 831 | 276 | 1242 | 1.8e−126 |

Description
pir:[LN:F69656] [AC:F69656:A42715:S27512] [PN:naphthoate synthase,
menB:DHNA synthase:dihydroxynaphthoate synthase:dihydroxynapthoic acid
synthetase menB:menaquinone biosynthesis enzyme/enoyl CoA hydratase homolog]
[GN:menB] [CL:naphthoate synthase:enoyl-CoA hydratase homology]
[OR:*Bacillus subtilis*] [EC:4.1.3.36] [DB:pir2] >gp:[GI:e1185953:g2635564]
[LN:BSUB0016] [AC:Z99119:AL009126] [PN:dihydroxynapthoic acid synthetase]
[GN:menB] [FN:menaquinone biosynthesis] [OR:*Bacillus subtilis*]
[DB:genpept-bct1] [EC:4.1.3.36] [DE:*Bacillus subtilis* complete genome
(section 16 of 21):from 2997771 to 3213410.] [LE:150211] [RE:151026]
[DI:complement] >gp:[GI:g2293148] [LN:AF008220] [AC:AF008220]
[PN:dihydroxynaphthoate synthase] [GN:menB] [OR:*Bacillus subtilis*]
[DB:genpept-bct2] [DE:*Bacillus subtilis* rrnB-dnaB genomic region.]
[LE:29401] [RE:30216] [DI:direct]

| ORF Name | NT ID | AA ID | NT LN | AA LN | Score | P-Value |
| --- | --- | --- | --- | --- | --- | --- |
| AI7503000991__24225010__c2__536 | 1990 | 5762 | 168 | 55 | | |

Description
NO-HIT

| AI7503000991__24270451__c1__432 | 1991 | 5763 | 135 | 44 | | |

Description
NO-HIT

| ORF Name | NT ID | AA ID | NT LN | AA LN | Score | P-Value |
| --- | --- | --- | --- | --- | --- | --- |
| AI7503000991__24409428__c1__438 | 1992 | 5764 | 258 | 85 | 357 | 1.1e−32 |

Description
gp:[GI:g1731452] [LN:SAU38429] [AC:U38429] [PN:recombination protein]
[GN:pre] [OR:*Staphylococcus aureus*] [DB:genpept-bct1] [DE:*Staphylococcus
aureus* chloramphenicol resistance plasmid pKH7, complete sequence.] [LE:2074]
[RE:3285] [DI:direct]

-continued

| ORF Name | NT ID | AA ID | NT LN | AA LN | Score | P-Value |
|---|---|---|---|---|---|---|
| AI7503000991__24412517__c3__581 | 1993 | 5765 | 393 | 130 | 213 | 1.2e−16 |

Description
sp:[LN:G6PD_BACSU] [AC:P54547] [GN:ZWF] [OR:*BACILLUS SUBTILIS*] [EC:1.1.1.49]
[DE:PROTEIN 11) (VEG11)] [SP:P54547] [DB:swissprot] >pir:[LN:B69964]
[AC:B69964] [PN:probable glucose-6-phosphate 1-dehydrogenase, yqjJ]
[GN:yqjJ] [CL:glucose-6-phosphate dehydrogenase] [OR:*Bacillus subtilis*]
[EC:1.1.1.49] [DB:pir2] >gp:[GI:d1013296:g1303961] [LN:BACJH642]
[AC:D84432:D82370] [PN:YqjJ] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:239025] [RE:240494]
[DI:complement] >gp:[GI:e1185654:g2634820] [LN:BSUB0013]
[AC:Z99116:AL009126] [GN:yqjJ] [FN:unknown] [OR:*Bacillus subtilis*]
[DB:genpept-bct1] [DE:*Bacillus subtilis* complete genome (section 13 of 21):
from 2395261 to 2613730.] [NT:similar to glucose-S-phosphate 1-dehydrogenase]
[SP:P54547] [LE:83125] [RE:84594] [DI:direct]

| ORF Name | NT ID | AA ID | NT LN | AA LN | Score | P-Value |
|---|---|---|---|---|---|---|
| AI7503000991__24415632__c1__393 | 1994 | 5766 | 579 | 192 | 827 | 1.7e−82 |

Description
sp:[LN:LEP_STAAU] [AC:P72365] GN:SPSB] [OR:*STAPHYLOCOCCUS AUREUS*]
[EC:3.4.21.89] [DE:SIGNAL PEPTIDASE IB, (SPASE IB) [LEADER PEPTIDASE IB)]
[SP:P72365] [DB:swissprot] >gp:[GI:g1595810] [LN:SAU65000] [AC:U65000]
[PN:type-I signal peptidase SpsB] [GN:spsB] [OR:*Staphylococcus aureus*]
[DB:genpept-bct2] [DE:*Staphylococcus aureus* type-I signal peptidase SpsA
(spsA) gene, and type-I signal peptidase SpsB (spsB) gene, complete cds.]
[NT:signal peptidase, leader peptidase, serine] [LE:580] [RE:1155]
[DI:direct]

| ORF Name | NT ID | AA ID | NT LN | AA LN | Score | P-Value |
|---|---|---|---|---|---|---|
| AI7503000991__24416702__f2__125 | 1995 | 5767 | 4008 | 1335 | 7001 | 0.0 |

Description
gp:[GI:g2267242] [LN:SEU71377] [AC:U71377] [PN:autolysin AtlE]
[OR:*Staphylococcus epidermidis*] [DB:genpept-bct1] [DE:*Staphylococcus
epidermidis* autolysin AtlE and putative transcriptional regulator AtlR genes,
complete cds.] [NT:primary attachment to a polystyrene surface] [LE:2620]
[RE:6627] [DI:direct]

| ORF Name | NT ID | AA ID | NT LN | AA LN | Score | P-Value |
|---|---|---|---|---|---|---|
| AI7503000991__24428543__f3__297 | 1996 | 5768 | 174 | 57 | 72 | 0.017 |

Description
gp:[GI:g153715] [LN:STRMLIKEE] [AC:L05021] [PN:M-like protein]
[OR:*Streptococcus pyogenes*] [SR:*Streptococcus pyogenes* DNA]
[DB:genpept-bct1] [DE:*Streptococcus pyogenes* M-like protein gene, partial
cds.] [LE:<1] [RE:>243] [DI:direct]

| ORF Name | NT ID | AA ID | NT LN | AA LN | Score | P-Value |
|---|---|---|---|---|---|---|
| AI7503000991__24475252__f3__289 | 1997 | 5769 | 159 | 52 | | |

Description
NO-HIT

| AI7503000991__24646886__c3__594 | 1998 | 5770 | 1557 | 518 | 296 | 2.0e−23 |

Description
pir:[LN:B71973] [AC:B71973] [PN:2',3'-cyclic-nucleotide
2'-phosphodiesterase] [GN:cpdB] [CL:2',3'-cyclic-nucleotide
2'-phosphodiesterase:2',3'-cyclic-nucleotide 2'-phosphodiesterase
homology:phosphoesterase core homology] [OR:*Helicobacter pylori*] [SR:strain
J99, , strain J99] [SR:strain J99,] [DB:pir2] >gp:[GI:g4154615]
[LN:AE001449] [AC:AE001449:AE001439] [PN:2',3'-CYCLIC-NUCLEOTIDE
2'-PHOSPHODIESTERASE] [GN:cpdB] [OR:*Helicobacter pylori* J99]
[DB:genpept-bct2] [DE:*Helicobacter pylori*, strain J99 section 10 of 132 of
the complete genome.] [NT:similar to *H. pylori* 26695 gene HP0104] [LE:139]
[RE:1884] [DI:complement]

| ORF Name | NT ID | AA ID | NT LN | AA LN | Score | P-Value |
|---|---|---|---|---|---|---|
| AI7503000991__24648412__c1__406 | 1999 | 5771 | 642 | 213 | 683 | 3.1e−67 |

-continued

Description
pir:[LN:E69844] [AC:E69844] [PN:GTP pyrophosphokinase homolog yjbM]
[GN:yjbM] [CL:GTP pyrophosphokinase related protein] [OR:*Bacillus subtilis*]
[DB:pir2] >gp:[GI:e1183180:g2633514] [LN:BSUB0007] [AC:Z99110:AL009126]
[GN:yjbM] [FN:unknown] [OR:*Bacillus subtilis*] [DB:genpept-bct1] [DE:*Bacillus
subtilis* complete genome (section 7 of 21):from 1194391 to 1411140.]
[NT:similar to GTP pyrophosphokinase] [LE:42087] [RE:42722] [DI:direct]

| ORF Name | NT ID | AA ID | NT LN | AA LN | Score | P-Value |
|---|---|---|---|---|---|---|
| AI7503000991_24745437_c3_539 | 2000 | 5772 | 1263 | 420 | 1659 | 1.2e−170 |

Description
sp:[LN:YPCA_BACSU] [AC:P50735] [GN:YPCA] [OR:*BACILLUS SUBTILIS*] [EC:1.4.1.—]
[DE:(EC 1.4.1.—)] [SP:P50735] [DB:swissprot] >pir:[LN:G69933] [AC:G69933]
[PN:glutamate dehydrogenase homolog ypcA] [GN:ypcA] [CL:glutamate
dehydrogenase (NAD(P)+)] [OR:*Bacillus subtilis*] [DB:pir2]
>gp:[GI:e1183741:g2634714] [LN:BSUB0012] [AC:Z99115:AL009126] [GN:ypcA]
[FN:unknown] [OR:*Bacillus subtilis*] [DB:genpept-bct1] [DE:*Bacillus subtilis*
complete genome (section 12 of 21):from 2195541 to 2409220.] [NT:similar to
glutamate dehydrogenase] [SP:P50735] [LE:205764] [RE:207044] [DI:complement]
>gp:[GI:e1185565:g2634731] [LN:BSUB0013] [AC:Z99116:AL009126] [GN:ypcA]
[FN:unknown] [OR:*Bacillus subtilis*] [DB:genpept-bct1] [DE:*Bacillus subtilis*
complete genome (section 13 of 21):from 2395261 to 2613730.] [NT:similar to
glutamate dehydrogenase] [SP:P50735] [LE:6044] [RE:7324] [DI:complement]
>gp:[GI:g1146206] [LN:BACSERA] [AC:L47648] [PN:glutamate dehydrogenase]
[GN:ypcA] [OR:*Bacillus subtilis*] [DB:genpept-bct2] [DE:*Bacillus subtilis*
phosphoglycerate dehydrogenase (serA), ypaA, ferredoxin (fer), ypbB, recS,
ypbD, ypbE, ypbF, ypbG, ypbH, glutamate dehydrogenase (ypcA), ypdA, ypdB,
ypdC, spore cortexlytic enzyme (sleB), ypeB, ypfA, ypfB, cytidine
monophosphatekinase (cmk), ypfD, ypgA, yphA, yphB, yphC, NAD+
dependent glycerol-3-phosphate dehydrogenase (glyc), yphE and yphF
genes, complete cds.] [NT:similar to *Clostridium difficile* glutamate]
[LE:9353] [RE:10633] [DI:direct]

| ORF Name | NT ID | AA ID | NT LN | AA LN | Score | P-Value |
|---|---|---|---|---|---|---|
| AI7503000991_24804677_c3_597 | 2001 | 5773 | 366 | 121 | 117 | 1.5e−06 |

Description
gp:[GI:g2541936] [LN:PSU27310] [AC:U27310] [PN:unknown] [OR:*Pseudomonas
syringae*] [DB:genpept-bct2] [DE:*Pseudomonas syringae* phaseolotoxin gene
cluster, complete sequence.] [NT:ORF6; similar to *Pseudomonas syringae* fatty
acid] [LE:5079] [RE:6062] [DI:direct]

| ORF Name | NT ID | AA ID | NT LN | AA LN | Score | P-Value |
|---|---|---|---|---|---|---|
| AI7503000991_25392826_f2_175 | 2002 | 5774 | 1146 | 381 | 557 | 7.0e−54 |

Description
pir:[LN:G70007] [AC:G70007] [PN:conserved hypothetical protein yueF]
[GN:yueF] [CL:*Bacillus subtilis* conserved hypothetical protein yueF]
[OR:*Bacillus subtilis*] [DB:pir2] >gp:[GI:e1184257:g2635675] [LN:BSUB0017]
[AC:Z99120:AL009126] [GN:yueF] [FN:unknown] [OR:*Bacillus subtilis*]
[DB:genpept-bct1] [DE:*Bacillus subtilis* complete genome (section 17 of 21):
from 3197001 to 3414420.] [NT:similar to hypothetical proteins] [LE:64687]
[RE:65796] [DI:complement]

| ORF Name | NT ID | AA ID | NT LN | AA LN | Score | P-Value |
|---|---|---|---|---|---|---|
| AI7503000991_25429512_c3_593 | 2003 | 5775 | 1392 | 463 | 1130 | 1.3e−114 |

Description
pir:[LN:H69862] [AC:H69862] [PN:Na+-transporting ATP synthase homolog ykrM]
[GN:ykrM] [CL:Na+-ATP synthase chain J] [OR:*Bacillus subtilis*] [DB:pir2]
>gp:[GI:e1184940:g2633721] [LN:BSUB0008] [AC:Z99111:AL009126] [GN:ykrM]
[FN:unknown] [OR:*Bacillus subtilis*] [DB:genpept-bct1] [DE:*Bacillus subtilis*
complete genome (section 8 of 21):from 1394791 to 1603020.] [NT:similar to
Na+-transporting ATP synthase] [LE:20743] [RE:22092] [DI:direct]

| ORF Name | NT ID | AA ID | NT LN | AA LN | Score | P-Value |
|---|---|---|---|---|---|---|
| AI7503000991_25430316_c2_522 | 2004 | 5776 | 171 | 56 | 171 | 5.6e−13 |

Description
pir:[LN:QQSA8T] [AC:A04493] [PN:hypothetical protein B-189]
[OR:*Staphylococcus aureus*] [DB:pir1]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000991__26178400__c3__542 | 2005 | 5777 | 186 | 61 | 71 | 0.042 |

Description
sp:[LN:AOPP_HUMAN] [AC:P30044] [OR:*HOMO SAPIENS*] [SR:,HUMAN] [DE:71B)]
[SP:P30044] [DB:swissprot]

| ORF Name | NT ID | AA ID | NT LN | AA LN | Score | P-Value |
|---|---|---|---|---|---|---|
| AI7503000991__26212787__f3__335 | 2006 | 5778 | 612 | 203 | 308 | 1.7e−27 |

Description
pir:[LN:C69844] [AC:C69844] [PN:hypothetical protein yjbK] [GN:yjbK]
[OR:*Bacillus subtilis*] [DB:pir2] >gp:[GI:e1183178:g2633512] [LN:BSUB0007]
[AC:Z99110:AL009126] [GN:yjbK] [FN:unknown] [OR:*Bacillus subtilis*]
[DB:genpept-bct1] [DE:*Bacillus subtilis* complete genome (section 7 of 21):
from 1194391 to 1411140.] [LE:40993] [RE:41565] [DI:complement]

| ORF Name | NT ID | AA ID | NT LN | AA LN | Score | P-Value |
|---|---|---|---|---|---|---|
| AI7503000991__26377340__c2__488 | 2007 | 5779 | 999 | 332 | 208 | 4.6e−15 |

Description
gp:[GI:e257629:g1771202] [LN:LLLVSFPEP] [AC:X99710] [PN:transcription
factor] [OR:*Lactococcus lactis*] [DB:genpept-bct1] [DE:*L. lactis* ORF, genes
homologous to vsf-1 and pepF2 and gene encoding protein homologous to
methyltransferase.] [NT:weak homology with vsf-1 gene (X73635)] [LE:934]
[RE:1917] [DI:direct]

| ORF Name | NT ID | AA ID | NT LN | AA LN | Score | P-Value |
|---|---|---|---|---|---|---|
| AI7503000991__26564012__c2__477 | 2008 | 5780 | 2616 | 871 | 2649 | 1.5e−275 |

Description
gp:[GI:g3150046] [LN:AF016634] [AC:AF016634] [PN:ClpB chaperone homolog]
[GN:clpB] [OR:*Lactococcus lactis* subsp. *cremoris*] [DB:genpept-bct2]
[DE:*Lactococcus lactis cremoris* ClpB chaperone homolog (clpB)
and phosphoribosylformylglycinamide cyclo-ligase (pur5) genes, complete cds;
and phosphoribosylglycinamide formyltransferase (pur3) gene, partial cds.]
[LE:183] [RE:2786] [DI:direct]

| ORF Name | NT ID | AA ID | NT LN | AA LN | Score | P-Value |
|---|---|---|---|---|---|---|
| AI7503000991__26567557__c3__558 | 2009 | 5781 | 138 | 45 | | |

Description
NO-HIT

| ORF Name | NT ID | AA ID | NT LN | AA LN | Score | P-Value |
|---|---|---|---|---|---|---|
| AI7503000991__26604662__c2__495 | 2010 | 5782 | 630 | 209 | | |

Description
NO-HIT

| ORF Name | NT ID | AA ID | NT LN | AA LN | Score | P-Value |
|---|---|---|---|---|---|---|
| AI7503000991__26775637__c1__447 | 2011 | 5783 | 1389 | 462 | 599 | 2.5e−58 |

Description
sp:[LN:MENF_BACSU] [AC:P23973:P23972] [GN:MENF:ICSM] [OR:*BACILLUS SUBTILIS*]
[EC:5.4.99.6] [DE:MENAQUINONE-SPECIFIC ISOCHORISMATE SYNTHASE,]
[SP:P23973:P23972] [DB:swissprot] >pir:[LN:A69657]
[AC:A69657:S27507:S27508:I39883] [PN:probable isochorismate synthase,
menaquinone-specific menF] [GN:menF] [CL:isochorismate synthase]
[OR:*Bacillus subtilis*] [EC:5.4.99.6] [DB:pir2] >gp:[GI:e1185956:g2635567]
[LN:BSUB0016] [AC:Z99119:AL009126] [PN:menaquinone-specific isochorismate
synthase] [GN:menF] [FN:menaquinone biosynthesis] [OR:*Bacillus subtilis*]
[DB:genpept-bct1] [EC:5.4.99.6] [DE:*Bacillus subtilis* complete genome
(section 16 of 21):from 2997771 to 3213410.] [NT:alternate gene name:icsM,
entC] [SP:P23973] [LE:153612] [RE:155027] [DI:complement] >gp:[GI:g2293145]
[LN:AF008220] [AC:AF008220] [PN:isochorismate synthase] [GN:menF]
[OR:*Bacillus subtilis*] [DB:genpept-bct2] [DE:*Bacillus subtilis* rrnB-dnaB
genomic region.] [LE:25400] [RE:26815] [DI:direct] >gp:[GI:g1185288]
[LN:BACMENAQOP] [AC:M74538:M74182:M74183] [PN:isochorismate synthase]
[GN:menF] [OR:*Bacillus subtilis*] [SR:*Bacillus subtilis* (strain RB1) DNA]
[DB:genpept-bct2] [DE:*Bacillus subtilis* menaquinone operon:menF, menD, menB
and menE genes, complete cds.] [NT:based on similarity to *E. coli* EntC, *A.
hydrophila*] [LE:143] [RE:1558] [DI:direct]

-continued

| ORF Name | NT ID | AA ID | NT LN | AA LN | Score | P-Value |
|---|---|---|---|---|---|---|
| AI7503000991__2848308__c3__607 | 2012 | 5784 | 135 | 44 | | |

Description
NO-HIT

| ORF Name | NT ID | AA ID | NT LN | AA LN | Score | P-Value |
|---|---|---|---|---|---|---|
| AI7503000991__289802__f2__227 | 2013 | 5785 | 189 | 62 | 89 | 0.0019 |

Description
pir:[LN:F22845] [AC:F22845] [PN:hypothetical protein 6] [OR:mitochondrion *Trypanosoma brucei*] [DB:pir2]

| ORF Name | NT ID | AA ID | NT LN | AA LN | Score | P-Value |
|---|---|---|---|---|---|---|
| AI7503000991__2922260__c3__574 | 2014 | 5786 | 384 | 127 | 174 | 2.7e−13 |

Description
pir:[LN:D69844] [AC:D69844] [PN:hypothetical protein yjbL] [GN:yjbL]
[OR:*Bacillus subtilis*] [DB:pir2] >gp:[GI:e1183179:g2633513] [LN:BSUB0007]
[AC:Z99110:AL009126] [GN:yjbL] [FN:unknown] [OR:*Bacillus subtilis*]
[DB:genpept-bct1] [DE:*Bacillus subtilis* complete genome (section 7 of 21):
from 1194391 to 1411140.] [LE:41690] [RE:42058] [DI:direct]

| ORF Name | NT ID | AA ID | NT LN | AA LN | Score | P-Value |
|---|---|---|---|---|---|---|
| AI7503000991__29335888__c3__562 | 2015 | 5787 | 135 | 44 | | |

Description
NO-HIT

| ORF Name | NT ID | AA ID | NT LN | AA LN | Score | P-Value |
|---|---|---|---|---|---|---|
| AI7503000991__29570302__f1__24 | 2016 | 5788 | 132 | 43 | | |

Description
NO-HIT

| ORF Name | NT ID | AA ID | NT LN | AA LN | Score | P-Value |
|---|---|---|---|---|---|---|
| AI7503000991__31281253__c3__538 | 2017 | 5789 | 1221 | 406 | 1513 | 3.5e−155 |

Description
sp:[LN:OAT_BACSU] [AC:P38021] [GN:ROCD] [OR:*BACILLUS SUBTILIS*] [EC:2.6.1.13]
[DE:AMINOTRANSFERASE)] [SP:P38021] [DB:swissprot] >pir:[LN:S55793]
[AC:S55793:S49267:B53370:H69693] [PN:ornithine--oxo-acid transaminase,
rocD:ornithine aminotransferase:ornithine--oxo-acid aminotransferase]
[GN:rocD] [CL:ornithine--oxo-acid aminotransferase] [OR:*Bacillus subtilis*]
[EC:2.6.1.13] [DB:pir2] >gp:[GI:d1011955:g1064807] [LN:BACGNTZA] [AC:D78193]
[PN:orthinine aminotransferase] [GN:rocD] [OR:*Bacillus subtilis*]
[SR:*Bacillus subtilis* (strain:168) DNA] [DB:genpept-bct1] [DE:*Bacillus
subtilis* 36 kb sequence between gntZ and trnY genes encoding 34 ORFs.]
[LE:25845] [RE:27050] [DI:complement] >gp:[GI:g550311] [LN:BSROCDEF]
[AC:X81802] [PN:ornithine< aminotransferase] [GN:rocD] [OR:*Bacillus
subtilis*] [DB:genpept-bct1] [DE:*B. subtilis* rocD, rocE and rocF genes.]
[SP:P38021] [LE:241] [RE:1446] [DI:direct] >gp:[GI:e1184760:g2636581]
[LN:BSUB0021] [AC:Z99124:AL009126] [PN:ornithine aminotransferase] [GN:rocD]
[FN:arginine and ornithine utilization] [OR:*Bacillus subtilis*]
[DB:genpept-bct1] [EC:2.6.1.13] [DE:*Bacillus subtilis* complete genome
(section 21 of 21):from 3999281 to 4214814.] [SP:P38021] [LE:144229]
[RE:145434] [DI:complement]

| ORF Name | NT ID | AA ID | NT LN | AA LN | Score | P-Value |
|---|---|---|---|---|---|---|
| AI7503000991__31300807__c1__436 | 2018 | 5790 | 156 | 51 | | |

Description
NO-HIT

| ORF Name | NT ID | AA ID | NT LN | AA LN | Score | P-Value |
|---|---|---|---|---|---|---|
| AI7503000991__31525260__c3__579 | 2019 | 5791 | 135 | 44 | | |

Description
NO-HIT

-continued

| ORF Name | NT ID | AA ID | NT LN | AA LN | Score | P-Value |
|---|---|---|---|---|---|---|
| AI7503000991_32062875_c1_439 | 2020 | 5792 | 291 | 96 | 333 | 3.8e−30 |

Description
gp:[GI:g1731452] [LN:SAU38429] [AC:U38429] [PN:recombination protein]
[GN:pre] [OR:*Staphylococcus aureus*] [DB:genpept-bct1] [DE:*Staphylococcus aureus* chloramphenicol resistance plasmid pKH7, complete sequence.] [LE:2074]
[RE:3285] [DI:direct]

| ORF Name | NT ID | AA ID | NT LN | AA LN | Score | P-Value |
|---|---|---|---|---|---|---|
| AI7503000991_32067937_f2_247 | 2021 | 5793 | 1365 | 454 | 1790 | 1.5e−184 |

Description
gp:[GI:g2792490] [LN:AF041467] [AC:AF041467] [PN:coenzyme A disulfide reductase] [FN:pyridine nucleotide disulfide oxidoreductase]
[OR:*Staphylococcus aureus*] [DB:genpept-bct2] [DE:*Staphylococcus aureus* coenzyme A disulfide reductase gene, complete cds.] [NT:CoADR; flavoenzyme (FAD); single catalytic cysteine] [LE:66] [RE:1382] [DI:direct]

| ORF Name | NT ID | AA ID | NT LN | AA LN | Score | P-Value |
|---|---|---|---|---|---|---|
| AI7503000991_32132183_c1_455 | 2022 | 5794 | 132 | 43 | | |

Description
NO-HIT

| ORF Name | NT ID | AA ID | NT LN | AA LN | Score | P-Value |
|---|---|---|---|---|---|---|
| AI7503000991_32457312_c2_501 | 2023 | 5795 | 495 | 164 | 233 | 1.5e−19 |

Description
gp:[GI:e303881:g1850807] [LN:CPCPEAA] [AC:X71844] [PN:putative transposase]
[OR:*Clostridium perfringens*] [DB:genpept-bct1] [DE:*C. perfringens* uapC, cpe, and nadC genes.] [LE:2477] [RE:2932] [DI:direct]

| ORF Name | NT ID | AA ID | NT LN | AA LN | Score | P-Value |
|---|---|---|---|---|---|---|
| AI7503000991_32635937_c1_429 | 2024 | 5796 | 1503 | 500 | 2239 | 4.1e−232 |

Description
gp:[GI:e1301684:g3256223] [LN:SAY14370] [AC:Y14370]
[PN:UDP-N-acetylmuramyl-tripeptide synthetase] [GN:murE] [OR:*Staphylococcus aureus*] [DB:genpept-bct1] [DE:*Staphylococcus aureus* RF3, murE, ypfP genes.]
[LE:3244] [RE:4722] [DI:complement]

| ORF Name | NT ID | AA ID | NT LN | AA LN | Score | P-Value |
|---|---|---|---|---|---|---|
| AI7503000991_33364067_c1_431 | 2025 | 5797 | 1782 | 593 | 542 | 2.7e−52 |

Description
gp:[GI:g2109443] [LN:SPDNAARG] [AC:AF000658] [PN:putative serine protease]
[GN:sphtra] [OR:*Streptococcus pneumoniae*] [DB genpept-bct2]
[DE:*Streptococcus pneumoniae* R801 tRNA-Arg gene, partial sequence, and putative serine protease (sphtra), SPSpoJ (spspoJ), initiator protein (spdnaa) and beta subunit of DNA polymerase III (spdnan) genes, complete cds.] [NT:SPHtra] [LE:765] [RE:1958] [DI:direct]

| ORF Name | NT ID | AA ID | NT LN | AA LN | Score | P-Value |
|---|---|---|---|---|---|---|
| AI7503000991_3371067_c2_482 | 2026 | 5798 | 954 | 317 | 1033 | 2.5e−104 |

Description
pir:[LN:E38447] [AC:E38447:S15234:C69669] [PN:oligopeptide transport
ATP-binding protein oppF:sporulation initiation protein spo0KE]
[GN:spo0KE:oppF] [CL:inner membrane protein malK:ATP-binding cassette homology] [OR:*Bacillus subtilis*] [DB:pir2] >gp:[GI:g143608] [LN:BACSPO0K]
[AC:M57689] [PN:sporulation protein] [GN:spo0KE] [OR:*Bacillus subtilis*]
[SR:*B. subtilis* (strain JH642) DNA, clones pDR20/21, pJL2/3 and pJL7]
[DB:genpept-bct1] [DE:*Bacillus subtilis* spo0K operon.] [LE:5152] [RE:6078]
[DI:direct]

| ORF Name | NT ID | AA ID | NT LN | AA LN | Score | P-Value |
|---|---|---|---|---|---|---|
| AI7503000991_33710968_f2_124 | 2027 | 5799 | 453 | 150 | 742 | 1.7e−73 |

Description
gp:[GI:g2267241] [LN:SEU71377] [AC:U71377] [OR:*Staphylococcus epidermidis*]

-continued

[DB:genpept-bct1] [DE:*Staphylococcus epidermidis* autolysin AtlE and putative transcriptional regulator AtlR genes, complete cds.] [NT:ORF3] [LE:1957] [RE:2379] [DI:direct]

| ORF Name | NT ID | AA ID | NT LN | AA LN | Score | P-Value |
|---|---|---|---|---|---|---|
| AI7503000991_3394540_f2_138 | 2028 | 5800 | 312 | 103 | | |

Description
NO-HIT

| ORF Name | NT ID | AA ID | NT LN | AA LN | Score | P-Value |
|---|---|---|---|---|---|---|
| AI7503000991_34006561_f3_312 | 2029 | 5801 | 150 | 49 | | |

Description
NO-HIT

| ORF Name | NT ID | AA ID | NT LN | AA LN | Score | P-Value |
|---|---|---|---|---|---|---|
| AI7503000991_34062930_c1_440 | 2030 | 5802 | 273 | 90 | 290 | 1.4e−25 |

Description
sp:[LN:PRE3_STAAU] [AC:P03864] [OR:*STAPHYLOCOCCUS AUREUS*] [DE:PLASMID RECOMBINATION ENZYME (MOBILIZATION PROTEIN)] [SP:P03864] [DB:swissprot] >gp:[GI:g151683] [LN:PT1CG] [AC:J01764:J01765] [OR:Plasmid pT181] [SR:Plasmid pT181 DNA from *Staphylococcus aureus*] [DB:genpept-bct1] [DE:Plasmid pT181, complete genome.] [NT:Pre protein (plasmid recombination)] [LE:2521] [RE:3762] [DI:direct]

| ORF Name | NT ID | AA ID | NT LN | AA LN | Score | P-Value |
|---|---|---|---|---|---|---|
| AI7503000991_34073552_c2_509 | 2031 | 5803 | 1545 | 514 | 2291 | 1.3e−237 |

Description
gp:[GI:e1301683:g3256222] [LN:SAY14370] [AC:Y14370] [PN:peptide chain release factor 3] [GN:RF3] [OR:*Staphylococcus aureus*] [DB:genpept-bct1] [DE:*Staphylococcus aureus* RF3, murE, ypfP genes.] [LE:1435] [RE:3000] [DI:complement]

| ORF Name | NT ID | AA ID | NT LN | AA LN | Score | P-Value |
|---|---|---|---|---|---|---|
| AI7503000991_34163562_f3_322 | 2032 | 5804 | 486 | 161 | 329 | 1.0e−29 |

Description
pir:[LN:D69583] [AC:D69583] [PN:alcohol dehydrogenase, adhB] [GN:adhB] [CL:alcohol dehydrogenase long-chain alcohol dehydrogenase homology] [OR:*Bacillus subtilis*] [EC:1.1.1.1] [DB:pir2] >gp:[GI:e209890:g2108273] [LN:BS233DEG] [AC:X92868:X79978] [PN:NAD alcohol dehydrogenase] [GN:adhB] [OR:*Bacillus subtilis*] [DB:genpept-bct1] [DE:*B. subtilis* 23.9 kb fragment from map position 233 degrees on the chromosome.] [LE:13725] [RE:14861] [DI:complement] >gp:[GI:e1183926:g2635142] [LN:BSUB0014] [AC:Z99117:AL009126] [PN:alcohol dehydrogenase] [GN:adhB] [OR:*Bacillus subtilis*] [DB:genpept-bct1] [DE:*Bacillus subtilis* complete genome (section 14 of 21):from 2599451 to 2812870.] [LE:153270] [RE:154406] [DI:direct]

| ORF Name | NT ID | AA ID | NT LN | AA LN | Score | P-Value |
|---|---|---|---|---|---|---|
| AI7503000991_34179031_f2_122 | 2033 | 5805 | 135 | 44 | | |

Description
NO-HIT

| ORF Name | NT ID | AA ID | NT LN | AA LN | Score | P-Value |
|---|---|---|---|---|---|---|
| AI7503000991_34398505_f3_354 | 2034 | 5806 | 222 | 73 | | |

Description
NO-HIT

| ORF Name | NT ID | AA ID | NT LN | AA LN | Score | P-Value |
|---|---|---|---|---|---|---|
| AI7503000991_34407888_c3_572 | 2035 | 5807 | 729 | 242 | 288 | 1.9e−37 |

Description
gp:[GI:g2952027] [LN:BFU88888] [AC:U88888] [PN:MecA homolog] [GN:mecA] [OR:*Bacillus firmus*] [DB:genpept-bct2] [DE:*Bacillus firmus* MecA homolog -continued (mecA) and cardiolipin synthase (cls) genes, complete cds.] [LE:349]
[RE:1002] [DI:direct]

| ORF Name | NT ID | AA ID | NT LN | AA LN | Score | P-Value |
|---|---|---|---|---|---|---|
| AI7503000991_35158177_c1_408 | 2036 | 5808 | 1407 | 468 | 903 | 1.5e−90 |

Description
gp:[GI:d1039121:g4514345] [LN:AB013374] [AC:AB013374] [PN:Ykok] [GN:ykok]
[OR:*Bacillus halodurans*] [SR:*Bacillus halodurans* (strain:C-125) DNA]
[DB:genpept-bct1] [DE:*Bacillus halodurans* C-125 mamX, yjdA, ykoK and yvfK
genes, partial and complete cds.] [LE:1793] [RE:3142] [DI:complement]

| ORF Name | NT ID | AA ID | NT LN | AA LN | Score | P-Value |
|---|---|---|---|---|---|---|
| AI7503000991_35937827_c2_505 | 2037 | 5809 | 510 | 169 | 343 | 3.3e−31 |

Description
pir:[LN:G69846] [AC:G69846] [PN:hypothetical protein yjcG] [GN:yjcG]
[OR:*Bacillus subtilis*] [DB:pir2] >gp:[GI:e1183205:g2633539] [LN:BSUB0007]
[AC:Z99110:AL009126] [GN:yjcG] [FN:unknown] [OR:*Bacillus subtilis*]
[DB:genpept-bct1] [DE:*Bacillus subtilis* complete genome (section 7 of 21):
from 1194391 to 1411140.] [LE:61943] [RE:62458] [DI:complement]

| ORF Name | NT ID | AA ID | NT LN | AA LN | Score | P-Value |
|---|---|---|---|---|---|---|
| AI7503000991_36128387_c3_621 | 2038 | 5810 | 165 | 55 | | |

Description
NO-HIT

| ORF Name | NT ID | AA ID | NT LN | AA LN | Score | P-Value |
|---|---|---|---|---|---|---|
| AI7503000991_36134717_c1_401 | 2039 | 5811 | 1647 | 548 | 889 | 4.6e−89 |

Description
pir:[LN:A53310] [AC:A53310] [PN:pheromone cAD1 binding protein
precursor:TraC] [GN:traC] [CL:dipeptide transport protein] [OR:*Enterococcus
faecalis*] [DB:pir2] >gp:[GI:g388269] [LN:AD1TRAC] [AC:L19532] [GN:traC]
[OR:Plasmid pAD1] [SR:Plasmid pAD1 DNA] [DB:genpept-bct1] [DE:Plasmid pAD1
(from *Enterococcus faecalis* strain:DS16) hemolysinbacteriocin (traC) gene,
complete cds, traA and traB genes, 3' end.] [LE:166] [RE:1797] [DI:direct]

| ORF Name | NT ID | AA ID | NT LN | AA LN | Score | P-Value |
|---|---|---|---|---|---|---|
| AI7503000991_36229625_f3_295 | 2040 | 5812 | 204 | 67 | 195 | 1.6e−15 |

Description
pir:[LN:B69869] [AC:B69869] [PN:hypothetical protein ykvS] [GN:ykvS]
[OR:*Bacillus subtilis*] [DB:pir2] >gp:[GI:e1184971:g2633752] [LN:BSUB0008]
[AC:Z99111:AL009126] [GN:ykvS] [FN:unknown] [OR:*Bacillus subtilis*]
[DB:genpept-bct1] [DE:*Bacillus subtilis* complete genome (section 8 of 21):
from 1394791 to 1603020.] [LE:52338] [RE:52769] [DI:complement]

| ORF Name | NT ID | AA ID | NT LN | AA LN | Score | P-Value |
|---|---|---|---|---|---|---|
| AI7503000991_36611062_c3_557 | 2041 | 5813 | 420 | 139 | 174 | 2.7e−13 |

Description
pir:[LN:D69837] [AC:D69837] [PN:hypothetical protein yisL] [GN:yisL]
[OR:*Bacillus subtilis*] [DB:pir2] >gp:[GI:e1183078:g2633412] [LN:BSUB0006]
[AC:Z99109:AL009126] [GN:yisL] [FN:unknown] [OR:*Bacillus subtilis*]
[DB:genpept-bct1] [DE:*Bacillus subtilis* complete genome (section 6 of 21):
from 999501 to 1209940.] [LE:153237] [RE:153593] [DI:direct]
>gp:GI:e1173510:g2145377] [LN:BSY09476] [AC:Y09476] [PN:YisL] [OR:*Bacillus
subtilis*] [DB:genpept-bct1] [DE:*B. subtilis* 54 kb genomic DNA fragment.]
[NT:putative] [LE:10463] [RE:10819] [DI:direct]

| ORF Name | NT ID | AA ID | NT LN | AA LN | Score | P-Value |
|---|---|---|---|---|---|---|
| AI7503000991_37777_c1_434 | 2042 | 5814 | 168 | 55 | | |

Description
NO-HIT

| ORF Name | NT ID | AA ID | NT LN | AA LN | Score | P-Value |
|---|---|---|---|---|---|---|
| AI7503000991_3954718_c1_394 | 2043 | 5815 | 3489 | 1162 | 1331 | 6.7e−136 |

-continued

Description
sp:[LN:ADDB_BACSU] [AC:P23477] [GN:ADDB] [OR:*BACILLUS SUBTILIS*]
[DE:ATP-DEPENDENT NUCLEASE SUBUNIT B] [SP:P23477] [DB:swissprot]
>pir:[LN:A39432] [AC:A39432:S61272:A69583] [PN:ATP-dependent
deoxyribonuclease chain B addB:ATP-dependent exonuclease synthesis protein
AdaB] [GN:addB] [OR:*Bacillus subtilis*] [DB:pir2] >gp:[GI:g142439]
[LN:BACADDAA] [AC:M63489] [PN:ATP-dependent nuclease] [GN:addA] [OR:*Bacillus
subtilis*] [SR:*B. subtilis* DNA] [DB:genpept-bct1] [DE:*Bacillus subtilis*
ATP-dependent nuclease (addA) and (addB), and open reading frame 3, partial
cds.] [LE:502] [RE:4002] [DI:direct] >gp:[GI:e1183064:g2633398]
[LN:BSUB0006] [AC:Z99109:AL009126] [PN:ATP-dependent deoxyribonuclease
(subunit B)] [GN:addB] [OR:*Bacillus subtilis*] [DB:genpept-bct1] [DE:*Bacillus
subtilis* complete genome (section 6 of 21):from 999501 to 1209940.]
[SP:P23477] [LE:136293] [RE:139793] [DI:direct] >gp:[GI:e1364880:g2226191]
[LN:BSY14081] [AC:Y14081] [PN:ATP-dependent nuclease] [GN:addB] [OR:*Bacillus
subtilis*] [DB:genpept-bct1] [DE:*Bacillus subtilis* chromosomal DNA, region 92
degrees:region between comK and addAB.] [NT:TTG start; see ref [3]; In EMBL
entry M63489 this] [LE:18588] [RE:22088] [DI:direct]

| ORF Name | NT ID | AA ID | NT LN | AA LN | Score | P-Value |
|---|---|---|---|---|---|---|
| AI7503000991_4019193_c1_418 | 2044 | 5816 | 783 | 260 | 749 | 3.2e-74 |

Description
pir: [LN:G69845] [AC:G69845] [PN:enoyl-[acyl-carrier-protein] reductase
(NADH), yjbW] [GN:yjbW] [CL:enoyl-[acyl-carrier-protein] reductase (NADH):
short-chain alcohol dehydrogenase homology] [OR:*Bacillus subtilis*]
[EC:1.3.1.9] [DB:pir2] >gp:[GI:e1183192:g2633526] [LN:BSUB0007]
[AC:Z99110:AL009126] [GN:yjbW] [FN:unknown] [OR:*Bacillus subtilis*]
[DB:genpept-bct1] [DE:*Bacillus subtilis* complete genome (section 7 of 21):
from 1194391 to 1411140.] [NT:similar to enoyl-acyl-carrier protein
reductase] [LE:52836] [RE:53645] [DI:direct]

| ORF Name | NT ID | AA ID | NT LN | AA LN | Score | P-Value |
|---|---|---|---|---|---|---|
| AI7503000991_4070151_c2_472 | 2045 | 5817 | 447 | 148 | 165 | 2.4e-12 |

Description
gp:[GI:e1173495:g2145362] [LN:BSY09476] [AC:Y09476] [PN:AddA] [OR:*Bacillus
subtilis*] [DB:genpept-bct1] [DE:*B. subtilis* 54kb genomic DNA fragment.]
[SP:P23478] [LE:<1] [RE:702] [DI:direct]

| ORF Name | NT ID | AA ID | NT LN | AA LN | Score | P-Value |
|---|---|---|---|---|---|---|
| AI7503000991_4080443_c1_409 | 2046 | 5818 | 1854 | 617 | 1574 | 1.2e-161 |

Description
pir:[LN:A69845] [AC:A69845] [PN:Na+/H+ antiporter homolog yjbQ] [GN:yjbQ]
[OR:*Bacillus subtilis*] [DB:pir2] >gp:[GI:e1183184:g2633518] [LN:BSUB0007]
[AC:Z99110:AL009126] [GN:yjbQ] [FN:unknown] [OR:*Bacillus subtilis*]
[DB:genpept-bct1] [DE:*Bacillus subtilis* complete genome (section 7 of 21):
from 1194391 to 1411140.] [NT:similar to Na+/H+ antiporter] [LE:45437]
[RE:47281] [DI:direct]

| ORF Name | NT ID | AA ID | NT LN | AA LN | Score | P-Value |
|---|---|---|---|---|---|---|
| AI7503000991_4088962_c2_508 | 2047 | 5819 | 279 | 92 | 76 | 0.0065 |

Description
pir:[LN:A70008] [AC:A70008] [PN:hypothetical protein yueH] [GN:yueH]
[OR:*Bacillus subtilis*] [DB:pir2] >gp:[GI:e1184255:g2635673] [LN:BSUB0017]
[AC:Z99120:AL009126] [GN:yueH] [FN:unknown] [OR:*Bacillus subtilis*]
[DB:genpept-bct1] [DE:*Bacillus subtilis* complete genome (section 17 of 21):
from 3197001 to 3414420.] [LE:64085] [RE:64333] [DI:complement]

| ORF Name | NT ID | AA ID | NT LN | AA LN | Score | P-Value |
|---|---|---|---|---|---|---|
| AI7503000991_4094433_f1_72 | 2048 | 5820 | 999 | 332 | 1184 | 2.5e-120 |

Description
sp:[LN:SYW_BACSU] [AC:P21656] [GN:TRPS] [OR:*BACILLUS SUBTILIS*] [EC:6.1.1.2]
[DE:(TRPRS)] [SP:P21656] [DB:swissprot] >pir:[LN:YWBS]
[AC:JT0481:A32452:E69726] [PN:tryptophan--tRNA ligase, :tryptophanyl-tRNA
synthetase] [GN:trpS] [CL:tryptophan--tRNA ligase] [OR:*Bacillus subtilis*]

-continued

[EC:6.1.1.2] [DB:pir1] >gp:[GI:g143786] [LN:BACTRPSA] [AC:M24068]
[OR:*Bacillus subtilisi*] [SR:*B. subtilis* (strain QB928) DNA, clone pTSQ2]
[DB:genpept-bct1] [DE:*B. subtilis* trpS gene encoding tryptophanyl-tRNA
synthetase, complete cds.] [NT:tryptophanyl-tRNA synthetase (EC 6.1.1.2)]
[LE:171] [RE:1163] [DI:direct] >gp:[GI:e1183162:g2633496] [LN:BSUB0007]
[AC:Z99110:AL009126] [PN:tryptophanyl-tRNA synthetase] [GN:trpS]
[OR:*Bacillus subtilis*] [DB:genpept-bct1] [EC:6.1.1.2] [DE:*Bacillus subtilis*
complete genome (section 7 of 21): from 1194391 to 1411140.] [SP:P21656]
[LE:23195] [RE:24187] [DI:complement]

| ORF Name | NT ID | AA ID | NT LN | AA LN | Score | P-Value |
|---|---|---|---|---|---|---|
| AI7503000991_40957_c1_407 | 2049 | 5821 | 858 | 285 | 513 | 3.2e-49 |

Description
sp:[LN:YJBO_BACSU] [AC:O31613] [GN:YJBO] [OR:*BACILLUS SUBTILIS*]
[DE:HYPOTHETICAL 31.5 KD PROTEIN IN MECA-TENA INTERGENIC REGION] [SP:O31613]
[DB:swissprot] >pir:[LN:G69844] [AC:G69844] [PN:conserved hypothetical
protein yjbO] [GN:yjbO] [CL:conserved hypothetical protein H10176]
[OR:*Bacillus subtilis*] [DB:pir2] >gp:[GI:e1183182:g2633516] [LN:BSUB0007]
[AC:Z99110:AL009126] [GN:yjbO] [FN:unknown] [OR:*Bacillus subtilis*]
[DB:genpept-bct1] [DE:*Bacillus subtilis* complete genome (section 7 of 21):
from 1194391 to 1411140.] [NT:similar to hypothetical proteins] [SP:O31613]
[LE:43604] [RE:44455] [DI:direct]

| ORF Name | NT ID | AA ID | NT LN | AA LN | Score | P-Value |
|---|---|---|---|---|---|---|
| AI7503000991_4100393_f3_379 | 2050 | 5822 | 1215 | 404 | 1458 | 2.3e-149 |

Description
pir:[LN:B69589] [AC:B69589] [PN:argininosuccinate synthase argG] [GN:argG]
[CL:argininosuccinate synthase] [OR:*Bacillus subtilis*] [DB:pir2]
>gp:[GI:e1184194:g2635410] [LN:BSUB0015] [AC:Z99118:AL009126]
[PN:argininosuccinate synthase] [GN:argG] [FN:arginine biosynthesis]
[OR:*Bacillus subtilis*] [DB:genpept-bct1] [EC:6.3.4.5] [DE:*Bacillus subtilis*
complete genome (section 15 of 21): from 2795131 to 3013540.] [LE:217075]
[RE:218286] [DI:complement] >gp:[GI:e1185818:g2635429] [LN:BSUB0016]
[AC:Z99119:AL009126] [PN:argininosuccinate synthase] [GN:argG] [FN:arginine
biosynthesis] [OR:*Bacillus subtilis*] (DB:genpept-bct1] [EC:6.3.4.5]
[DE:*Bacillus subtilis* complete genome (section 16 of 21): from 2997771 to
3213410.] [LE:14435] [RE:15646] [DI:complement] >gp:[GI:g2293242]
[LN:AF008220] [AC:AF008220] [PN:arginine succinate synthase] [GN:argG]
[OR:*Bacillus subtilis*] [DB:genpept-bct2] [DE:*Bacillus subtilis* rrnB-dnaB
genomic region.] [LE:164781] [RE:165992] [DI:direct]

| ORF Name | NT ID | AA ID | NT LN | AA LN | Score | P-Value |
|---|---|---|---|---|---|---|
| AI7503000991_4173410_c2_504 | 2051 | 5823 | 792 | 263 | 485 | 3.0e-46 |

Description
pir:[LN:H69846] [AC:H69846] [PN:hypothetical protein yjcH] [GN:yjcH]
[OR:*Bacillus subtilis*] [DB:pir2] >gp:[GI:e1183206:g2633540] [LN:BSUB0007]
[AC:Z99110:AL009126] [GN:yjcH] [FN:unknown] [OR:*Bacillus subtilis*]
[DB:genpept-bct1] [DE:*Bacillus subtilis* complete genome (section 7 of 21):
from 1194391 to 1411140.] [LE:62495] [RE:63217] [DI:complement]

| ORF Name | NT ID | AA ID | NT LN | AA LN | Score | P-Value |
|---|---|---|---|---|---|---|
| AI7503000991_4181312_c2_527 | 2052 | 5824 | 606 | 201 | 93 | 0.010 |

Description
pir:[LN:A71455] [AC:A71455] [PN:probable acetyltransferase] [GN:PH0296]
[OR:*Pyrococcus horikoshii*] [DB:pir2] >gp:[GI:d1030311:g3256685]
[LN:AP000001]
[AC:AP000001:AB009465:AB009464:AB009466:AB009467:AB009468:AB009469]
[PN:172aa long hypothetical acetyltransferase] [GN:PH0296] [OR:*Pyrococcus
horikoshii*] [SR:*Pyrococcus horikoshii* (strain:OT3) DNA] [DB:genpept-bct1]
[DE:*Pyrococcus horikoshii* OT3 genomic DNA, 1-287000 nt. position (1/7).]
[NT:similar to PIR:A64491 percent identity:42.029 in] [LE:262066]
[RE:262584] [DI:complement]

| ORF Name | NT ID | AA ID | NT LN | AA LN | Score | P-Value |
|---|---|---|---|---|---|---|
| AI7503000991_4335752_f1_4 | 2053 | 5825 | 171 | 56 | | |

Description
NO-HIT

-continued

| ORF Name | NT ID | AA ID | NT LN | AA LN | Score | P-Value |
|---|---|---|---|---|---|---|
| AI7503000991_4546890_f2_174 | 2054 | 5826 | 150 | 49 | | |

Description
NO-HIT

| ORF Name | NT ID | AA ID | NT LN | AA LN | Score | P-Value |
|---|---|---|---|---|---|---|
| AI7503000991_4687518_c2_519 | 2055 | 5827 | 585 | 194 | 179 | 8.0e-14 |

Description
sp:[LN:COMK_BACSU] [AC:P40396] [GN:COMK] [OR:*BACILLUS SUBTILIS*]
[DE:COMPETENCE TRANSCRIPTION FACTOR (CTF) (COMPETENCE PROTEIN K)]
[SP:P40396] [DB:swissprot] >pir:[LN:S43611] [AC:S43611:A69604]
[PN:competence transcription factor (CTF) comK] [GN:comK] [OR:*Bacillus subtilis*] [DB:pir2] >gp:[GI:e1183044:g2633378] [LN:BSUB0006]
[AC:Z99109:AL009126] [PN:competence transcription factor (CTF)] [GN:comK]
[FN:final autoregulatory control switch prior to] [OR:*Bacillus subtilis*]
[DB:genpept-bct1] [DE:*Bacillus subtilis* complete genome (section 6 of 21):
from 999501 to 1209940.] [SP:P40396] [LE:117081] [RE:117659] [DI:direct]
>gp:[GI:g546917] [LN:S70734] [AC:S70734] [GN:comK] [OR:*Bacillus subtilis*]
[SR:*Bacillus subtilis* E26] [DB:genpept-bct1] [DE:comK [*Bacillus subtilis*,
E26, Genomic, 3 genes, 1947 nt] .] [NT:This sequence comes from FIG. 3.]
[LE:900] [RE:1478] [DI:direct]

| ORF Name | NT ID | AA ID | NT LN | AA LN | Score | P-Value |
|---|---|---|---|---|---|---|
| AI7503000991_4688750_f3_283 | 2056 | 5828 | 174 | 57 | | |

Description
NO-HIT

| ORF Name | NT ID | AA ID | NT LN | AA LN | Score | P-Value |
|---|---|---|---|---|---|---|
| AI7503000991_4726010_c1_413 | 2057 | 5829 | 2304 | 767 | 1777 | 3.7e-183 |

Description
gp:[GI:g1196907] [LN:STMDRRC] [AC:L76359] [PN:daunorubicin resistance
protein] [GN:drrC] [OR:*Streptomyces peucetius*] [DB:genpept-bct1]
[DE:*Streptomyces peucetius* daunorubicin resistance protein (drrC)
gene, complete cds.] [LE:991] [RE:3285] [DI:direct]

| ORF Name | NT ID | AA ID | NT LN | AA LN | Score | P-Value |
|---|---|---|---|---|---|---|
| AI7503000991_4781275_f2_194 | 2058 | 5830 | 249 | 82 | | |

Description
NO-HIT

| ORF Name | NT ID | AA ID | NT LN | AA LN | Score | P-Value |
|---|---|---|---|---|---|---|
| AI7503000991_4812675_c1_412 | 2059 | 5831 | 321 | 106 | 273 | 3.1e-23 |

Description
Sp:[LN:G6PD_BACSU] [AC:P54547] [GN:ZWF] [OR:*BACILLUS SUBTILIS*] [EC:1.1.1.49]
[DE:PROTEIN 11) (VEG11)] [SP:P54547] [DB:swissprot] >pir:[LN:B69964]
[AC:B69964] [PN:probable glucose-6-phosphate 1-dehydrogenase, yqjJ]
[GN:yqjJ] [CL:glucose-6-phosphate dehydrogenase] [OR:*Bacillus subtilis*]
[EC:1.1.1.49] [DB:pir2] >gp:[GI:d1013296:g1303961] [LN:BACJHG42]
[AC:D84432:D82370] [PN:YqjJ] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:239025] [RE:240494]
[DI:complement] >gp:[GI:e1185654:g2634820] [LN:BSUB0013]
[AC:Z99116:AL009126] [GN:yqjJ] [FN:unknown] [OR:*Bacillus subtilis*]
[DB:genpept-bct1] [DE:*Bacillus subtilis* complete genome (section 13 of 21):
from 2395261 to 2613730.] [NT:similar to glucose-6-phosphate 1-dehydrogenase)
[SP:P54547] [LE:83125] [RE:84594] [DI:direct]

| ORF Name | NT ID | AA ID | NT LN | AA LN | Score | P-Value |
|---|---|---|---|---|---|---|
| AI7503000991_48587_f3_381 | 2060 | 5832 | 1062 | 353 | 729 | 4.2e-72 |

Description
sp:[LN:GLPQ_BACSU] [AC:P37965] [GN:GLPQ] [OR:*BACILLUS SUBTILIS*]
[EC:3.1.4.46] [DE:(GLYCEROPHOSPHODIESTER PHOSPHODIESTERASE)] [SP:P37965]
[DB:swissprot] >pir:[LN:I40418] [AC:I40418:E69634:S37251]
[PN:glycerophosphoryl diester phosphodiesterase glpQ] [GN:glpQ]
[OR:*Bacillus subtilis*] [DB:pir2] >gp:[GI:d1034076:g3599635] [LN:AB006424]

[AC:AB006424] [GN:ybeD] [OR:*Bacillus subtilis*] [SR:*Bacillus subtilis*
(strain:168) DNA] [DB:genpept-bct1] [DE:*Bacillus subtilis* genomic DNA, 70 kb
region between 17 and 23 degree.] [LE:36004] [RE:36885] [DI:complement]
>gp:[GI:g403373] [LN:BSGLPTQ] [AC:Z26522] [PN:glycerophosphoryl diester
phosphodiesterase] [GN:glpQ] [FN:hydrolysis of deacylated phospholipids]
[OR:*Bacillus subtilis*] [DB:genpept-bct1] [DE:*B. subtilis* glpT and glpQ genes
for glycerol 3-phosphate permeaseand glycerophosphoryl diester
phosphodiesterase.] [SP:P37965] [LE:1748] [RE:2629] [DI:direct]
>gp:[GI:e1182165:g2632499] [LN:BSUB0002] [AC:Z99105:AL009126]
[PN:glycerophosphoryl diester phosphodiesterase] [GN:glpQ] [FN:hydrolysis of
deacylated phospholipids] [OR:*Bacillus subtilis*] [DB:genpept-bct1]
[EC:3.1.4.46] [DE:*Bacillus subtilis* complete genome (section 2 of 21): from
194651 to 415810.] [NT:alternate gene name:ybeD] [SP:P37965] [LE:38353]
[RE:39234] [DI:complement]

| ORF Name | NT ID | AA ID | NT LN | AA LN | Score | P-Value |
|---|---|---|---|---|---|---|
| AI7503000991_4882133_c1_435 | 2061 | 5833 | 150 | 49 | | |

Description
NO-HIT

| ORF Name | NT ID | AA ID | NT LN | AA LN | Score | P-Value |
|---|---|---|---|---|---|---|
| AI7503000991_4882806_c2_524 | 2062 | 5834 | 522 | 173 | 399 | 3.9e-37 |

Description
pir:[LN:D69838] [AC:D69838] [PN:conserved hypothetical protein yisU]
[GN:yisU] [OR:*Bacillus subtilis*] [DB:pir2] >gp:[GI:e1183088:g2633422]
[LN:BSUB0006] [AC:Z99109:AL009126] [GN:yisU] [FN:unknown] [OR:*Bacillus
subtilis*] [DB:genpept-bct1] [DE:*Bacillus subtilis* complete genome (section 6
of 21): from 999501 to 1209940.] [NT:similar to hypothetical proteins]
[LE:165981] [RE:166643] [DI:complement] >gp:[GI:e1173520:g2145387]
[LN:BSY09476] [AC:Y09476] [PN:YisU] [OR:*Bacillus subtilis*] [DB:genpept-bct1]
[DE:*B. subtilis* 54kb genomic DNA fragment.] [NT:putative] [LE:23207]
[RE:23869] [DI:complement]

| ORF Name | NT ID | AA ID | NT LN | AA LN | Score | P-Value |
|---|---|---|---|---|---|---|
| AI7503000991_4961000_f1_6 | 2063 | 5835 | 123 | 40 | | |

Description
NO-HIT

| ORF Name | NT ID | AA ID | NT LN | AA LN | Score | P-Value |
|---|---|---|---|---|---|---|
| AI7503000991_5085003_f1_118 | 2064 | 5836 | 1455 | 484 | 1439 | 2.4e-147 |

Description
pir:[LN:C69589] [AC:C69589] [PN:argininosuccinate lyase argH] [GN:argH]
[CL:argininosuccinate lyase] [OR:*Bacillus subtilis*] [DB:pir2]
>gp:[GI:e1184193:g2635409] [LN:BSUB0015] [AC:Z99118:AL009126]
[PN:argininosuccinate lyase] [GN:argH] [FN:arginine biosynthesis]
[OR:*Bacillus subtilis*] [DB:genpept-bct1] [EC:4.3.2.1] [DE:*Bacillus subtilis*
complete genome (section 15 of 21): from 2795131 to 3013540.] [LE:215693]
[RE:217078] [DI:complement] >gp:[GI:e1185817:g2635428] [LN:BSUB0016]
[AC:Z99119:AL009126] [PN:argininosuccinate lyase] [GN:argH] [FN:arginine
biosynthesis] [OR:*Bacillus subtilis*] [DB:genpept-bct1] [EC:4.3.2.1]
[DE:*Bacillus subtilis* complete genome (section 16 of 21): from 2997771 to
3213410.] [LE:13053] [RE:14438] [DI:complement] >gp:[GI:g2293243]
[LN:AF008220] [AC:AF008220] [PN:arginine succinate lyase] [GN:argH]
[OR:*Bacillus subtilis*] [DB:genpept-bct2] [DE:*Bacillus subtilis* rrnB-dnaB
genomic region.] [LE:165989] [RE:167374] [DI:direct]

| ORF Name | NT ID | AA ID | NT LN | AA LN | Score | P-Value |
|---|---|---|---|---|---|---|
| AI7503000991_5115927_c2_528 | 2065 | 5837 | 1680 | 559 | 340 | 1.3e-59 |

Description
pir:[LN:S76520] [AC:S76520] [PN:hypothetical protein] [OR:*Synechocystis*
sp.] [SR:PCC 6803, , PCC 6803] [SR:PCC 6803,] [DB:pir2]
>gp:[GI:d1011017:g1001635] [LN:SYCSLRD] [AC:D64002:AB001339]
[PN:2-succinyl-6-hydroxy-2,] [GN:menD] [OR:*Synechocystis* sp.]
[SR:*Synechocystis* sp. (strain:PCC6803) DNA] [DB:genpept-bct1]
[DE:*Synechocystis* sp. PCC6803 complete genome, 21/27, 2644795-2755702.]
[NT:ORF_ID:s110603] [LE:25321] [RE:27108] DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000991__5165711__f3__336 | 2066 | 5838 | 447 | 148 | 338 | 1.1e-30 |

Description
pir:[LN:A69844] [AC:A69844] [PN:hypothetical protein yjbI] [GN:yjbI]
[OR:*Bacillus subtilis*] [DB:pir2] >gp:[GI:e1183176:g2633510] [LN:BSUB0007]
[AC:Z99110:AL009126] [GN:yjbI] [FN:unknown] [OR:*Bacillus subtilis*]
[DB:genpept-bct1] [DE:*Bacillus subtilis* complete genome (section 7 of 21):
from 1194391 to 1411140.] [LE:39591] [RE:39989] [DI:complement]

| ORF Name | NT ID | AA ID | NT LN | AA LN | Score | P-Value |
|---|---|---|---|---|---|---|
| AI7503000991__5250258__c1__403 | 2067 | 5839 | 1839 | 612 | 1741 | 2.4e-179 |

Description
gp:[GI:d1014255:g1651216] [LN:D88209] [AC:D88209] [PN:Pz-peptidase]
[OR:*Bacillus licheniformis*] [SR:*Bacillus licheniformis* (strain:N22) DNA]
[DB:genpept-bct1] [DE:*Bacillus licheniformis* DNA for Pz-peptidase, complete
cds.] [LE:238] [RE:2124] [DI:direct]

| ORF Name | NT ID | AA ID | NT LN | AA LN | Score | P-Value |
|---|---|---|---|---|---|---|
| AI7503000991__579441__c1__386 | 2068 | 5840 | 150 | 49 | | |

Description
NO-HIT

| ORF Name | NT ID | AA ID | NT LN | AA LN | Score | P-Value |
|---|---|---|---|---|---|---|
| AI7503000991__580307__f2__246 | 2069 | 5841 | 132 | 43 | | |

Description
NO-HIT

| ORF Name | NT ID | AA ID | NT LN | AA LN | Score | P-Value |
|---|---|---|---|---|---|---|
| AI7503000991__6057943__c2__517 | 2070 | 5842 | 999 | 332 | 990 | 9.2e-100 |

Description
pir:[LN:G69830] [AC:G69830] [PN:lipoate-protein ligase homolog yhfJ]
[GN:yhfJ] [CL:lipoate-protein ligase] [OR:*Bacillus subtilis*] [DB:pir2]
>gp:[GI:e1183027:g2633361] [LN:BSUB0006] [AC:Z99109:AL009126] [GN:yhfJ]
[FN:unknown] [OR:*Bacillus subtilis*] [DB:genpept-bct1] [DE:*Bacillus subtilis*
complete genome (section 6 of 21): from 999501 to 1209940.] [NT:similar to
lipoate-protein ligase] [LE:99131] [RE:100126] [DI:direct]
>gp:[GI:e325016:g2226243] [LN:BSY14083] [AC:Y14083] [PN:hypothetical
protein] [GN:yhfJ] [OR:*Bacillus subtilis*] [DB:genpept-bct1] [DE:*Bacillus
subtilis* chromosomal DNA, region 76–78 degrees: between glyB-aprE.]
[NT:Similarity to several lipoate-protein ligases] [LE:18990] [RE:19985]
[DI:direct]

| ORF Name | NT ID | AA ID | NT LN | AA LN | Score | P-Value |
|---|---|---|---|---|---|---|
| AI7503000991__6688757__f2__123 | 2071 | 5843 | 507 | 168 | 823 | 4.6e-82 |

Description
gp:[GI:g2267240] [LN:SEU71377] [AC:U71377] [OR:*Staphylococcus epidermidis*]
[DB:genpept-bct1] [DE:*Staphylococcus epidermidis* autolysin AtlE and
putative transcriptional regulator AtlR genes, complete cds.] [NT:ORF2]
[LE:913] [RE:1383] [DI:direct]

| ORF Name | NT ID | AA ID | NT LN | AA LN | Score | P-Value |
|---|---|---|---|---|---|---|
| AI7503000991__6921877__c1__410 | 2072 | 5844 | 219 | 72 | 192 | 2.3e-14 |

Description
sp:[LN:G6PD_BACSU] [AC:P54547] [GN:ZWF] [OR:*BACILLUS SUBTILIS*] [EC:1.1.1.49]
[DE:PROTEIN 11) (VEG11)] [SP:P54547] [DB:swissprot] >pir:[LN:B69964]
[AC:B69964] [PN:probable glucose-6-phosphate 1-dehydrogenase, yqjJ]
[GN:yqjJ] [CL:glucose-6-phosphate dehydrogenase] [OR:*Bacillus subtilis*]
[EC:1.1.1.49] [DB:pir2] >gp:[GI:d1013296:g1303961] [LN:BACJH642]
[AC:D84432:D82370] [PN:YqjJ] [OR:*Bacillus subtilis*] [SR:*Bacillus subtilis*
(strain:JH642(trpC2 PheA1)) DNA] [DB:genpept-bct1] [DE:*Bacillus subtilis*
DNA, 283 Kb region containing skin element.] [LE:239025] [RE:240494]
[DI:complement] >gp:[GI:e1185654:g2634820] [LN:BSUB0013]
[AC:Z99116:AL009126] [GN:yqjJ] [FN:unknown] [OR:*Bacillus subtilis*]
[DB:genpept-bct1] [DE:*Bacillus subtilis* complete genome (section 13 of 21):
from 2395261 to 2613730.] [NT:similar to glucose-6-phosphate 1-dehydrogenase]
[SP:P54547] [LE:83125] [RE:84594] [DI:direct]

-continued

| ORF Name | NT ID | AA ID | NT LN | AA LN | Score | P-Value |
|---|---|---|---|---|---|---|
| AI7503000991_7032752_f3_268 | 2073 | 5845 | 795 | 264 | 1335 | 2.5e-136 |

Description
gp:[GI:g2267239] [LN:SEU71377] [AC:U71377] [OR:*Staphylococcus epidermidis*]
[DB:genpept-bct1] [DE:*Staphylococcus epidermidis* autolysin AtlE and
putative transcriptional regulator AtlR genes, complete cds.] [NT:ORF1]
[LE:<1] [RE:865] [DI:direct]

| ORF Name | NT ID | AA ID | NT LN | AA LN | Score | P-Value |
|---|---|---|---|---|---|---|
| AI7503000991_7081712_f1_27 | 2074 | 5846 | 234 | 77 | 84 | 0.00093 |

Description
pir:[LN:H69835] [AC:H69835] [PN:hypothetical protein yhzC] [GN:yhzC]
[OR:*Bacillus subtilis*] [DB:pir2] >gp:[GI:e1183043:g2633377] [LN:BSUB0006]
[AC:Z99109:AL009126] [GN:yhzC] [FN:unknown] [OR:*Bacillus subtilis*]
[DB:genpept-bct1] [DE:*Bacillus subtilis* complete genome (section 6 of 21):
from 999501 to 1209940.] [LE:116555] [RE:116788] [DI:complement]

| ORF Name | NT ID | AA ID | NT LN | AA LN | Score | P-Value |
|---|---|---|---|---|---|---|
| AI7503000991_7145260_f3_337 | 2075 | 5847 | 243 | 80 | | |

Description
NO-HIT

| ORF Name | NT ID | AA ID | NT LN | AA LN | Score | P-Value |
|---|---|---|---|---|---|---|
| AI7503000991_7228438_c2_471 | 2076 | 5848 | 3231 | 1076 | 1793 | 7.4e-185 |

Description
sp:[LN:ADDA_BACSU] [AC:P23478] [GN:ADDA] [OR:*BACILLUS SUBTILIS*]
[DE:ATP-DEPENDENT NUCLEASE SUBUNIT A] [SP:P23478] [DB:swissprot]
>pir:[LN:B39432] [AC:B39432:H69582] [PN:ATP-dependent deoxyribonuclease
chain A addA:ATP-dependent exonuclease synthesis protein AddA] [GN:addA]
[OR:*Bacillus subtilis*] [DB:pir2] >gp:[GI:g142440] [LN:BACADDAA] [AC:M63489]
[PN:ATP-dependent nuclease] [GN:addB] [OR:*Bacillus subtilis*] [SR:*B. subtilis*
DNA*] [DB:genpept-bct1] [DE:*Bacillus subtilis* ATP-dependent nuclease (addA)
and (addB), and open reading frame 3, partial cds.] [LE:3988] [RE:7687]
[DI:direct] >gp:[GI:e1183065:g2633399] [LN:BSUB0006] [AC:Z99109:AL009126]
[PN:ATP-dependent deoxyribonuclease (subunit A)] [GN:addA] [OR:*Bacillus
subtilis*] [DB:genpept-bct1] [DE:*Bacillus subtilis* complete genome (section 6
of 21): from 999501 to 1209940.] [NT:alternate gene name:recE5] [SP:P23478]
[LE:139780] [RE:143478] [DI:direct] >gp:[GI:e1364881:g2226192] [LN:BSY14081]
[AC:Y14081] [PN:ATP-dependent nuclease] [GN:addA] [OR:*Bacillus subtilis*]
[DB:genpept-bct1] [DE:*Bacillus subtilis* chromosomal DNA, region 92 degrees:
region between comK and addAB.] [NT:see ref [3]; In EMBL entry M63489 this
gene is] [LE:22075] [RE:25773] [DI:direct]

| ORF Name | NT ID | AA ID | NT LN | AA LN | Score | P-Value |
|---|---|---|---|---|---|---|
| AI7503000991_7241300_c2_502 | 2077 | 5849 | 135 | 44 | | |

Description
NO-HIT

| ORF Name | NT ID | AA ID | NT LN | AA LN | Score | P-Value |
|---|---|---|---|---|---|---|
| AI7503000991_7308375_c3_567 | 2078 | 5850 | 942 | 313 | 791 | 1.1e-78 |

Description
pir:[LN:H69668] [AC:H69668:S15231:B38447] [PN:oligopeptide transport system
permease protein oppB:sporulation initiation protein spo0KB] [GN:oppB:spo0KB]
[CL:oligopeptide permease protein oppB] [OR:*Bacillus subtilis*] [DB:pir2]
>gp:[GI:e1183164:g2633498] [LN:BSUB0007] [AC:Z99110:AL009126]
[PN:oligopeptide ABC transporter (permease)] [GN:oppB] [FN:required for
initiation of sporulation,] [OR:*Bacillus subtilis*] [DB:genpept-bct1]
[DE:*Bacillus subtilis* complete genome (section 7 of 21): from 1194391 to
1411140.] [NT:alternate gene name:spo0KB] [LE:26676] [RE:27611] [DI:direct]

| ORF Name | NT ID | AA ID | NT LN | AA LN | Score | P-Value |
|---|---|---|---|---|---|---|
| AI7503000991_782816_c1_396 | 2079 | 5851 | 1857 | 618 | 776 | 3.7e-116 |

Description
pir:[LN:C69975] [AC:C69975] [PN:acyltransferase homolog yrhL] [GN:yrhL]
[OR:*Bacillus subtilis*] [DB:pir2] >gp:[GI:g1934616] [LN:BSU93874] [AC:U93874]

-continued

[PN:hypothetical protein YrhL] [GN:yrhL] [OR:*Bacillus subtilis*]
[DB:genpept-bct1] [DE:*Bacillus subtilis* cysteine synthase (yrhA),
cystathioninegamma-lyase (yrhB), YrhC (yrhC), YrhD (yrhD), formate
dehydrogenase chain A (yrhE), YrhF (yrhF), formate dehydrogenase
YrhH (yrhH), regulatory protein (yrhI), cytochrome P450 102 (yrhJ),
YrhK (yrhK), hypothetical protein YrhL (yrhL), putative anti-SigV
factor (yrhM), RNA polymerase sigma factor SigV (sigV) and YrhO (yrhO) genes,
complete cds, and YrhP (yrhP) gene, partial cds.] [NT:similar to *Haemophilus
influenzae* hypothetical] [LE:13904] [RE:15808] [DI:complement]
>gp:[GI:e1183944:g2635160] [LN:BSUB0014] [AC:Z99117:AL009126] [GN:yrhL]
[FN:unknown] [OR:*Bacillus subtilis*] [DB:genpept-bct1] [DE:*Bacillus subtilis*
complete genome (section 14 of 21): from 2599451 to 2812870.] [NT:similar to
acyltransferase] [LE:171138] [RE:173042] [DI:direct]

| ORF Name | NT ID | AA ID | NT LN | AA LN | Score | P-Value |
|---|---|---|---|---|---|---|
| AI7503000991_813412_c1_411 | 2080 | 5852 | 156 | 51 | 191 | 3.0e-14 |

Description
sp:[LN:G6PD_BACSU] [AC:P54547] [GN:ZWF] [OR:*BACILLUS SUBTILIS*] [EC:1.1.1.49]
[DE:PROTEIN 11) (VEG11)] [SP:P54547] [DB:swissprot] >pir:[LN:B69964]
[AC:B69964] [PN:probable glucose-6-phosphate 1-dehydrogenase, yqjJ]
[GN:yqjJ] [CL:glucose-6-phosphate dehydrogenase] [OR:*Bacillus subtilis*]
[EC:1.1.1.49] [DB:pir2] >gp:[GI:d1013296:g1303961] [LN:BACJHG42]
[AC:D84432:D82370] [PN:YqjJ] [OR:*Bacillus subtilis*] [SR:*Bacillus subtilis*
(strain:JH642 (trpC2 PheA1)) DNA] [DB:genpept-bct1] [DE:*Bacillus subtilis*
DNA, 283 Kb region containing skin element.] [LE:239025] [RE:240494]
[DI:complement] >gp:[GI:e1185654:g2634820] [LN:BSUB0013]
[AC:Z99116:AL009126] [GN:yqjJ] [FN:unknown] [OR:*Bacillus subtilis*]
[DB:genpept-bct1] [DE:*Bacillus subtilis* complete genome (section 13 of 21):
from 2395261 to 2613730.] [NT:similar to glucose-6-phosphate 1-dehydrogenase]
[SP:P54547] [LE:83125] [RE:84594] [DI:direct]

| ORF Name | NT ID | AA ID | NT LN | AA LN | Score | P-Value |
|---|---|---|---|---|---|---|
| AI7503000991_859838_f3_357 | 2081 | 5853 | 384 | 127 | | |

Description
NO-HIT

| ORF Name | NT ID | AA ID | NT LN | AA LN | Score | P-Value |
|---|---|---|---|---|---|---|
| AI7503000991_978436_f2_126 | 2082 | 5854 | 1188 | 395 | 867 | 9.9e-87 |

Description
sp:[LN:PATA_BACSU] [AC:P16524] [GN:PATA:UAT] [OR:*BACILLUS SUBTILIS*]
[EC:2.6.1.—] [DE:PUTATIVE AMINOTRANSFERASE A,] [SP:P16524] [DB:swissprot]
>gp:[GI:e1181905:g2632221] [LN:BS16829KB] [AC:AJ222587] [PN:PatA protein]
[GN:patA] [OR:*Bacillus subtilis*] [DB:genpept-bct1] [DE:*Bacillus subtilis*
29kB DNA fragment from ykwC gene to cse15 gene.] [NT:hisC homologue]
[SP:P16524] [LE:6213] [RE:7391] [DI:complement]

| ORF Name | NT ID | AA ID | NT LN | AA LN | Score | P-Value |
|---|---|---|---|---|---|---|
| AI7503000991_985887_c3_570 | 2083 | 5855 | 435 | 144 | 570 | 2.9e-55 |

Description
pir:[LN:D69843] [AC:D69843] [PN:conserved hypothetical protein yjbD]
[GN:yjbD] [CL:hypothetical protein yjbD] [OR:*Bacillus subtilis*] [DB:pir2]
>gp:[GI:e1183170:g2633504] [LN:BSUB0007] [AC:Z99110:AL009126] [GN:yjbD]
[FN:unknown] [OR:*Bacillus subtilis*] [DB:genpept-bct1] [DE:*Bacillus subtilis*
complete genome (section 7 of 21): from 1194391 to 1411140.] [NT:similar to
hypothetical proteins] [LE:32779] [RE:33174] [DI:direct]

| ORF Name | NT ID | AA ID | NT LN | AA LN | Score | P-Value |
|---|---|---|---|---|---|---|
| AI7503000991_9927077_f3_378 | 2084 | 5856 | 147 | 48 | | |

Description
NO-HIT

| ORF Name | NT ID | AA ID | NT LN | AA LN | Score | P-Value |
|---|---|---|---|---|---|---|
| AI7503000992_10008513_c3_117 | 2085 | 5857 | 2667 | 888 | 3361 | 0.0 |

-continued

Description
pir:[LN:SYBSVS] [AC:A26738] [PN:valine--tRNA ligase, :valyl-tRNA synthetase]
[GN:valS] [CL:valine--tRNA ligase] [OR:*Bacillus stearothermophilus*]
[EC:6.1.1.9] [DB:pir1]

| ORF Name | NT ID | AA ID | NT LN | AA LN | Score | P-Value |
|---|---|---|---|---|---|---|
| AI7503000992__10720877__c1__78 | 2086 | 5858 | 1329 | 442 | 1343 | 3.6e-137 |

Description
pir:[LN:F69723] [AC:F69723] [PN:trigger factor (prolyl isomerase) tig]
[GN:tig] [CL:trigger factor] [OR:*Bacillus subtilis*] [DB:pir2]
>gp:[GI:e1184072:g2635288] [LN:BSUB0015] [AC:Z99118:AL009126] [PN:trigger
factor (prolyl isomerase)] [GN:tig] [OR:*Bacillus subtilis*] [DB:genpept-bct1]
[DE:*Bacillus subtilis* complete genome (section 15 of 21): from 2795131 to
3013540.] [NT:alternate gene name:yzzH] [SP:P80698] [LE:90286] [RE:91560]
[DI:complement] >gp:[GI:e1165373:g1770074] [LN:BSZ75208] [AC:Z75208]
[PN:trigger factor] [GN:tig] [OR:*Bacillus subtilis*] [DB:genpept-bct1]
[DE:*B. subtilis* genomic sequence 89009bp.] [NT:homology to trigger factor of
*Haemophilus*] [SP:P80698] [LE:78347] [RE:79621] [DI:direct]

| ORF Name | NT ID | AA ID | NT LN | AA LN | Score | P-Value |
|---|---|---|---|---|---|---|
| AI7503000992__11954500__f3__71 | 2087 | 5859 | 174 | 57 | | |

Description
NO-HIT

| ORF Name | NT ID | AA ID | NT LN | AA LN | Score | P-Value |
|---|---|---|---|---|---|---|
| AI7503000992__1211562__c2__94 | 2088 | 5860 | 1269 | 422 | 1518 | 1.0e-155 |

Description
gp:[GI:e221213:g1296452] [LN:BSCLPXGEN] [AC:X95306] [PN:ClpX protein]
[GN:clpX] [OR:*Bacillus subtilis*] [DB:genpept-bct1] [DE:*B. subtilis* clpX
gene.] [NT:ATP-dependent protease] [SP:P50866] [LE:168] [RE:1430]
[DI:direct]

| ORF Name | NT ID | AA ID | NT LN | AA LN | Score | P-Value |
|---|---|---|---|---|---|---|
| AI7503000992__14725300__c3__108 | 2089 | 5861 | 123 | 40 | | |

Description
NO-HIT

| ORF Name | NT ID | AA ID | NT LN | AA LN | Score | P-Value |
|---|---|---|---|---|---|---|
| AI7503000992__15820252__c1__81 | 2090 | 5862 | 141 | 46 | | |

Description
NO-HIT

| ORF Name | NT ID | AA ID | NT LN | AA LN | Score | P-Value |
|---|---|---|---|---|---|---|
| AI7503000992__16835900__c2__104 | 2091 | 5863 | 147 | 48 | 74 | 0.011 |

Description
gp:[GI:g1123053] [LN:CELF59A6] [AC:U41994] [GN:F59A6.2] [OR:*Caenorhabditis elegans*] [SR:*Caenorhabditis elegans* strain=Bristol N2] [DB:genpept-invl]
[DE:*Caenorhabditis elegans* cosmid F59A6.] [LE:19719:20072] [RE:19904:20242]
[DI:directJoin]

| ORF Name | NT ID | AA ID | NT LN | AA LN | Score | P-Value |
|---|---|---|---|---|---|---|
| AI7503000992__188388__c3__122 | 2092 | 5864 | 579 | 192 | 220 | 3.6e-18 |

Description
sp:[LN:MREC_BACSU] [AC:Q01466] [GN:MREC] [OR:*BACILLUS SUBTILIS*] [DE:ROD
SHAPE-DETERMINING PROTEIN MREC] [SP:Q01466] [DB:swissprot] >pir:[LN:JC4595]
[AC:JC4595] [PN:cell shape determinant MreC:protease secretion stimulating
protein, MreC] [GN:mreC] [OR:*Bacillus stearothermophilus*] [DB:pir2]
>pir:[LN:C45240] [AC:C45240:D45239:S27518] [PN:cell shape determinant mreC]
[GN:mreC] [OR:*Bacillus subtilis*] [DB:pir2] >gp:[GI:g143213] [LN:BACMREMIN]
[AC:M95582] [GN:mreC] [FN:cell shape determining] [OR:*Bacillus subtilis*]
[SR:*Bacillus subtilis* (strain W168) DNA] [DB:genpept-bct1] [DE:*Bacillus
subtilis* (mreB) gene complete cds, (mreC) gene complete cds, (mreD) gene
complete cds, (minC) gene complete cds, (minD) gene complete cds.]
[NT:putative] [LE:1370] [RE:2242] [DI:direct]

-continued

| ORF Name | NT ID | AA ID | NT LN | AA LN | Score | P-Value |
|---|---|---|---|---|---|---|
| AI7503000992_19707767_f1_4 | 2093 | 5865 | 324 | 107 | | |

Description
NO-HIT

| ORF Name | NT ID | AA ID | NT LN | AA LN | Score | P-Value |
|---|---|---|---|---|---|---|
| AI7503000992_20348160_f1_1 | 2094 | 5866 | 222 | 73 | 71 | 0.022 |

Description
gp:[GI:g1131474] [LN:PBU42580] [AC:U42580:U17055:U32570] [GN:A130R]
[OR:*Paramecium bursaria Chlorella* virus 1] [DB:genpept-vrl] [DE:*Paramecium bursaria Chlorella* virus 1, complete genome.] [LE:69061] [RE:69378]
[DI:direct]

| ORF Name | NT ID | AA ID | NT LN | AA LN | Score | P-Value |
|---|---|---|---|---|---|---|
| AI7503000992_21500253_c3_109 | 2095 | 5867 | 177 | 58 | | |

Description
NO-HIT

| ORF Name | NT ID | AA ID | NT LN | AA LN | Score | P-Value |
|---|---|---|---|---|---|---|
| AI7503000992_21563137_c2_102 | 2096 | 5868 | 135 | 44 | | |

Description
NO-HIT

| ORF Name | NT ID | AA ID | NT LN | AA LN | Score | P-Value |
|---|---|---|---|---|---|---|
| AI7503000992_23444187_f3_62 | 2097 | 5869 | 162 | 53 | | |

Description
NO-HIT

| ORF Name | NT ID | AA ID | NT LN | AA LN | Score | P-Value |
|---|---|---|---|---|---|---|
| AI7503000992_23522567_c2_91 | 2098 | 5870 | 381 | 126 | 450 | 1.5e-42 |

Description
sp:[LN:RL20_BACSU] [AC:P55873] [GN:RPLT] [OR:*BACILLUS SUBTILIS*] [DE:50S
RIBOSOMAL PROTEIN L20] [SP:P55873] [DB:swissprot] >pir:[LN:F69696]
[AC:F69696] [PN:ribosomal protein L20 rplT] [GN:rplT] [CL:*Escherichia coli*
ribosomal protein L20] [OR:*Bacillus subtilis*] [DB:pir2]
>gp:[GI:e1184134:g2635350] [LN:BSUB0015] [AC:Z99118:AL009126] [PN:ribosomal
protein L20] [GN:rplT] [OR:*Bacillus subtilis*] [DB:genpept-bct1] [DE:*Bacillus
subtilis* complete genome (section 15 of 21): from 2795131 to 3013540.]
[SP:P55873] [LE:156202] [RE:156561] [DI:complement]
>gp:[GI:e1165301:g1770009] [LN:BSZ75208] [AC:Z75208] [PN:ribosomal protein
L20] [GN:rplT] [OR:*Bacillus subtilis*] [DB:genpept-bct1] [DE:*B. subtilis*
genomic sequence 89009bp.] [NT:homology to rplT of *Bacillus
stearothermphilus;*] [SP:P55873] [LE:13346] [RE:13705] [DI:direct]

| ORF Name | NT ID | AA ID | NT LN | AA LN | Score | P-Value |
|---|---|---|---|---|---|---|
| AI7503000992_23531628_f2_28 | 2099 | 5871 | 144 | 47 | | |

Description
NO-HIT

| ORF Name | NT ID | AA ID | NT LN | AA LN | Score | P-Value |
|---|---|---|---|---|---|---|
| AI7503000992_23697141_c2_97 | 2100 | 5872 | 930 | 309 | 1327 | 1.8e-135 |

Description
gp:[GI:g2589181] [LN:SAU89396] [AC:U89396] [PN:porphobilinogen deaminase]
[GN:hemC] [OR:*Staphylococcus aureus*] [DB:genpept-bct2] [EC:4.3.1.8]
[DE:*Staphylococcus aureus* hemCDBL gene cluster:porphobilinogendeaminase
(hemC), uroporphyrinogen III synthase (hemD), d-aminolevulinic acid
dehydratase (hemB) and GSA-1-aminotransferase (hemL) genes, complete cds.]
[LE:219] [RE:1145] [DI:direct]

| ORF Name | NT ID | AA ID | NT LN | AA LN | Score | P-Value |
|---|---|---|---|---|---|---|
| AI7503000992_24017052_c2_103 | 2101 | 5873 | 150 | 49 | | |

-continued

| Description NO-HIT | | | | | | |
|---|---|---|---|---|---|---|
| ORF Name | NT ID | AA ID | NT LN | AA LN | Score | P-Value |
| AI7503000992__24240877_c3__119 | 2102 | 5874 | 522 | 173 | | |

| Description NO-HIT | | | | | | |
|---|---|---|---|---|---|---|
| ORF Name | NT ID | AA ID | NT LN | AA LN | Score | P-Value |
| AI7503000992__24625161_c1__87 | 2103 | 5875 | 141 | 46 | 160 | 8.2e-12 |

Description
sp:[LN:RADC_STAAU] [AC:P31337] [GN:RADC] [OR:*STAPHYLOCOCCUS AUREUS*] [DE:DNA REPAIR PROTEIN RADC HOMOLOG (25 KD PROTEIN) (FRAGMENT)] [SP:P31337] [DB:swissprot] >gp:[GI:g551992] [LN:STATNIS5] [AC:K02985] [OR:*Staphylococcus aureus*] [SR:*S. aureus* (strain RN450) DNA] [DB:genpept-bct1] [DE:*S. aureus* (strain RN450) transposon Tn554 insertion site.] [NT:25 kD protein (putative); putative] [LE:<1] [RE:>249] [DI:direct]

| ORF Name | NT ID | AA ID | NT LN | AA LN | Score | P-Value |
|---|---|---|---|---|---|---|
| AI7503000992__24897312_c3__112 | 2104 | 5876 | 186 | 61 | 255 | 7.1e-22 |

Description
sp:[LN:HEM2_STAAU] [AC:P50915] [GN:HEMB] [OR:*STAPHYLOCOCCUS AUREUS*] [EC:4.2.1.24] [DE:SYNTHASE) (ALAD) (ALADH)] [SP:P50915] [DB:swissprot] >gp:[GI:g2589183] [LN:SAU89396] [AC:U89396] [PN:d-aminolevulinic acid dehydratase] [GN:hemB] [OR:*Staphylococcus aureus*] [DB:genpept-bct2] [EC:4.2.1.24] [DE:*Staphylococcus aureus* hemCDBL gene cluster: porphobilinogendeaminase (hemC), uroporphyrinogen III synthase (hemD), d-aminolevulinic acid dehydratase (hemB) and GSA-1-aminotransferase (hemL) genes, complete cds.] [LE:1838] [RE:2809] [DI:direct]

| ORF Name | NT ID | AA ID | NT LN | AA LN | Score | P-Value |
|---|---|---|---|---|---|---|
| AI7503000992__25582912_f2__23 | 2105 | 5877 | 123 | 40 | | |

| Description NO-HIT | | | | | | |
|---|---|---|---|---|---|---|
| ORF Name | NT ID | AA ID | NT LN | AA LN | Score | P-Value |
| AI7503000992__25596000_c3__111 | 2106 | 5878 | 825 | 274 | 460 | 1.3e-43 |

Description
sp:[LN:HEMX_BACSU] [AC:P16645] [GN:HEMX] [OR:*BACILLUS SUBTILIS*] [DE:HEMX PROTEIN] [SP:P16645] [DB:swissprot] >pir:[LN:B35252] [AC:B35252:C69640] [PN:hemA concentration negative effector hemx] [GN:hemx] [OR:*Bacillus subtilis*] [DB:pir2] >gp:[GI:g143036] [LN:BACHEMAXC] [AC:M57676:M32130] [GN:hemx] [OR:*Bacillus subtilis*] [SR:*B. subtilis* DNA] [DB:genpept-bct1] [DE:*Bacillus subtilis* hemAXCDBL gene cluster.] [NT:unidentified gene product] [LE:1607] [RE:2437] [DI:direct] >gp:[GI:e1184065:g2635281] [LN:BSUB0015] [AC:Z99118:AL009126] [PN:membrane-bound protein] [GN:hemX] [FN:negative effector of the concentration of HemA] [OR:*Bacillus subtilis*] [DB:genpept-bct1] [DE:*Bacillus subtilis* complete genome (section 15 of 21): from 2795131 to 3013540.] [SP:P16645] [LE:80898] [RE:81728] [DI:complement] >gp:[GI:e1165382:g1770082] [LN:BSZ75208] [AC:Z75208] [PN:membrane-bound protein] [GN:hemx] [OR:*Bacillus subtilis*] [DB:genpept-bct1] [DE:*B. subtilis* genomic sequence 89009bp.] [NT:membrane bound protein dispensable for heme] [SP:P16645] [LE:88179] RE:89009] [DI:direct]

| ORF Name | NT ID | AA ID | NT LN | AA LN | Score | P-Value |
|---|---|---|---|---|---|---|
| AI7503000992__2866255_f3__65 | 2107 | 5879 | 264 | 87 | 74 | 0.045 |

Description
gp:[GI:e1250026:g2842472] [LN:SPBC20F10] [AC:AL021747] [PN:preg-like protein.] [GN:SPBC20F10.10] [OR:*Schizosaccharomyces pombe*] [SR:fission yeast] [DB:genpept-pln1] [DE:*S. pombe* chromosome II cosmid c20F10.] [NT:SPBC20F10.10, len:243, SIMILARITY:*Arabidopsis*] [LE:20474] [RE:21205] [DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503000992_31510_f3_55 | 2108 | 5880 | 627 | 208 | 435 | 6.0e-41 |

Description
sp:[LN:3MGA_HAEIN] [AC:P44321] [GN:TAG:HI0654] [OR:*HAEMOPHILUS INFLUENZAE*]
[EC:3.2.2.20] [DE:GLYCOSYLASE) (TAG)] [SP:P44321] [DB:swissprot]
>pir:[LN:G64084] [AC:G64084] [PN:3-methyladenine DNA glycosylase, I]
[CL:3-methyladenine DNA glycosylase I] [OR:*Haemophilus influenzae*]
[EC:3.2.2.—] [DB:pir2] >gp:[GI:g1573653] [LN:U32748] [AC:U32748:L42023]
[PN:DNA-3-methyladenine glycosidase I (tagI) [GN:HI0654] [OR:*Haemophilus
influenzae* Rd] [DB:genpept-bct2] [DE:*Haemophilus influenzae* Rd section 63 of
163 of the complete genome.] [NT:similar to SP:P05100 GB:J02606 GB:X03845
PID:147920] [LE:6773] [RE:7330] [DI:complement]

| ORF Name | NT ID | AA ID | NT LN | AA LN | Score | P-Value |
|---|---|---|---|---|---|---|
| AI7503000992_33395050_c2_95 | 2109 | 5881 | 618 | 205 | 577 | 5.3e-56 |

Description
sp:[LN:YSXC_BACSU] [AC:P38424] [GN:YSXC] [OR:*BACILLUS SUBTILIS*] [DE:(ORFX)]
[SP:P38424] [DB:swissprot] >pir:[LN:I40422] [AC:I40422:C69987:S45102]
[PN:conserved hypothetical protein ysxC] [GN:ysxC] [CL:*Bacillus subtilis*
conserved hypothetical protein ysxC:translation elongation factor Tu
homology] [OR:*Bacillus subtilis*] [DB:pir2] >gp:[GI:g496558] [LN:BSLONLA]
[AC:X76424] [OR:*Bacillus subtilis*] [DB:genpept-bct1] [DE:*B. subtilis* lon gene
for protease La.] [NT:orfX] [SP:P38424] [LE:2669] [RE:3256] [DI:direct]
>gp:[GI:e1184068:g2635284] [LN:BSUB0015] [AC:Z99118:AL009126] [GN:ysxC]
[FN:unknown] [OR:*Bacillus subtilis*] [DB:genpept-bct1] [DE:*Bacillus subtilis*
complete genome (section 15 of 21): from 2795131 to 3013540.] [NT:similar to
hypothetical proteins] [SP:P38424] [LE:83852] [RE:84439] [DI:complement]
>gp:[GI:e1165379:g1770079] [LN:BSZ75208] [AC:Z75208] [PN:hypothetical
protein] [GN:ysxC] [OR:*Bacillus subtilis*] [DB:genpept-bct1] [DE:*B. subtilis*
genomic sequence 89009bp.] [NT:unknown function; putative] [SP:P38424]
[LE:85468] [RE:86055] [DI:direct]

| ORF Name | NT ID | AA ID | NT LN | AA LN | Score | P-Value |
|---|---|---|---|---|---|---|
| AI7503000992_33517_c1_82 | 2110 | 5882 | 1077 | 358 | 258 | 2.8e-21 |

Description
pir:[LN:E69834] [AC:E69834] [PN:hypothetical protein yhjN] [GN:yhjN]
[OR:*Bacillus subtilis*] [DB:pir2] >gp:[GI:e1183059:g2633393] [LN:BSUB0006]
[AC:Z99109:AL009126] [GN:yhjN] [FN:unknown] [OR:*Bacillus subtilis*]
[DB:genpept-bct1] [DE:*Bacillus subtilis* complete genome (section 6 of 21):
from 999501 to 1209940.] [LE:130891] [RE:132045] [DI:complement]
>gp:[GI:e324987:g2226186] [LN:BSY14081] [AC:Y14081] [PN:hypothetical
protein] [GN:yhjN] [OR:*Bacillus subtilis*] [DB:genpept-bct1] [DE:*Bacillus
subtilis* chromosomal DNA, region 92 degrees:region between comK and addAB.]
[NT:TTG start; Similarity to a hypothetical protein] [LE:13186] [RE:14340]
[DI:complement]

| ORF Name | NT ID | AA ID | NT LN | AA LN | Score | P-Value |
|---|---|---|---|---|---|---|
| AI7503000992_34642092_c1_85 | 2111 | 5883 | 1284 | 427 | 907 | 5.7e-91 |

Description
sp:[LN:FOLC_BACSU] [AC:Q05865] [GN:FOLC] [OR:*BACILLUS SUBTILIS*]
[EC:6.3.2.17] [DE:SYNTHETASE) (FPGS)] [SP:Q05865] [DB:swissprot]
>pir:[LN:B40646] [AC:B40646:B33490:D69626] [PN:folyl-polyglutamate
synthetase folC] [GN:folC] [OR:*Bacillus subtilis*] [DB:pir2]
>gp:[GI:g142936] [LN:BACFOLC] [AC:L04520] [PN:folyl-polyglutamate
synthetase] [GN:folC] [OR:*Bacillus subtilis*] [SR:*Bacillus subtilis*
(sub_strain PY79, strain W168) DNA] [DB:genpept-bct1] [DE:*Bacillus subtilis*
valyl tRNA synthetase (valS) gene, 3' end cds; folyl-polyglutamate synthetase
(folC) gene, complete cds; comCgene, 5' end cds.] [LE:231] [RE:1523]
[DI:direct] >gp:[GI:e1184057:g2635273] [LN:BSUB0015] [AC:Z99118:AL009126]
[PN:folyl-polyglutamate synthetase] [GN:folC] [FN:folate biosynthesis]
[OR:*Bacillus subtilis*] [DB:genpept-bct1] [EC:6.3.2.17] [DE:*Bacillus subtilis*
complete genome (section 15 of 21): from 2795131 to 3013540.] [SP:Q05865]
[LE:69443] [RE:70735] [DI:complement]

| ORF Name | NT ID | AA ID | NT LN | AA LN | Score | P-Value |
|---|---|---|---|---|---|---|
| AI7503000992_3914012_c2_98 | 2112 | 5884 | 690 | 229 | 710 | 4.3e-70 |

Description
gp:[GI:g2589182] [LN:SAU89396] [AC:U89396] [PN:uroporphyrinogen III
synthase] [GN:hemD] [OR:*Staphylococcus aureus*] [DB:genpept-bct2]
[EC:4.2.1.75] [DE:*Staphylococcus aureus* hemCDBL gene cluster:
porphobilinogendeaminase (hemC), uroporphyrinogen III synthase -continued (hemD), d-aminolevulinic acid dehydratase (hemB) and
GSA-1-aminotransferase (hemL) genes, complete cds.] [LE:1167] [RE:1835]
[DI:direct]

| ORF Name | NT ID | AA ID | NT LN | AA LN | Score | P-Value |
|---|---|---|---|---|---|---|
| AI7503000992__4080443_c3__113 | 2113 | 5885 | 1296 | 431 | 2041 | 3.9e-211 |

Description
sp:[LN:GSA_STAAU] [AC:O34092] [GN:HEML] [OR:*STAPHYLOCOCCUS AUREUS*]
[EC:5.4.3.8] [DE:(GLUTAMATE-1-SEMIALDEHYDE AMINOTRANSFERASE) (GSA-AT)]
[SP:O34092] [DB:swissprot] >gp:[GI:g2589184] [LN:SAU89396] [AC:U89396]
[PN:GSA-1-aminotransferase] [GN:hemL] [OR:*Staphylococcus aureus*]
[DB:genpept-bct2] [EC:5.4.3.8] [DE:*Staphylococcus aureus* hemCDBL gene
cluster:porphobilinogendeaminase (hemC), uroporphyrinogen III synthase
(hemD), d-aminolevulinic acid dehydratase (hemB) and
GSA-1-aminotransferase (hemL) genes, complete cds.] [LE:2857] [RE:4143]
[DI:direct]

| ORF Name | NT ID | AA ID | NT LN | AA LN | Score | P-Value |
|---|---|---|---|---|---|---|
| AI7503000992__439183_f1__14 | 2114 | 5886 | 297 | 98 | 208 | 6.8e-17 |

Description
gp:[GI:e1165375:g1770076] [LN:BSZ75208] [AC:Z75208] [PN:hypothetical
protein] [GN:ysoC] [OR:*Bacillus subtilis*] [DB:genpept-bct1] [DE:*B. subtilis*
genomic sequence 89009bp.] [NT:unknown function; putative] [LE:80592]
[RE:81206] [DI:complement]

| ORF Name | NT ID | AA ID | NT LN | AA LN | Score | P-Value |
|---|---|---|---|---|---|---|
| AI7503000992__4729837_c2__92 | 2115 | 5887 | 624 | 207 | 416 | 6.1e-39 |

Description
sp:[LN:YMAB_BACSU] [AC:P50619] [GN:YMAB] [OR:*BACILLUS SUBTILIS*]
[DE:HYPOTHETICAL 23.4 KD PROTEIN IN NRDF-CWLC INTERGENIC REGION] [SP:P50619]
[DB:swissprot] >pir:[LN:D69883] [AC:D69883] [PN:hypothetical protein ymaB]
[GN:ymaB] [OR:*Bacillus subtilis*] [DB:pir2] >gp:[GI:e218063:g1154634]
[LN:BSNRDYMA] [AC:Z68500] [PN:YmaB] [GN:ymaB] [FN:unknown] [OR:*Bacillus
subtilis*] [DB:genpept-bct1] [DE:*B. subtilis* cwlC, nrdE, nrdF, ymaA and ymaB
genes.] [NT:no similarities, cannot be inactivated] [SP:P50619] [LE:4450]
[RE:5070] [DI:direct] >gp:[GI:e1183399:g2634124] [LN:BSUB0010]
[AC:Z99113:AL009126] [GN:ymaB] [FN:unknown] [OR:*Bacillus subtilis*]
[DB:genpept-bct1] [DE:*Bacillus subtilis* complete genome (section 10 of 21):
from 1781201 to 2014980.] [LE:90169] [RE:90789] [DI:direct]

| ORF Name | NT ID | AA ID | NT LN | AA LN | Score | P-Value |
|---|---|---|---|---|---|---|
| AI7503000992__4891876_f3__45 | 2116 | 5888 | 141 | 46 | | |

Description
NO-HIT

| ORF Name | NT ID | AA ID | NT LN | AA LN | Score | P-Value |
|---|---|---|---|---|---|---|
| AI7503000992__500052_c3__118 | 2117 | 5889 | 669 | 222 | 440 | 1.8e-41 |

Description
sp:[LN:RADC_BACSU] [AC:Q02170] [GN:YSXA] [OR:*BACILLUS SUBTILIS*] [DE:DNA
REPAIR PROTEIN RADC HOMOLOG (ORFB)] [SP:Q02170] [DB:swissprot]
>pir:[LN:B45239] [AC:B45239:B45240:I39881:A69987] [PN:DNA repair protein
homolog ysxA] [GN:ysxA] [CL:DNA repair protein radc] [OR:*Bacillus subtilis*]
[DB:pir2] >gp:[GI:g142854] [LN:BACDIVREG] [AC:M96343] [GN:orfB] [OR:*Bacillus
subtilis*] [SR:*Bacillus subtilis* (sub_strain PY79, strain W168) DNA]
[DB:genpept-bct1] [DE:*Bacillus subtilis* orfA, orfB, mreB, mreC, mreD, minC,
and minD genes, complete coding regions.] [NT:homologous to E. coli radC gene
product and to] [LE:762] [RE:1457] [DI:direct] >gp:[GI:g143162]
[LN:BACMAFMREB] [AC:L08793] [OR:*Bacillus subtilis*] [SR:*Bacillus subtilis*
(strain W168) DNA] [DB:genpept-bct1] [DE:*Bacillus subtilis* maf gene,
complete cds; orfB, complete cds; mreB gene, 5' end.] [NT:putative] [LE:1557]
[RE:2252] [DI:direct] >gp:[GI:e1184053:g2635269] [LN:BSUB0015]
[AC:Z99118:AL009126] [GN:ysxA] [FN:unknown] [OR:*Bacillus subtilis*]
[DB:genpept-bct1] [DE:*Bacillus subtilis* complete genome (section 15 of 21):
from 2795131 to 3013540.] [NT:similar to DNA repair protein] [SP:Q02170]
[LE:65971] [RE:66666] [DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000992_5268775_c3_105 | 2118 | 5890 | 960 | 319 | 138 | 8.5e-07 |

Description
pir:[LN:H69986] [AC:H69986 ] [PN:hypothetical protein ysoA] [GN:ysoA]
[OR:*Bacillus subtilis*] [DB:pir2] >gp:[GI:e1184073:g2635289] [LN:BSUB0015]
[AC:Z99118:AL009126] [GN:ysoA] [FN:unknown] [OR:*Bacillus subtilis*]
[DB:genpept-bct1] [DE:*Bacillus subtilis* complete genome (section 15 of 21):
from 2795131 to 3013540.] [LE:91788] [RE:92720] [DI:complement]
>gp:[GI:e1165372:g1770073] [LN:BSZ75208] [AC:Z75208] [PN:hypothetical
protein] [GN:ysoA] [OR:*Bacillus subtilis*] [DB:genpept-bct1] [DE:*B. subtilis*
genomic sequence 89009bp.] [NT:unknown function; putative] [LE:77187]
[RE:78119] [DI:direct]

| ORF Name | NT ID | AA ID | NT LN | AA LN | Score | P-Value |
|---|---|---|---|---|---|---|
| AI7503000992_5860827_c3_110 | 2119 | 5891 | 1347 | 448 | 1172 | 4.8e-119 |

Description
sp:[LN:HEM1_BACSU] [AC:P16618] [GN:HEMA] [OR:*BACILLUS SUBTILIS*] [EC:1.2.1.—]
[DE:GLUTAMYL-TRNA REDUCTASE, (GLUTR)] [SP:P16618] [DB:swissprot]
>pir:[LN:A35252] [AC:A35252:C69639] [PN:glutamyl-tRNA reductase, hemA:hemA
protein] [GN:hemA] [CL:glutamyl-tRNA reductase] [OR:*Bacillus subtilis*]
[EC:1.2.1.—] [DB:pir2] >gp:[GI:g143035] [LN:BACHEMAXC] [AC:M57676:M32130]
[PN:NAD(P)H:glutamyl-transfer RNA reductase] [GN:hemA] [OR:*Bacillus
subtilis*] [SR:*B. subtilis* DNA] [DB:genpept-bct1] [DE:*Bacillus subtilis*
hemAXCDBL gene cluster.] [NT:The product of this hemA gene is not an]
[LE:232] [RE:1599] [DI:direct] >gp:[GI:e1184066:g2635282] [LN:BSUB0015]
[AC:Z99118:AL009126] [PN:glutamyl-tRNA reductase] [GN:hemA] [FN:porphyrin
biosynthesis] [OR:*Bacillus subtilis*] (DB:genpept-bct1] [EC:1.2.1.—]
[DE:*Bacillus subtilis* complete genome (section 15 of 21): from 2795131 to
3013540.] [SP:P16618] [LE:81736] [RE:83103] [DI:complement]
>gp:[GI:e1165381:g1770081] [LN:BSZ75208] [AC:Z75208]
[PN:NAD(P)H:glutamyl-transfer RNA reductase] [GN:hemA] [OR:*Bacillus
subtilis*] [DB:genpept-bct1] [EC:2.3.1.37] [DE:*B. subtilis* genomic sequence
89009bp.] [NT:NAD(P)H:glutamyl-t-RNA reductase of the C-5 pathway]
[SP:P16618] [LE:86804] [RE:88171] [DI:direct]

| ORF Name | NT ID | AA ID | NT LN | AA LN | Score | P-Value |
|---|---|---|---|---|---|---|
| AI7503000992_6845382_f2_26 | 2120 | 5892 | 219 | 72 | 72 | 0.034 |

Description
gp:[GI:e1358367:g3979946] [LN:CEY18D10A] [AC:AL034393] [GN:Y18D10A.14]
[OR:*Caenorhabditis elegans*] [DB genpept-inv1] [DE:*Caenorhabditis elegans*
cosmid Y18D10A, complete sequence.] [LE:113813:114013:114203]
[RE:113961:114112:114448] [DI:directJoin]

| ORF Name | NT ID | AA ID | NT LN | AA LN | Score | P-Value |
|---|---|---|---|---|---|---|
| AI7503000992_7050319_c2_90 | 2121 | 5893 | 237 | 78 | 226 | 8.4e-19 |

Description
sp:[LN:RL35_BACSU] [AC:P55874] [GN:RPMI] [OR:*BACILLUS SUBTILIS*] [DE:50S
RIBOSOMAL PROTEIN L35] [SP:P55874] [DB:swissprot]

| ORF Name | NT ID | AA ID | NT LN | AA LN | Score | P-Value |
|---|---|---|---|---|---|---|
| AI7503000992_7283437_c1_89 | 2122 | 5894 | 162 | 54 | | |

Description
NO-HIT

| ORF Name | NT ID | AA ID | NT LN | AA LN | Score | P-Value |
|---|---|---|---|---|---|---|
| AI7503000992_806510_c1_86 | 2123 | 5895 | 714 | 237 | 189 | 7.0e-15 |

Description
sp:[LN:LEP3_BACSU] [AC:P15378] [GN:COMC] [OR:*BACILLUS SUBTILIS*]
[EC:3.4.99.—] [DE:(LATE COMPETENCE PROTEIN COMC)] [SP:P15378] [DB:swissprot]
>pir:[LN:A33490] [AC:A33490:E40646:F40646:B69602] [PN:type IV prepilin
peptidase, :genetic transformation late competence protein ComC] [GN:comC]
[CL:type IV prepilin peptidase] [OR:*Bacillus subtilis*] [EC:3.4.99.—]
[DB:pir2] >gp:[GI:g142704] [LN:BACCOMC] [AC:M30805] [PN:late competence
protein] [GN:comC] [OR:*Bacillus subtilis*] [SR:*Bacillus subtilis* (strain
IS75) DNA] [DB:genpept-bct1] [DE:*Bacillus subtilis* late competence protein
(comC) gene, complete cds.] [LE:819] [RE:1565] [DI:direct]
>gp:[GI:e1184056:g2635272] [:LN:BSUB0015] [AC:Z99118:AL009126]
[PN:DNA-binding protein] [GN:comC] [FN:required for the processing and
translocation] [OR:*Bacillus subtilis*] [DB:genpept-bct1] [DE:*Bacillus*

-continued

*subtilis* complete genome (section 15 of 21): from 2795131 to 3013540.]
[SP:P15378] [LE:68557] [RE:69303] [DI:complement]

| ORF Name | NT ID | AA ID | NT LN | AA LN | Score | P-Value |
|---|---|---|---|---|---|---|
| AI7503000992_820253_f1_15 | 2124 | 5896 | 297 | 98 | 206 | 1.1e-16 |

Description
gp:[GI:e1165375:g1770076] [LN:BSZ75208] [AC:Z75208] [PN:hypothetical
protein] [GN:ysoC] [OR:*Bacillus subtilis*] [DB:genpept-bct1] [DE:*B. subtilis*
genomic sequence 89009bp.] [NT:unknown function; putative] [LE:80592]
[RE:81206] [DI complement]

| ORF Name | NT ID | AA ID | NT LN | AA LN | Score | P-Value |
|---|---|---|---|---|---|---|
| AI7503000992_978562_c1_79 | 2125 | 5897 | 861 | 286 | 1261 | 1.8e-128 |

Description
sp:[LN:HEM2_STAAU] [AC:P50915] [GN:HEMB] [OR:*STAPHYLOCOCCUS AUREUS*]
[EC:4.2.1.24] [DE:SYNTHASE) (ALAD) (ALADH)] [SP:P50915] [DB:swissprot]
>gp:[GI:g2589183] [LN:SAU89396] [AC:U89396] [PN:d-aminolevulinic acid
dehydratase] [GN:hemB] [OR:*Staphylococcus aureus*] [DB:genpept-bct2]
[EC:4.2.1.24] [DE:*Staphylococcus aureus* hemCDBL gene cluster:
porphobilinogendeaminase (hemC), uroporphyrinogen III synthase
(hemD), d-aminolevulinic acid dehydratase (hemB) and
GSA-1-aminotransferase (hemL) genes, complete cds.] [LE:1838] [RE:2809]
[DI:direct]

| ORF Name | NT ID | AA ID | NT LN | AA LN | Score | P-Value |
|---|---|---|---|---|---|---|
| AI7503000993_10266875_c2_761 | 2126 | 5898 | 156 | 51 | | |

Description
NO-HIT

| ORF Name | NT ID | AA ID | NT LN | AA LN | Score | P-Value |
|---|---|---|---|---|---|---|
| AI7503000993_10463_c2_803 | 2127 | 5899 | 504 | 167 | 315 | 3.1e-28 |

Description
sp:[LN:YTXG_BACSU] [AC:P40779] [GN:YTXG] [OR:*BACILLUS SUBTILIS*]
[DE:HYPOTHETICAL 15.7 KD PROTEIN IN MURC-AROA INTERGENIC REGION (ORF1)]
[SP:P40779] [DB:swissprot] >pir:[LN:D70003] [AC:D70003:S71001] [PN:general
stress protein homolog ytxG] [GN:ytxG] [OR:*Bacillus subtilis*] [DB:pir2]
>gp:[GI:g556015] [LN:BACUNAM] [AC:L31845] [OR:*Bacillus subtilis*]
[DB:genpept-bct1] [DE:*Bacillus subtilis* UDP-N-acetylmuramate-alanine ligase
gene, partial cds, and 3 ORF's.] [NT:ORF1] [LE:1211] [RE:1642] [DI:direct]
>gp:[GI:e1185851:g2635462] [LN:BSUB0016] [AC:Z99119:AL009126] [GN:ytxG]
[FN:unknown] [OR:*Bacillus subtilis*] [DB:genpept-bct1] [DE:*Bacillus subtilis*
complete genome (section 16 of 21): from 2997771 to 3213410.] [NT:alternate
gene name: csb40; similar to general] [SP:P40779] [LE:48897] [RE:49328]
[DI:complement] >gp:[GI:g2293217] [LN:AF008220] [AC:AF008220] [PN:YtxG]
[GN:ytxG] [OR:*Bacillus subtilis*] [DB:genpept-bct2] [DE:*Bacillus subtilis*
rrnB-dnaB genomic region.] [LE:131098] [RE:131529] [DI:direct]

| ORF Name | NT ID | AA ID | NT LN | AA LN | Score | P-Value |
|---|---|---|---|---|---|---|
| AI7503000993_10548383_f1_3 | 2128 | 5900 | 237 | 78 | | |

Description
NO-HIT

| ORF Name | NT ID | AA ID | NT LN | AA LN | Score | P-Value |
|---|---|---|---|---|---|---|
| AI7503000993_10564375_f3_510 | 2129 | 5901 | 123 | 40 | | |

Description
NO-HIT

| ORF Name | NT ID | AA ID | NT LN | AA LN | Score | P-Value |
|---|---|---|---|---|---|---|
| AI7503000993_1056693_c2_793 | 2130 | 5902 | 1101 | 366 | 774 | 7.1e-77 |

Description
pir:[LN:B69998] [AC:B69998] [PN:endo-1,4-beta-glucanase homolog ytoP]
[GN:ytoP] [CL:thermophilic aminopeptidase I alpha chain] [OR:*Bacillus
subtilis*] [DB:pir2] >gp:[GI:e1185859:g2635470] [LN:BSUB0016]
[AC:Z99119:AL009126] [GN:ytoP] [FN:unknown] [OR:*Bacillus subtilis*]
[DB:genpept-bct1] [DE:*Bacillus subtilis* complete genome (section 16 of 21):

-continued from 2997771 to 3213410.] [NT:similar to endo-1,4-beta-glucanase] [LE:56559]
[RE:57632] [DI:complement] >gp:[GI:g2293210] [LN:AF008220] LAC:AF008220]
[PN:YtoP] [GN:ytoP] [OR:Bacillus subtilis] [DB:genpept-bct2] [DE:Bacillus
subtilis rrnB-dnaB genomic region.] [NT:similar to hypothetical protein f356
from E. coli] [LE:122794] [RE:123867] [DI:direct]

| ORF Name | NT ID | AA ID | NT LN | AA LN | Score | P-Value |
|---|---|---|---|---|---|---|
| AI7503000993__10588877__f1__52 | 2131 | 5903 | 138 | 45 | | |

Description
NO-HIT

| ORF Name | NT ID | AA ID | NT LN | AA LN | Score | P-Value |
|---|---|---|---|---|---|---|
| AI7503000993__10667002__f1__111 | 2132 | 5904 | 165 | 54 | | |

Description
NO-HIT

| ORF Name | NT ID | AA ID | NT LN | AA LN | Score | P-Value |
|---|---|---|---|---|---|---|
| AI7503000993__109430__f3__485 | 2133 | 5905 | 144 | 47 | | |

Description
NO-HIT

| ORF Name | NT ID | AA ID | NT LN | AA LN | Score | P-Value |
|---|---|---|---|---|---|---|
| AI7503000993__10969427__f3__448 | 2134 | 5906 | 156 | 51 | | |

Description
NO-HIT

| ORF Name | NT ID | AA ID | NT LN | AA LN | Score | P-Value |
|---|---|---|---|---|---|---|
| AI7503000993__112525__f3__546 | 2135 | 5907 | 141 | 46 | | |

Description
NO-HIT

| ORF Name | NT ID | AA ID | NT LN | AA LN | Score | P-Value |
|---|---|---|---|---|---|---|
| AI7503000993__116337__f2__251 | 2136 | 5908 | 627 | 208 | 199 | 6.1e-16 |

Description
gp:[GI:g3043872] [LN:LLU95837] [AC:U95837] [PN:transmembrane protein Tmp3]
[OR:Lactococcus lactis] [DB:genpept-bct2] [DE:Lactococcus lactis
transmembrane protein Tmp3 gene, partial cds.] [NT:PBP1A homolog; identified
as a fusion to a signal] [LE:<1] [RE:588] [DI:complement]

| ORF Name | NT ID | AA ID | NT LN | AA LN | Score | P-Value |
|---|---|---|---|---|---|---|
| AI7503000993__11881325__f3__568 | 2137 | 5909 | 147 | 48 | | |

Description
NO-HIT

| ORF Name | NT ID | AA ID | NT LN | AA LN | Score | P-Value |
|---|---|---|---|---|---|---|
| AI7503000993__1203827__c3__893 | 2138 | 5910 | 639 | 212 | 475 | 3.4e-45 |

Description
sp:[LN:RISA__ACTPL] [AC:P50854] [GN:RIBE:RIBB] [OR:ACTINOBACILLUS
PLEUROPNEUMONIAE] [SR:, HAEMOPHILUS PLEUROPNEUMONIAE] [EC:2.5.1.9]
[DE:RIBOFLAVIN SYNTHASE ALPHA CHAIN,] [SP:P50854] [DB:swissprot]
>gp:[GI:g1173517] [LN:APU27202] [AC:U27202] [PN:riboflavin synthase alpha
subunit] [GN:ribB] [OR:Actinobacillus pleuropneumoniae] [DB:genpept-bct1]
[DE:Actinobacillus pleuropneumoniae riboflavin biosynthesis
operon, riboflavin-specific deaminase (ribG), riboflavin synthase
alphasubunit (ribB), bifunctional GTP
cyclohydraseII/3,4-dihydroxy-2-butanone-4-phosphate synthase (ribA),
and riboflavin synthase beta subunit (ribH) genes, complete cds.]
[NT:lumazine synthase; similar to Bacillus subtilis] [LE:1685] [RE:2332]
[DI:direct]

-continued

| ORF Name | NT ID | AA ID | NT LN | AA LN | Score | P-Value |
|---|---|---|---|---|---|---|
| AI7503000993_1209417_c3_959 | 2139 | 5911 | 1704 | 567 | 797 | 2.6e-79 |

Description
sp:[LN:PHOR_BACSU] [AC:P23545] [GN:PHOR] [OR:*BACILLUS SUBTILIS*] [EC:2.7.3.—]
[DE:ALKALINE PHOSPHATASE SYNTHESIS SENSOR PROTEIN PHOR,] [SP:P23545]
[DB:swissprot] >pir:[LN:A27650] [AC:A27650:G69676] [PN:phosphate response
regulator histidine kinase phoR] [GN:phoR] [OR:*Bacillus subtilis*] [DB:pir2]
>gp:[GI:g143331] [LN:BACPHORP] [AC:M23549] [PN:alkaline phosphatase
regulatory protein] [GN:phoR] [OR:*Bacillus subtilis*] [SR:*Bacillus subtilis*
DNA] [DB:genpept-bct1] [DE:*Bacillus subtilis* alkaline phosphatase regulatory
protein (phoPgene, 3' end and phoR gene, complete cds).] [LE:85] [RE:1824]
[DI:direct] >gp:[GI:e1184159:g2635375] [LN:BSUB0015] [AC:Z99118:AL009126]
[PN:two-component sensor histidine kinase] [GN:phoR] [FN:involved in
phosphate regulation] [OR:*Bacillus subtilis*] [DB:genpept-bct1] [DE:*Bacillus
subtilis* complete genome (section 15 of 21): from 2795131 to 3013540.]
[SP:P23545] [LE:180011] [RE:181750] [DI:complement] >gp:[GI:g2293271]
[LN:AF008220] [AC:AF008220] [PN:signal transduction protein kinase]
[GN:phoR] [OR:*Bacillus subtilis*] [DB:genpept-bct2] [DE:*Bacillus subtilis*
rrnB-dnaB genomic region.] [LE:201317] RE:203056] [DI:direct]

| ORF Name | NT ID | AA ID | NT LN | AA LN | Score | P-Value |
|---|---|---|---|---|---|---|
| AI7503000993_125880_f2_361 | 2140 | 5912 | 309 | 102 | | |

Description
NO-HIT

| ORF Name | NT ID | AA ID | NT LN | AA LN | Score | P-Value |
|---|---|---|---|---|---|---|
| AI7503000993_1284381_c1_652 | 2141 | 5913 | 741 | 246 | 297 | 2.5e-26 |

Description
sp:[LN:TAL_METJA] [AC:Q58370] [GN:TAL:MJ0960] [OR:*METHANOCOCCUS JANNASCHII*]
(EC:2.2.1.—] [DE:TRANSALDOLASE-LIKE PROTEIN,] [SP:Q58370] [DB:swissprot]
>pir:[LN:H64419] [AC:H64419] [PN:transaldolase,] [CL:*Bacillus subtilis* 23K
phosphoprotein orfU] [OR:*Methanococcus jannaschii*] [EC:2.2.1.2] [DB:pir2]
[MP:REV892437-891784] >gp:[GI:g1591624] [LN:U67539] [AC:U67539:L77117]
[PN:transaldolase] [GN:MJ0960] [OR:*Methanococcus jannaschii*]
[DB:genpept-bct2] [DE:*Methanococcus jannaschii* section 81 of 150 of the
complete genome.] [NT:similar to SP:P19669 PID:853766 GB:AL009126 percent]
[LE:7990] [RE:8643] [DI:complement]

| ORF Name | NT ID | AA ID | NT LN | AA LN | Score | P-Value |
|---|---|---|---|---|---|---|
| AI7503000993_12894378_f2_347 | 2142 | 5914 | 177 | 58 | | |

Description
NO-HIT

| ORF Name | NT ID | AA ID | NT LN | AA LN | Score | P-Value |
|---|---|---|---|---|---|---|
| AI7503000993_13001537_f3_444 | 2143 | 5915 | 249 | 82 | | |

Description
NO-HIT

| ORF Name | NT ID | AA ID | NT LN | AA LN | Score | P-Value |
|---|---|---|---|---|---|---|
| AI7503000993_13089052_f3_538 | 2144 | 5916 | 141 | 46 | | |

Description
NO-HIT

| ORF Name | NT ID | AA ID | NT LN | AA LN | Score | P-Value |
|---|---|---|---|---|---|---|
| AI7503000993_1352042_c2_777 | 2145 | 5917 | 180 | 59 | | |

Description
NO-HIT

| ORF Name | NT ID | AA ID | NT LN | AA LN | Score | P-Value |
|---|---|---|---|---|---|---|
| AI7503000993_13678452_c1_628 | 2146 | 5918 | 1263 | 420 | 438 | 2.9e-41 |

Description
sp:[LN:ECSB_BACSU] [AC:P55340] [GN:ECSB:PRST] [OR:*BACILLUS SUBTILIS*]
[DE:PROTEIN ECSB] [SP:P55340] [DB:swissprot] >pir:[LN:G69619] [AC:G69619]

-continued

[PN:ABC transporter (membrane protein) ecsB] [GN:ecsB] [OR:*Bacillus subtilis*] [DB:pir2] >gp:[GI:e183450:g1177254] [LN:BSECSABCG] [AC:X87807] [PN:hypothetical EcsB protein] [GN:ecsB] [OR:*Bacillus subtilis*] [DB:genpept-bct1] [DE:*B. subtilis* ecsA, ecsB, and ecsC genes.] [SP:P55340] [LE:984] [RE:2210] [DI:direct] >gp:[GI:e1183007:g2633341] [LN:BSUB0006] [AC:Z99109:AL009126] [PN:ABC transporter (membrane protein)] [GN:ecsB] [FN:regulates both components of the protein] [OR:*Bacillus subtilis*] [DB:genpept-bct1] [DE:*Bacillus subtilis* complete genome (section 6 of 21): from 999501 to 1209940.] [NT:alternate gene name: prsT, yhaC] [SP:P55340] [LE:78149] [RE:79375] [DI:direct] >gp:[GI:e324951:g2226114] [LN:BSY14077] [AC:Y14077] [PN:Hypothetical protein] [GN:yhaC] [OR:*Bacillus subtilis*] [DB:genpept-bct1] [DE:*Bacillus subitlis* 10.6 Kb chromosomal DNA:glyB-prsA region.] [NT:Identified as ecsB. Hypothetical integral membrane] [SP:P55340] [LE:1538] [RE:2764] [DI:complement]

| ORF Name | NT ID | AA ID | NT LN | AA LN | Score | P-Value |
|---|---|---|---|---|---|---|
| AI7503000993__13722338__c3__943 | 2147 | 5919 | 507 | 168 | 505 | 2.3e-48 |

Description
pir:[LN:F69992] [AC:F69992] [PN:thiol peroxidase homolog ytgI] [GN:ytgI] [CL:thiol peroxidase] [OR:*Bacillus subtilis*] [DB:pir2] >gp:[GI:e1185822:g2635433] [LN:BSUB0016] [AC:Z99119:AL009126] [GN:ytgI] [FN:unknown] [OR:*Bacillus subtilis*] [DB:genpept-bct1] [DE:*Bacillus subtilis* complete genome (section 16 of 21): from 2997771 to 3213410.] [NT:similar to thiol peroxidase] [LE:18998] [RE:19501] [DI:complement] >gp:[GI:g2293238] [LN:AF008220] [AC:AF008220] [PN:YtgI] [GN:ytgI] [OR:*Bacillus subtilis*] [DB:genpept-bct2] [DE:*Bacillus subtilis* rrnB-dnaB genomic region.] [NT:similarity to tagD protein from *V. cholerae*] [LE:160926] [RE:161429] [DI:direct]

| ORF Name | NT ID | AA ID | NT LN | AA LN | Score | P-Value |
|---|---|---|---|---|---|---|
| AI7503000993__13723318__c3__945 | 2148 | 5920 | 1149 | 382 | 1230 | 3.4e-125 |

Description
pir:[LN:JE0388] [AC:JE0388] [PN:alanine dehydrogenase,] [OR:*Enterobacter aerogenes*] [EC:1.4.1.1] [DB:pir3] >gp:[GI:d1041279:g4803749] [LN:AB013821] [AC:AB013821] [PN:alanine dehydrogenase] [GN:aladh] [OR:*Enterobacter aerogenes*] [SR:*Enterobacter aerogenes* DNA] [DB:genpept-bct1] [EC:1.4.1.1] [DE:*Enterobacter aerogenes* aladh gene for alanine dehydrogenase, complete cds.] [LE:174] [RE:1307] [DI:direct]

| ORF Name | NT ID | AA ID | NT LN | AA LN | Score | P-Value |
|---|---|---|---|---|---|---|
| AI7503000993__13787912__c3__891 | 2149 | 5921 | 1524 | 507 | 118 | 1.7e-05 |

Description
pir:[LN:D64924] [AC:D64924] [PN:hypothetical protein b1668] [OR:*Escherichia coli*] [DB:pir2] >gp:[GI:g1549279] [LN:ECUG8703] [AC:U68703] [OR:*Escherichia coli*] [DB:genpept-bct1] [DE:*Escherichia coli* K-12 MG1655 genome, ribC-pykF region.] [NT:hypothetical protein] [LE:4535] [RE:6139] [DI:direct] >gp:[GI:g1787957] [LN:AE000262] [AC:AE000262:U00096] [PN:orf, hypothetical protein] [GN:b1668] [FN:orf; Unknown] [OR:*Escherichia coli*] [DB:genpept-bct2] [DE:*Escherichia coli* K-12 MG1655 section 152 of 400 of the complete genome.] [NT:o534; This 534 aa ORF is 38 pct identical (6 gaps)] [LE:872] [RE:2476] [DI:direct]

| ORF Name | NT ID | AA ID | NT LN | AA LN | Score | P-Value |
|---|---|---|---|---|---|---|
| AI7503000993__13852187__f1__136 | 2150 | 5922 | 186 | 61 | 113 | 4.5e-06 |

Description
pir:[LN:S77632] [AC:577632:S52761] [PN:probable integrase] [GN:int] [OR:*Staphylococcus aureus* phage phi-13] [DB:pir2] >gp:[GI:g758229] [LN:PHI13INT] [AC:X82312] [PN:integrase] [GN:int] [FN:integration of phi-13 in *S. aureus* genome] [OR:Bacteriophage phi-13] [DB:genpept-phg] [DE:Bacteriophage phi-13 integrase gene.] [LE:461] [RE:1498] [DI:direct]

| ORF Name | NT ID | AA ID | NT LN | AA LN | Score | P-Value |
|---|---|---|---|---|---|---|
| AI7503000993__13939027__f3__560 | 2151 | 5923 | 186 | 61 | | |

Description
NO-HIT

| ORF Name | NT ID | AA ID | NT LN | AA LN | Score | P-Value |
|---|---|---|---|---|---|---|

| -continued | | | | | | |
|---|---|---|---|---|---|---|
| AI7503000993_14251933_f2_239 | 2152 | 5924 | 663 | 220 | 818 | 1.5e-81 |

Description
pir:[LN:A37146] [AC:A37146:A44901:S11354:C69699:I39962] [PN:ribosomal protein S4:ribosomal protein BS4 (rpsD)] [GN:rpsD] [CL:*Escherichia coli* ribosomal protein S4] [OR:*Bacillus subtilis*] [DB:pir2] >gp:[GI:g143467] [LN:BACRPSD] [AC:M59358:M34718] [PN:ribosomal protein S4] [GN:rpsD] [OR:*Bacillus subtilis*] [SR:*B. subtilis* (strain 168, isolate BR151) DNA] [DB:genpept-bct1] [DE:*B. subtilis* ribosomal protein S4 gene, complete cds and tyrosyl tRNA synthetase (tyrS) gene, 3' end.] [LE:756] [RE:1358] [DI:direct] >gp:[GI:e1185839:g2635450] [LN:BSUB0016] [AC:Z99119:AL009126] [PN:ribosomal protein S4 (BS4)] [GN:rpsD] [OR:*Bacillus subtilis*] [DB:genpept-bct1] [DE:*Bacillus subtilis* complete genome (section 16 of 21): from 2997771 to 3213410.] [SP:P21466] [LE:37035] [RE:37637] [DI:direct] >gp:[GI:g2293319] [LN:AF008220] [AC:AF008220] [PN:ribosomal protein S4] [GN:rpsD] [OR:*Bacillus subtilis*] [DB:genpept-bct2] [DE:*Bacillus subtilis* rrnB-dnaB genomic region.] [LE:142790] [RE:143392] [DI:complement]

| ORF Name | NT ID | AA ID | NT LN | AA LN | Score | P-Value |
|---|---|---|---|---|---|---|
| AI7503000993_14460877_c3_963 | 2153 | 5925 | 138 | 45 | 131 | 2.8e-08 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000993_14460882_c1_649 | 2154 | 5926 | 177 | 58 | 227 | 6.6e-19 |

Description
gp:[GI:g1022726] [LN:SHU35635] [AC:U35635] [PN:unknownl [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000993_14460932_c1_612 | 2155 | 5927 | 177 | 58 | 211 | 3.3e-17 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000993_14460932_f2_226 | 2156 | 5928 | 168 | 55 | 196 | 1.3e-15 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000993_14656327_c2_751 | 2157 | 5929 | 624 | 207 | 799 | 1.6e-79 |

Description
gp:[GI:g1916729] [LN:AF134905] [AC:AF134905:U76550] [PN:CadD] [GN:cadD] [OR:*Staphylococcus aureus*] [DB:genpept-bct2] [DE:*Staphylococcus aureus* plasmid pRW001 CadD (cadD) gene, complete cds.] [NT:confers low level cadmium resistance] [LE:2328] [RE:2957] [DI:direct]

| ORF Name | NT ID | AA ID | NT LN | AA LN | Score | P-Value |
|---|---|---|---|---|---|---|
| AI7503000993_14658152_f3_589 | 2158 | 5930 | 156 | 51 | | |

Description
NO-HIT

| ORF Name | NT ID | AA ID | NT LN | AA LN | Score | P-Value |
|---|---|---|---|---|---|---|
| AI7503000993_14742937_c2_774 | 2159 | 5931 | 231 | 76 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000993_14877316_f1_64 | 2160 | 5932 | 483 | 160 | 407 | 5.5e-38 |

Description
sp:[LN:YEBR_ECOLI] [AC:P76270:O07976:O07978] [GN:YEBR] [OR:*ESCHERICHIA COLI*]
[DE:HYPOTHETICAL 20.3 KD PROTEIN IN PRC-PPHA INTERGENIC REGION]
[SP:P76270:O07976:O07978] [DB:swissprot] >pir:[LN:H64944] [AC:H64944]
[PN:probable membrane protein b1832] [CL:hypothetical protein YKL069w]
[OR:*Escherichia coli*] [DB:pir2] >gp:[GI:d1016364:g1736473] [LN:D90826]
[AC:D90826:AB001340] [GN:YKL069W, YKL340] [OR:*Escherichia coli*]
[SR:*Escherichia coli* (strain:K12) DNA, clone_lib:*Kohara lambda* minise]
[DB:genpept-bct1] [DE:*E. coli* genomic DNA, Kohara clone #335 (40.9–41.3
min.).] [NT:ORF_ID:o335#13; similar to [SwissProt Accession] [LE:16795]
[RE:17346] [DI:complement] >gp:[GI:d1016369:g1736479] [LN:D90827]
[AC:D90827:AB001340] [GN:YKL069W, YKL340] [OR:*Escherichia coli*]
[SR:*Escherichia coli* (strain:K12) DNA, clone_lib:*Kohara lambda* minise]
[DB:genpept-bct1] [DE:*E. coli* genomic DNA, Kohara clone #336 (41.2–41.6
min.).] [NT:ORF_ID:o335#13; similar to [SwissProt Accession] [LE:2748]
[RE:3299] [DI:complement] >gp:[GI:g1788136] [LN:AE000277]
[AC:AE000277:U00096] [PN:orf, hypothetical protein] [GN:b1832] [FN:orf;
Unknown] [OR:*Escherichia coli*] [DB:genpept-bct2] [DE:*Escherichia coli* K-12
MG1655 section 167 of 400 of the complete genome.] [NT:f183; residues 72–127
are 57 pct identical to] [LE:7076] [RE:7627] [DI:complement]

| ORF Name | NT ID | AA ID | NT LN | AA LN | Score | P-Value |
|---|---|---|---|---|---|---|
| AI7503000993_14882928_c3_923 | 2161 | 5933 | 1098 | 365 | 1279 | 2.2e-130 |

Description
gp:[GI:e220317:g1177684] [LN:SXCCPA] [AC:X95439] [PN:chorismate mutase]
[GN:aroA] [OR:*Staphylococcus xylosus*] [DB:genpept-bct1] [EC:5.4.99.5]
[DE:*S. xylosus* aroA, ccpA, acuC and acuA genes.] [LE:<1] [RE:807] [DI:direct]

| ORF Name | NT ID | AA ID | NT LN | AA LN | Score | P-Value |
|---|---|---|---|---|---|---|
| AI7503000993_15650303_c3_882 | 2162 | 5934 | 207 | 68 | | |

| Description | | | | | | |
|---|---|---|---|---|---|---|
| NO-HIT | | | | | | |
| ORF Name | NT ID | AA ID | NT LN | AA LN | Score | P-Value |
| AI7503000993_163151_c3_886 | 2163 | 5935 | 1248 | 415 | 1800 | 1.3e-185 |

Description
sp:[LN:METK_STAAU] [AC:P50307] [GN:METK] [OR:*STAPHYLOCOCCUS AUREUS*]
[EC:2.5.1.6] [DE:ADENOSYLTRANSFERASE) (ADOMET SYNTHETASE)] [SP:P50307]
[DB:swissprot] >gp:[GI:g10203171] [LN:SAU36379] [AC:U36379]
[PN:S-adenosylmethionine synthetase] [FN:catalyses the synthesis of SAM]
[OR:*Staphylococcus aureus*] [DB:genpept-bct1] [DE:*Staphylococcus aureus*
S-adenosylmethionine synthetase gene, complete cds.] [NT:SAM synthetase]
[LE:212] [RE:1405] [DI:direct]

| ORF Name | NT ID | AA ID | NT LN | AA LN | Score | P-Value |
|---|---|---|---|---|---|---|
| AI7503000993_16533442_c2_738 | 2164 | 5936 | 522 | 173 | 546 | 1.0e-52 |

Description
gp:[GI:g1381681] [LN:BSU58864] [AC:U58864] [PN:CspR] [GN:cspR] [OR:*Bacillus
subtilis*] [SR:*Bacillus subtilis* strain=JH642] [DB:genpept-bct1] [DE:*Bacillus
subtilis* methylase homolog (cspR) gene, complete cds.] [NT:methylase
homolog] [LE:573] [RE:1046] [DI:direct]

| ORF Name | NT ID | AA ID | NT LN | AA LN | Score | P-Value |
|---|---|---|---|---|---|---|
| AI7503000993_16586012_f2_308 | 2165 | 5937 | 588 | 195 | 456 | 3.5e-43 |

Description
pir:[LN:E69999] [AC:E69999] [PN:hypothetical protein ytqB] [GN:ytqB]
[OR:*Bacillus subtilis*] [DB:pir2] >gp:[GI:e1185922:g2635533] [LN:BSUB0016]
[AC:Z99119:AL009126] [GN:ytqB] [FN:unknown] [OR:*Bacillus subtilis*]
[DB:genpept-bct1] [DE:*Bacillus subtilis* complete genome (section 16 of 21):
from 2997771 to 3213410.] [LE:122275] [RE:122859] [DI:direct]
>gp:[GI:g2293301] [LN:AF008220] [AC:AF008220] [PN:YtqB] [GN:ytqB]
[OR:*Bacillus subtilis*] [DB:genpept-bct2] [DE:*Bacillus subtilis* rrnB-dnaB -continued genomic region.] [LE:57568] [RE:58152] [DI:complement]

| ORF Name | NT ID | AA ID | NT LN | AA LN | Score | P-Value |
|---|---|---|---|---|---|---|
| AI7503000993_165908_f2_353 | 2166 | 5938 | 507 | 168 | 182 | 3.8e-14 |

Description
sp:[LN:YHGC_BACSU] [AC:P38049] [GN:YHGC] [OR:*BACILLUS SUBTILIS*]
[DE:HYPOTHETICAL 18.8 KD PROTEIN IN ECSC-PBPF INTERGENIC REGION] [SP:P38049]
[DB:swissprot] >pir:[LN:B40614] [AC:B40614:F69832] [PN:conserved
hypothetical protein yhgC:hypothetical protein X (pbpF 5' region)] [GN:yhgC]
[OR:*Bacillus subtilis*] [DB:pir2] >gp:[GI:g304160] [LN:BACPBPF] [AC:L10630]
[OR:*Bacillus subtilis*] [SR:*Bacillus subtilis* (strain W168) DNA]
[DB:genpept-bct1] [DE:*Bacillus subtilis* penicillin-binding protein (pbpF)
gene, 5' end.] [NT:product unknown] [LE:247] [RE:747] [DI:complement]
>gp:[GI:e1183012:g2633346] [LN:BSUB0006] [AC:Z99109:AL009126] [GN:yhgC]
[FN:unknown] [OR:*Bacillus subtilis*] [DB:genpept-bct1] [DE:*Bacillus subtilis*
complete genome (section 6 of 21): from 999501 to 1209940.] [NT:alternate
gene name: yixC; similar to hypothetical] [SP:P38049] [LE:83202] [RE:83702]
[DI:complement] >gp:[GI:e325006:g2226228] [LN:BSY14083] [AC:Y14083]
[PN:Hypothetical protein] [GN:yixC] [OR:*Bacillus subtilis*] [DB:genpept-bct1]
[DE:*Bacillus subtilis* chromosomal DNA, region 76–78 degrees:
between glyB-aprE.] [NT:See Swiss Prot P38049; YIXC_BACSU] [SP:P38049]
[LE:3061] [RE:3561] [DI:complement]

| ORF Name | NT ID | AA ID | NT LN | AA LN | Score | P-Value |
|---|---|---|---|---|---|---|
| AI7503000993_16835053_c2_758 | 2167 | 5939 | 168 | 55 | | |

Description
NO-HIT

| ORF Name | NT ID | AA ID | NT LN | AA LN | Score | P-Value |
|---|---|---|---|---|---|---|
| AI7503000993_16994043_c3_933 | 2168 | 5940 | 1128 | 375 | 81 | 0.0062 |

Description
pir:[LN:E69106] [AC:E69106] [PN:hypothetical protein MTH1793] [GN:MTH1793]
[OR:*Methanobacterium thermoautotrophicum*] [DB:pir2] >gp:[GI:g2622925]
[LN:AE000934] [AC:AE000934:AE000666] [PN:unknown] [GN:MTH1793]
[OR:*Methanobacterium thermoautotrophicum*] [DB:genpept-bct2]
[DE:*Methanobacterium thermoautotrophicum* from bases 1640298 to
1655421 (section 140 of 148) of the complete genome.] [NT:Function Code:14.00-
Unknown, ; similar to,] [LE:89] [RE:790] [DI:complement]

| ORF Name | NT ID | AA ID | NT LN | AA LN | Score | P-Value |
|---|---|---|---|---|---|---|
| AI7503000993_189437_f1_34 | 2169 | 5941 | 144 | 47 | | |

Description
NO-HIT

| ORF Name | NT ID | AA ID | NT LN | AA LN | Score | P-Value |
|---|---|---|---|---|---|---|
| AI7503000993_191713_c3_904 | 2170 | 5942 | 11091 | 3696 | 1884 | 6.9e-195 |

Description
gp:[GI:e286140:g4775551] [LN:SACTORF13] [AC:Y09928] [OR:*Staphylococcus
aureus*] [DB:genpept-bct1] [DE:*S. aureus* CTORF1365, partial.] [NT:CT0RF1365]
[LE:<1] [RE:>3982] [DI:direct]

| ORF Name | NT ID | AA ID | NT LN | AA LN | Score | P-Value |
|---|---|---|---|---|---|---|
| AI7503000993_19565876_c3_915 | 2171 | 5943 | 201 | 66 | | |

Description
NO-HIT

| ORF Name | NT ID | AA ID | NT LN | AA LN | Score | P-Value |
|---|---|---|---|---|---|---|
| AI7503000993_1960937_c3_964 | 2172 | 5944 | 177 | 58 | 228 | 5.1e-19 |

Description
gp:[GI:g1022726] [LN:SHU35635] [AC:U35635] [PN:unknown] [OR:*Staphylococcus
haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000993_19742842_c2_769 | 2173 | 5945 | 849 | 282 | 776 | 4.4e-77 |

Description
pir:[LN:C70040] [AC:C70040] [PN:plant-metabolite dehydrogenase homolog yvgN] [GN:yvgN] [CL:aldehyde reductase] [OR:*Bacillus subtilis*] [DB:pir2] >gp:[GI:e1249784:g2832788] [LN:BS43KBDNA] [AC:AJ223978] [PN:putative reductase protein, YvgN] [GN:yvgN] [OR:*Bacillus subtilis*] [DB:genpept-bct1] [DE:*Bacillus subtilis* 42.7kB DNA fragment from yvsA to yvqA.] [LE:646] [RE:1476] [DI:direct] >gp:[GI:e1186028:g2635853] [LN:BSUB0018] [AC:Z99121:AL009126] [GN:yvgN] [FN:unknown] [OR:*Bacillus subtilis*] [DB:genpept-bct1] [DE:*Bacillus subtilis* complete genome (section 18 of 21): from 3399551 to 3609060.] [NT:alternate gene name:yvsB; similar to] [LE:26261] [RE:27091] [DI:complement]

| ORF Name | NT ID | AA ID | NT LN | AA LN | Score | P-Value |
|---|---|---|---|---|---|---|
| AI7503000993_19770437_c2_830 | 2174 | 5946 | 1332 | 443 | 1018 | 9.9e-103 |

Description
pir:[LN:A69998] [AC:A69998] [PN:hypothetical protein ytoI] [GN:ytoI] [OR:*Bacillus subtilis*] [DB:pir2] >gp:[GI:e1184176:g2635392] [LN:BSUB0015] [AC:Z99118:AL009126] [GN:ytoI] [FN:unknown] [OR:*Bacillus subtilis*] [DB:genpept-bct1] [DE:*Bacillus subtilis* complete genome (section 15 of 21): from 2795131 to 3013540.] [LE:201244] [RE:202563] [DI:complement] >gp:[GI:g2293258] [LN:AF008220] [AC:AF008220] [PN:YtoI] [GN:ytoI] [OR:*Bacillus subtilis*] [DB:genpept-bct2] [DE:*Bacillus subtilis* rrnB-dnaB genomic region.] [NT:similarity with hypothetical protein 3 from] [LE:180504] [RE:181823] [DI:direct]

| ORF Name | NT ID | AA ID | NT LN | AA LN | Score | P-Value |
|---|---|---|---|---|---|---|
| AI7503000993_1991325_f3_469 | 2175 | 5947 | 219 | 72 | | |

Description
NO-HIT

| ORF Name | NT ID | AA ID | NT LN | AA LN | Score | P-Value |
|---|---|---|---|---|---|---|
| AI7503000993_19922162_c3_857 | 2176 | 5948 | 1161 | 386 | 527 | 1.1e-50 |

Description
gp:[GI:g3688818] [LN:AF084104] [AC:AF084104] [PN:hypothetical protein] [OR:*Bacillus firmus*] [DB:genpept-bct2] [DE:*Bacillus firmus* AcsA (acsA) gene, partial cds; SspA (sspA), hypothetical protein, maltose transportor ATP-binding protein (malK), leucine-rich protein transcriptional regulator (lrpR), hypothetical proteins, ABC transporter ATP-binding protein (natC), NatA (natA), NatB (natB), and hypothetical protein genes, complete cds; and SpoIIIJ (spoIIIJ) gene, partial cds.] [NT:Orf10; similar to hypothetical protein YheB from] [LE:5845] [RE:6957] [DI:direct]

| ORF Name | NT ID | AA ID | NT LN | AA LN | Score | P-Value |
|---|---|---|---|---|---|---|
| AI7503000993_1992943_f3_561 | 2177 | 5949 | 747 | 248 | 104 | 2.3e-05 |

Description
gp:[GI:g160225] [LN:PFACSPI] [AC:M18821] [PN:circumsporozoite protein] [GN:CSP] [OR:*Plasmodium yoelii*] [SR:*Plasmodium yoelii* (strain 17X NL) DNA] [DB:genpept-inv1] [DE:*Plasmodium yoelii* circumsporozoite protein (CSP) gene, 5' end.] [NT:precursor] [LE:1] [RE:>420] [DI:direct]

| ORF Name | NT ID | AA ID | NT LN | AA LN | Score | P-Value |
|---|---|---|---|---|---|---|
| AI7503000993_20365892_c1_731 | 2178 | 5950 | 150 | 49 | | |

Description
NO-HIT

| ORF Name | NT ID | AA ID | NT LN | AA LN | Score | P-Value |
|---|---|---|---|---|---|---|
| AI7503000993_2051502_f2_250 | 2179 | 5951 | 159 | 52 | | |

Description
NO-HIT

-continued

| ORF Name | NT ID | AA ID | NT LN | AA LN | Score | P-Value |
|---|---|---|---|---|---|---|
| AI7503000993_20706557_c3_860 | 2180 | 5952 | 1254 | 417 | 592 | 1.4e-57 |

Description
pir:[LN:A69819] [AC:A69819] [PN:probable phosphoesterase, yhaO] [GN:yhaO]
[CL:unassigned probable phosphoesterases:phosphoesterase core homology]
[OR:*Bacillus subtilis*] [EC:3.1.—.—] [DB:pir2] >gp:[GI:e1182993:g2633327]
[LN:BSUB0006] [AC:Z99109:AL009126] [GN:yhaO] [FN:unknown] [OR:*Bacillus subtilis*] [DB:genpept-bct1] [DE:*Bacillus subtilis* complete genome (section 6 of 21): from 999501 to 1209940.] [NT:similar to hypothetical proteins]
[LE:64822] [RE:66048] [DI:direct] >gp:[GI:e324934:g2226129] [LN:BSY14078]
[AC:Y14078] [PN:Hypothetical protein] [GN:yhaO] [OR:*Bacillus subtilis*]
[DB:genpept-bct1] [DE:*Bacillus subtilis* 8.7 Kb chromosomal DNA:downstream
glyB-prsA region.] [NT:similarity to exonuclease sbcD from *Escherichia*]
[LE:4292] [RE:5518] [DI:complement]

| ORF Name | NT ID | AA ID | NT LN | AA LN | Score | P-Value |
|---|---|---|---|---|---|---|
| AI7503000993_20834812_f2_339 | 2181 | 5953 | 306 | 101 | 86 | 0.0039 |

Description
pir:[LN:S77632] [AC:S77632:S52761] [PN:probable integrase] [GN:int]
[OR:*Staphylococcus aureus* phage phi-13] [DB:pir2] >gp:[GI:g758229]
[LN:PHI13INT] [AC:X82312] [PN:integrase] [GN:int] [FN:integration of phi-13
in *S. aureus* genome] [OR:*Bacteriophage* phi-13] [DB:genpept-phg]
[DE:*Bacteriophage* phi-13 integrase gene.] [LE:461] [RE:1498] [DI:direct]

| ORF Name | NT ID | AA ID | NT LN | AA LN | Score | P-Value |
|---|---|---|---|---|---|---|
| AI7503000993_20901713_c3_939 | 2182 | 5954 | 1707 | 568 | 613 | 8.2e-60 |

Description
pir:[LN:G70002] [AC:G70002] [PN:hypothetical protein ytwP] [GN:ytwP]
[OR:*Bacillus subtilis*] [DB:pir2] >gp:[GI:e1185834:g2635445] [LN:BSUB0016]
[AC:Z99119:AL009126] [GN:ytwP] [FN:unknown] [OR:*Bacillus subtilis*]
[DB:genpept-bct1] [DE:*Bacillus subtilis* complete genome (section 16 of 21):
from 2997771 to 3213410.] [LE:31035] [RE:32723] [DI:complement]
>gp:[GI:g2293228] [LN:AF008220] [AC:AF008220] [PN:YtwP] [GN:ytwP]
[OR:*Bacillus subtilis*] [DB:genpept-bct2] [DE:*Bacillus subtilis* rrnB-dnaB
genomic region.] [NT:similarity to fcrA protein precursor from] [LE:147704]
[RE:149392] [DI:direct]

| ORF Name | NT ID | AA ID | NT LN | AA LN | Score | P-Value |
|---|---|---|---|---|---|---|
| AI7503000993_20947781_f2_348 | 2183 | 5955 | 126 | 41 | | |

Description
NO-HIT

| ORF Name | NT ID | AA ID | NT LN | AA LN | Score | P-Value |
|---|---|---|---|---|---|---|
| AI7503000993_2115812_f2_222 | 2184 | 5956 | 1113 | 370 | 843 | 3.5e-84 |

Description
pir:[LN:G69869] [AC:G69869] [PN:Xaa-Pro dipeptidase homolog ykvY] [GN:ykvY]
[CL:X-Pro aminopeptidase] [OR:*Bacillus subtilis*] [DB:pir2]
>gp:[GI:e1184976:g2633757] [LN:BSUB0008] [AC:Z99111:AL009126] [GN:ykvY]
[FN:unknown] [OR:*Bacillus subtilis*] [DB:genpept-bct1] [DE:*Bacillus subtilis*
complete genome (section 8 of 21): from 1394791 to 1603020.] [NT:similar to
Xaa-Pro dipeptidase] [LE:58367] [RE:59458] [DI:direct]

| ORF Name | NT ID | AA ID | NT LN | AA LN | Score | P-Value |
|---|---|---|---|---|---|---|
| AI7503000993_2117077_f3_536 | 2185 | 5957 | 366 | 121 | 195 | 1.6e-15 |

Description
pir:[LN:A70341] [AC:A70341] [PN:conserved hypothetical protein aq_449]
[GN:aq_449] [CL:hypothetical protein MJ1523] [OR:*Aquifex aeolicus*]
[DB:pir2] >gp:[GI:g2983116] [LN:AE000690] [AC:AE000690:AE000657]
[PN:hypothetical protein] [GN:aq_449] [OR:*Aquifex aeolicus*]
[DB:genpept-bct2] [DE:*Aquifex aeolicus* section 22 of 109 of the complete
genome.] [LE:10789] [RE:11163] [DI:direct]

| ORF Name | NT ID | AA ID | NT LN | AA LN | Score | P-Value |
|---|---|---|---|---|---|---|
| AI7503000993_2126250_f2_305 | 2186 | 5958 | 210 | 69 | | |

-continued

| ORF Name | NT ID | AA ID | NT LN | AA LN | Score | P-Value |
|---|---|---|---|---|---|---|
| | | | | | | |

Description
NO-HIT

| ORF Name | NT ID | AA ID | NT LN | AA LN | Score | P-Value |
|---|---|---|---|---|---|---|
| AI7503000993_21491462_c1_722 | 2187 | 5959 | 1161 | 386 | 1188 | 9.6e-121 |

Description
sp:[LN:CISZ_BACSU] [AC:P39120:O34435] [GN:CITZ:CITA2] [OR:*BACILLUS SUBTILIS*]
[EC:4.1.3.7] [DE:CITRATE SYNTHASE II,] [SP:P39120:O34435] [DB:swissprot]
>pir:[LN:G69600] [AC:G69600:I40381] [:PN:citrate synthase II,] [GN:citZ]
[CL:citrate (si)-synthase] [OR:*Bacillus subtilis*] [EC:4.1.3.—] [DB:pir2]
>gp:[GI:e1184163:g2635379] [LN:BSUB0015] [AC:Z99118:AL009126] [PN:citrate
synthase II] [GN:citZ] [OR:*Bacillus subtilis*] [DB:genpept-bct1] [EC:4.1.3.7]
[DE:*Bacillus subtilis* complete genome (section 15 of 21): from 2795131 to
3013540.] [NT:alternate gene name: citA2] [SP:P39120] [LE:185094]
[RE:186212] [DI:complement] >gp:[g2293267] [LN:AF008220] [AC:AF008220]
[PN:citrate synthase subunit II] [GN:citZ] [OR:*Bacillus subtilis*]
[DB:genpept-bct2] [DE:*Bacillus subtilis* rrnB-dnaB genomic region.]
[LE:196855] [RE:197973] [DI:direct]

| ORF Name | NT ID | AA ID | NT LN | AA LN | Score | P-Value |
|---|---|---|---|---|---|---|
| AI7503000993_21520887_c2_781 | 2188 | 5960 | 135 | 44 | | |

Description
NO-HIT

| ORF Name | NT ID | AA ID | NT LN | AA LN | Score | P-Value |
|---|---|---|---|---|---|---|
| AI7503000993_21522010_f2_331 | 2189 | 5961 | 1725 | 574 | 2393 | 2.0e-248 |

Description
sp:[LN:PPCK_STAAU] [AC:P51065] [GN:PCKA] [OR:*STAPHYLOCOCCUS AUREUS*]
[EC:4.1.1.49] [DE:PHOSPHOENOLPYRUVATE CARBOXYKINASE [ATP],] [SP:P51065]
[DB:swissprot] >gp:[GI:g1255262] [LN:SAU51133] [AC:U51133]
[PN:phosphoenolpyruvate carboxykinase] [GN:pcka] [OR:*Staphylococcus aureus*]
[DB:genpept-bct1] [DE:*Staphylococcus aureus* phosphoenolpyruvate
carboxykinase (pcka) gene, complete cds.] [LE:160] [RE:1752] [DI:direct]
>gp:[GI:g860732] [LN:STAPEPCK] [AC:L42943] [PN:phosphoenolpyruvate
carboxykinase] [GN:pckA] [OR:*Staphylococcus aureus*] [DB:genpept-bct1]
[EC:4.1.1.32] [DE:*Staphylococcus aureus* (clone KIN50)
phosphoenolpyruvatecarboxykinase (pckA) gene, complete cds.] [NT:PEPCK;
homologue] [LE:409] [RE:2001] [DI:direct]

| ORF Name | NT ID | AA ID | NT LN | AA LN | Score | P-Value |
|---|---|---|---|---|---|---|
| AI7503000993_21523400_f2_356 | 2190 | 5962 | 162 | 53 | | |

Description
NO-HIT

| ORF Name | NT ID | AA ID | NT LN | AA LN | Score | P-Value |
|---|---|---|---|---|---|---|
| AI7503000993_21645967_f3_575 | 2191 | 5963 | 993 | 330 | 368 | 7.5e-34 |

Description
sp:[LN:PRSA_BACSU] [AC:P24327] [GN:PRSA] [OR:*BACILLUS SUBTILIS*] [DE:PROTEIN
EXPORT PROTEIN PRSA PRECURSOR] [SP:P24327] [DB:swissprot] >pir:[LN:S15269]
[AC:S15269:I40003:H69682] [PN:post-translocation molecular chaperone
prsA:33K lipoprotein prsA] [GN:prsA] [OR:*Bacillus subtilis*] [DB:pir2]
>gp:[GI:g39782] [LN:BS33KDA] [AC:X57271:S67658] [PN:33kDa lipoprotein]
[GN:prsA] [OR:*Bacillus subtilis*] [DB:genpept-bct1] [DE:*B. subtilis* prsA gene
for a 33kDa lipoprotein.] [SP:P24327] [LE:63] [RE:941] [DI:direct]
>gp:[GI:e1182997:g2633331] [LN:BSUB0006] [AC:Z99109:AL009126] [PN:molecular
chaperonin] [GN:prsA] [FN:essential for the stability of secreted]
[OR:*Bacillus subtilis*] [DB:genpept-bct1] [DE:*Bacillus subtilis* complete
genome (section 6 of 21): from 999501 to 1209940.] [SP:P24327] [LE:70340]
[RE:71218] [DI:complement] >gp:[GI:e325181:g2226124] [LN:BSY14077]
[AC:Y14077] [PN:33kDa lipoprotein] [GN:prsA] [OR:*Bacillus subtilis*]
[DB:genpept-bct1] [DE:*Bacillus subitlis* 10.6 Kb chromosomal DNA:glyB-prsA
region.] [NT:See Swiss Prot P24327] [SP:P24327] [LE:9695] [RE:10573]
[DI:direct]

| ORF Name | NT ID | AA ID | NT LN | AA LN | Score | P-Value |
|---|---|---|---|---|---|---|
| AI7503000993_2189718_f3_412 | 2192 | 5964 | 1371 | 456 | 1309 | 1.4e-133 |

-continued

Description
sp:[LN:CYCA_ECOLI] [AC:P39312] [GN:CYCA:DAGA] [OR:*ESCHERICHIA COLI*]
[DE:D-SERINE/D-ALANINE/GLYCINE TRANSPORTER] [SP:P39312] [DB:swissprot]
>pir:[LN:S56433] [AC:S56433:C65232] [PN:d-serine/d-alanine/glycine
transporter] [GN:cycA] [CL:arginine permease] [OR:*Escherichia coli*]
[DB:pir2] >gp:[GI:g537049] [LN:ECOUW93] [AC:U14003] [OR:*Escherichia coli*]
[DB:genpept-bct1] [DE:*Escherichia coli* K-12 chromosomal region from 92.8 to
00.1 minutes.] [NT:ORF_o470] [LE:120696] [RE:122108] [DI:direct]
>gp:[GI:g1790653] [LN:AE000492] [AC:AE000492:U00096] [PN:transport of
D-alanine, D-serine, and glycine] [GN:cycA] [FN:transport; Transport of
small molecules:Amino] [OR:*Escherichia coli*] [DB:genpept-bct2]
[DE:*Escherichia coli* K-12 MG1655 section 382 of 400 of the complete genome.]
[NT:o470; 100 pct identical amino acid sequence and] [LE:2436] [RE:3848]
[DI:direct]

| ORF Name | NT ID | AA ID | NT LN | AA LN | Score | P-Value |
|---|---|---|---|---|---|---|
| AI7503000993_22078331_f3_564 | 2193 | 5965 | 252 | 83 | | |

Description
NO-HIT

| ORF Name | NT ID | AA ID | NT LN | AA LN | Score | P-Value |
|---|---|---|---|---|---|---|
| AI7503000993_22164757_f2_244 | 2194 | 5966 | 132 | 43 | | |

Description
NO-HIT

| ORF Name | NT ID | AA ID | NT LN | AA LN | Score | P-Value |
|---|---|---|---|---|---|---|
| AI7503000993_22271932_c1_651 | 2195 | 5967 | 132 | 43 | | |

Description
NO-HIT

| ORF Name | NT ID | AA ID | NT LN | AA LN | Score | P-Value |
|---|---|---|---|---|---|---|
| AI7503000993_22277327_c3_968 | 2196 | 5968 | 1371 | 456 | 496 | 2.0e-47 |

Description
sp:[LN:DNAB_BACSU] [AC:P07908] [GN:DNAB] [OR:*BACILLUS SUBTILIS*]
[DE:REPLICATION INITIATION AND MEMBRANE ATTACHMENT PROTEIN] [SP:P07908]
[DB:swissprot] >pir:[LN:B26580] [AC:B26580:A24720:A69617] [PN:chromosome
replication initiation/membrane attachment protein dnaB:dnaB protein]
[GN:dnaB] [OR:*Bacillus subtilis*] [DB:pir2] >gp:[GI:g142863] [LN:BACDNAB]
[AC:M15183] [PN:replication initiation protein] [GN:dnaB] [OR:*Bacillus
subtilis*] [SR:*Bacillus subtilis* (sub_strain PY79, strain W168) DNA]
[DB:genpept-bct1] [DE:*B. subtilis* dnaB gene, encoding the replication
initiation and membrane attachment protein, complete cds, clone pdnaB12.]
[NT:The part of the protein encoded by 634–693 binds to] [LE:397] [RE:1815]
[DI:direct] >gp:[GI:e1184148:g2635364] [LN:BSUB0015] [AC:Z99118:AL009126]
[PN:membrane attachment protein] [GN:dnaB] [FN:initiation of chromosome
replication (DNA)] [OR:*Bacillus subtilis*] [DB:genpept-bct1] [DE:*Bacillus
subtilis* complete genome (section 15 of 21): from 2795131 to 3013540.]
[LE:168092] [RE:169510] [DI:complement] >gp:[GI:e1165285:g1769995]
[LN:BSZ75208] [AC:Z75208] [PN:replication initiation protein] [GN:dnaB]
[OR:*Bacillus subtilis*] [DB:genpept-bct1] [DE:*B. subtilis* genomic sequence
89009bp.] [NT:the part of the protein encoded by 634–693 binds to]
[SP:P07908] [LE:397] [RE:1815] [DI:direct] >gp:[GI:g2293280] [LN:AF008220]
[AC:AF008220] [PN:DnaB] [GN:dnaB] [OR:*Bacillus subtilis*] [DB:genpept-bct2]
[DE:*Bacillus subtilis* rrnB-dnaB genomic region.] [LE:213557] [RE:214975]
[DI direct]

| ORF Name | NT ID | AA ID | NT LN | AA LN | Score | P-Value |
|---|---|---|---|---|---|---|
| AI7503000993_22391432_f3_562 | 2197 | 5969 | 525 | 174 | 288 | 2.3e-25 |

Description
pir:[LN:S77632] [AC:S77632:S52761] [PN:probable integrase] [GN:int]
[OR:*Staphylococcus aureus* phage phi-13] [DB:pir2] >gp:[GI:g758229]
[LN:PHI13INT] [AC:X82312] [PN:integrase] [GN:int] [FN:integration of phi-13
in *S. aureus* genome] [OR:Bacteriophage phi-13] [DB:genpept-phg]
[DE:Bacteriophage phi-13 integrase gene.] [LE:461] [RE:1498] [DI:direct]

| ORF Name | NT ID | AA ID | NT LN | AA LN | Score | P-Value |
|---|---|---|---|---|---|---|
| AI7503000993_22459692_f1_125 | 2198 | 5970 | 201 | 66 | | |

| Description | | | | | | |
|---|---|---|---|---|---|---|
| NO-HIT | | | | | | |
| ORF Name | NT ID | AA ID | NT LN | AA LN | Score | P-Value |
| AI7503000993__22664125__c2__832 | 2199 | 5971 | 165 | 54 | | |

| Description | | | | | | |
|---|---|---|---|---|---|---|
| NO-HIT | | | | | | |
| ORF Name | NT ID | AA ID | NT LN | AA LN | Score | P-Value |
| AI7503000993__23438837__f3__600 | 2200 | 5972 | 132 | 43 | | |

| Description | | | | | | |
|---|---|---|---|---|---|---|
| NO-HIT | | | | | | |
| ORF Name | NT ID | AA ID | NT LN | AA LN | Score | P-Value |
| AI7503000993__23468812__f1__141 | 2201 | 5973 | 129 | 42 | | |

| Description | | | | | | |
|---|---|---|---|---|---|---|
| NO-HIT | | | | | | |
| ORF Name | NT ID | AA ID | NT LN | AA LN | Score | P-Value |
| AI7503000993__23485443__c1__709 | 2202 | 5974 | 1239 | 412 | 931 | 1.6e-93 |

Description
sp:[LN:THII_BACSU] [AC:O34595] [GN:THII] [OR:*BACILLUS SUBTILIS*] [DE:PROBABLE
THIAMIN BIOSYNTHESIS PROTEIN THII] [SP:O34595] [DB:swissprot]
>pir:[LN:E69988] [AC:E69988] [PN:conserved hypothetical protein ytbJ]
[GN:ytbJ] [CL:*Mycoplasma genitalium* hypothetical protein MG372]
[OR:*Bacillus subtilis*] [DB:pir2] >gp:[GI:e1185831:g2635442] [LN:BSUB0016]
[AC:Z99119:AL009126] [GN:ytbJ] [FN:unknown] [OR:*Bacillus subtilis*]
[DB:genpept-bct1] [DE:*Bacillus subtilis* complete genome (section 16 of 21):
from 2997771 to 3213410.] [NT:similar to hypothetical proteins] [SP:O34595]
[LE:27183] [RE:28259] [DI:complement] >gp:[GI:g2293230] [LN:AF008220]
[AC:AF008220] [PN:YtbJ] [GN:ytbJ] [OR:*Bacillus subtilis*] [DB:genpept-bct2]
[DE:*Bacillus subtilis* rrnB-dnaB genomic region.] [NT:similar to hypothetical
protein MG372 from M.] [LE:152168] [RE:153244] [DI:direct]

| ORF Name | NT ID | AA ID | NT LN | AA LN | Score | P-Value |
|---|---|---|---|---|---|---|
| AI7503000993__23489090__c2__835 | 2203 | 5975 | 1038 | 345 | 1033 | 2.5e-104 |

Description
sp:[LN:KGPF_BACSU] [AC:O34529] [GN:PFKA:PFK] [OR:*BACILLUS SUBTILIS*]
[EC:2.7.1.11] [DE:(PHOSPHOHEXOKINASE)] [SP:O34529] [DB:swissprot]
>pir:[LN:A69675] [AC:A69675] [PN:6-phosphofructokinase pfk] [GN:pfk]
[CL:6-phosphofructokinase:6-phosphofructokinase 1 homology] [OR:*Bacillus
subtilis*] [DB:pir2] >gp:[GI:e1184168:g2635384] [LN:BSUB0015]
[AC:Z99118:AL009126] [PN:6-phosphofructokinase] [GN:pfk] [FN:glycolysis]
[OR:*Bacillus subtilis*] [DB:genpept-bct1] [EC:2.7.1.11] [DE:*Bacillus subtilis*
complete genome (section 15 of 21): from 2795131 to 3013540.] [SP:O34529]
[LE:190531] [RE:191490] [DI:complement] >gp:[GI:g2293264] [LN:AF008220]
[AC:AF008220] [PN:G-phosphofructokinase] [GN:pfk] [OR:*Bacillus subtilis*]
[DB:genpept-bct2] [DE:*Bacillus subtilis* rrnB-dnaB genomic region.]
[LE:191577] [RE:192536] [DI:direct]

| ORF Name | NT ID | AA ID | NT LN | AA LN | Score | P-Value |
|---|---|---|---|---|---|---|
| AI7503000993__23555302__f2__233 | 2204 | 5976 | 387 | 128 | 91 | 0.00083 |

Description
gp:[GI:e1363147:g4127385] [LN:APR011678] [AC:AJ011678] [PN:immunodominant
protein] [OR:Apple proliferation phytoplasma] [DB:genpept-bct1] [DE:Apple
proliferation phytoplasma immunodominant protein gene, strainAT.] [LE:885]
[RE:1382] [DI:direct]

| ORF Name | NT ID | AA ID | NT LN | AA LN | Score | P-Value |
|---|---|---|---|---|---|---|
| AI7503000993__23601713__c3__894 | 2205 | 5977 | 1194 | 397 | 1108 | 2.9e-112 |

Description
sp:[LN:GCH2_BACAM] [AC:P51695] [GN:RIBA] [OR:*BACILLUS AMYLOLIQUEFACIENS*]
[EC:3.5.4.25] [DE:PHOSPHATE SYNTHASE (DHBP SYNTHASE)] [SP:P51695]
[DB:swissprot] >gp:[GI:e223994:g1212775] [LN:BARIBGENS] [AC:X95955]
[PN:3,4-dihydroxy-2-butanone 4-phosphate synthase] [GN:ribA] [OR:*Bacillus*

*amyloliquefaciens*] [DB:genpept-bct1] [DE:*B. amyloliquefaciens* ribB, ribG, ribA, ribH & ribT genes.] [NT:GTP cyclohydrolase II] [SP:P51695] [LE:2411] [RE:3607] [DI:direct]

| ORF Name | NT ID | AA ID | NT LN | AA LN | Score | P-Value |
|---|---|---|---|---|---|---|
| AI7503000993_23603375_f2_219 | 2206 | 5978 | 417 | 138 | 139 | 1.4e-09 |

Description
sp:[LN:Y577_METJA] [AC:Q57997] [GN:MJ0577] [OR:*METHANOCOCCUS JANNASCHII*] [DE:PROTEIN MJ0577] [SP:Q57997] [DB:swissprot] >pir:[LN:A64372] [AC:A64372] [PN:hypothetical protein homolog MJ0577] [CL:*Escherichia coli* ybdQ protein] [OR:*Methanococcus jannaschii*] [DB:pir2] [MP:FOR512975-513463] >gp:[GI:g1591284] [LN:U67506] [AC:U67506:L77117] [PN:conserved hypothetical protein] [GN:MJ0577] [OR:*Methanococcus jannaschii*] [DB:genpept-bct2] [DE:*Methanococcus jannaschii* section 48 of 150 of the complete genome.] [NT:similar to SP:P42297 PID:603780 PID:849027] [LE:8204] [RE:8692] [DI:direct]

| ORF Name | NT ID | AA ID | NT LN | AA LN | Score | P-Value |
|---|---|---|---|---|---|---|
| AI7503000993_2362587_f2_321 | 2207 | 5979 | 150 | 49 | | |

Description
NO-HIT

| ORF Name | NT ID | AA ID | NT LN | AA LN | Score | P-Value |
|---|---|---|---|---|---|---|
| AI7503000993_23651567_c3_961 | 2208 | 5980 | 888 | 295 | 387 | 5.2e-41 |

Description
gp:[GI:d1025814:g2897751] [LN:AB008520] [AC:AB008520] [GN:mutM] [OR:*Thermus thermophilus*] [SR:*Thermus thermophilus* (strain:HB8) DNA] [DB:genpept-bct1] [DE:*Thermus thermophilus* MutM gene, complete cds.] [LE:297] [RE:1100] [DI:direct]

| ORF Name | NT ID | AA ID | NT LN | AA LN | Score | P-Value |
|---|---|---|---|---|---|---|
| AI7503000993_23694052_f2_359 | 2209 | 5981 | 603 | 200 | 82 | 0.0040 |

Description
pir:[LN:E69818] [AC:E69818] [PN:hypothetical protein yhaK] [GN:yhaK] [OR:*Bacillus subtilis*] [DB:pir2] >gp:[GI:e1182998:g2633332] [LN:BSUB0006] [AC:Z99109:AL009126] [GN:yhaK] [FN:unknown] [OR:*Bacillus subtilis*] [DB:genpept-bct1] [DE:*Bacillus subtilis* complete genome (section 6 of 21): from 999501 to 1209940.] [LE:72018] [RE:72272] [DI:complement] >gp:[GI:e324957:g2226123] [LN:BSY14077] [AC:Y14077] [PN:Hypothetical protein] [GN:yhaK] [OR:*Bacillus subtilis*] [DB:genpept-bct1] [DE:*Bacillus subitlis* 10.6 Kb chromosomal DNA:glyB-prsA region.] [LE:8641] [RE:8895] [DI:direct]

| ORF Name | NT ID | AA ID | NT LN | AA LN | Score | P-Value |
|---|---|---|---|---|---|---|
| AI7503000993_23710885_f2_167 | 2210 | 5982 | 147 | 48 | 76 | 0.027 |

Description
pir:[LN:S72289] [AC:S72289] [PN:ribosomal protein L2] [GN:rpl2] [OR:plastid *Plasmodium falciparum*] [DB:pir2] >gp:[GI:e220178:g1171595] [LN:PFCOMPIRB] [AC:X95276] [GN:rpl2] [OR:*Plasmodium falciparum*] [SR:malaria parasite *P. falciparum*] [DB:genpept-inv1] [DE:*P. falciparum* complete gene map of plastid-like DNA (IR-B).] [LE:2799] [RE:3536] [DI:direct]

| ORF Name | NT ID | AA ID | NT LN | AA LN | Score | P-Value |
|---|---|---|---|---|---|---|
| AI7503000993_2380342_c2_741 | 2211 | 5983 | 636 | 211 | 463 | 6.4e-44 |

Description
pir:[LN:F69824] [AC:F69824] [PN:two-component response regulator [YhcY] homolog yhcZ] [GN:yhcZ] [CL:regulatory protein comA:response regulator homology] [OR:*Bacillus subtilis*] [DB:pir2] >gp:[GI:e1182922:g2633256] [LN:BSUB0005] [AC:Z99108:AL009126] [GN:yhcZ] [FN:unknown] [OR:*Bacillus subtilis*] [DB:genpept-bct1] [DE:*Bacillus subtilis* complete genome (section 5 of 21): from 802821 to 1011250.] [NT:similar to two-component response regulator [YhcY]] [LE:206441] [RE:207085] [DI:direct] >gp:[GI:e1182934:g2633268] [LN:BSUB0006] [AC:Z99109:AL009126] [GN:yhcZ] [FN:unknown] [OR:*Bacillus subtilis*] DB:genpept-bct1] [DE:*Bacillus subtilis* complete genome (section 6 of 21): from 999501 to 1209940.] [NT:similar to two-component response regulator [YhcY] [LE:9761] [RE:10405] [DI:direct] >gp:[GI:e324945:g2226141] [LN:BSY14079] [AC:Y14079] [PN:hypothetical -continued protein] [GN:yhcZ] [OR:*Bacillus subtilis*] [DB:genpept-bct1] [DE:*Bacillus subtilis* chromosomal DNA, region 75 degrees:glpPFKD operon and downstream.] [NT:similarity to the transcriptional regulator degU] [LE:9409] [RE:10053] [DI:direct]

| ORF Name | NT ID | AA ID | NT LN | AA LN | Score | P-Value |
|---|---|---|---|---|---|---|
| AI7503000993_2383253_c1_635 | 2212 | 5984 | 198 | 65 | | |

Description
NO-HIT

| ORF Name | NT ID | AA ID | NT LN | AA LN | Score | P-Value |
|---|---|---|---|---|---|---|
| AI7503000993_23984787_c3_924 | 2213 | 5985 | 1011 | 336 | 1404 | 1.2e-143 |

Description
sp:[LN:CCPA_STAXY] [AC:Q56194] [GN:CCPA] [OR:*STAPHYLOCOCCUS XYLOSUS*] [DE:PROBABLE CATABOLITE CONTROL PROTEIN A] [SP:Q56194] [DB:swissprot] >gp:[GI:e220318:g1177685] [LN:SXCCPA] [AC:X95439] [GN:ccpA] [OR:*Staphylococcus xylosus*] [DB:genpept-bct1] [DE:*S. xylosus* aroA, ccpA, acuC and acuA genes.] [SP:Q56194] [LE:1305] [RE:2294] [DI:direct]

| ORF Name | NT ID | AA ID | NT LN | AA LN | Score | P-Value |
|---|---|---|---|---|---|---|
| AI7503000993_24017890_c2_843 | 2214 | 5986 | 1428 | 476 | 1242 | 1.8e-126 |

Description
sp:[LN:LYSP_ECOLI] [AC:P25737] [GN:LYSP:CADR] [OR:*ESCHERICHIA COLI*] [DE:LYSINE-SPECIFIC PERMEASE] [SP:P25737] [DB:swissprot]

| ORF Name | NT ID | AA ID | NT LN | AA LN | Score | P-Value |
|---|---|---|---|---|---|---|
| AI7503000993_24020250_c1_654 | 2215 | 5987 | 882 | 293 | 551 | 6.5e-52 |

Description
gp:[GI:e1295630:g3184134] [LN:SSAASPROT] [AC:AJ000007] [PN:AAS surface protein] [GN:aas] [OR:*Staphylococcus saprophyticus*] [DB:genpept-bct1] [DE:*Staphylococcus saprophyticus* aas gene.] [LE:203] [RE:4594] [DI:direct]

| ORF Name | NT ID | AA ID | NT LN | AA LN | Score | P-Value |
|---|---|---|---|---|---|---|
| AI7503000993_24025463_c1_620 | 2216 | 5988 | 2952 | 983 | 1357 | 1.2e-138 |

Description
gp:[GI:g710421] [LN:SAU21636] [AC:U21636] [PN:unknown] [OR:*Staphylococcus aureus*] [DB:genpept-bct2] [DE:*Staphylococcus aureus* cmp-binding-factor 1 (cbf1) and ORF X genes, complete cds.] [NT:ORF X] [LE:52] [RE:1158] [DI direct]

| ORF Name | NT ID | AA ID | NT LN | AA LN | Score | P-Value |
|---|---|---|---|---|---|---|
| AI7503000993_24226543_c1_704 | 2217 | 5989 | 783 | 260 | 365 | 1.6e-33 |

Description
pir:[LN:E69827] [AC:E69827] [PN:glycerophosphodiester phosphodiesterase homolog yhdW] [GN:yhdW] [OR:*Bacillus subtilis*] [DB:pir2] >gp:[GI:e1182963:g2633297] [LN:BSUB0006] [AC:Z99109:AL009126] [GN:yhdW] [FN:unknown] [OR:*Bacillus subtilis*] [DB:genpept-bct1] [DE:*Bacillus subtilis* complete genome (section 6 of 21): from 999501 to 1209940.] [NT:similar to glycerophosphodiester phosphodiesterase] [LE:37668] [RE:38399] [DI:complement] >gp:[GI:e1191883:g2226218] [LN:BSY14082] [AC:Y14082] [PN:hypothetical protein] [GN:yhdW] [OR:*Bacillus subtilis*] [DB:genpept-bct1] [DE:*Bacillus subtilis* chromosomal DNA, region 72 to 75 degrees: spoVR to sspB.] [NT:Similarity to glycerol diester phosphodiesterase] [LE:24316] [RE:25047] [DI:complement]

| ORF Name | NT ID | AA ID | NT LN | AA LN | Score | P-Value |
|---|---|---|---|---|---|---|
| AI7503000993_2426312_f1_103 | 2218 | 5990 | 135 | 44 | | |

Description
NO-HIT

| ORF Name | NT ID | AA ID | NT LN | AA LN | Score | P-Value |
|---|---|---|---|---|---|---|
| AI7503000993_24272568_c2_782 | 2219 | 5991 | 147 | 48 | | |

Description
NO-HIT

-continued

| ORF Name | NT ID | AA ID | NT LN | AA LN | Score | P-Value |
|---|---|---|---|---|---|---|
| AI7503000993__2428950__c3__844 | 2220 | 5992 | 444 | 147 | 227 | 6.6e-19 |

Description
gp:[GI:g1022725] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF2] [LE:394] [RE:1083] [DI:complement] >gp:[GI:g2951621 [LN:STAMECRA] [AC:L14017] [OR:*Staphylococcus aureus*] [SR:*Staphylococcus aureus* (strain COL) DNA] [DB:genpept-bct1] [DE:*Staphylococcus aureus* methicillin-resistance protein (mecR) gene and unknown ORF, complete cds.] [NT:unknown ORF1; putative] [LE:1492] [RE:2181] [DI:complement]

| ORF Name | NT ID | AA ID | NT LN | AA LN | Score | P-Value |
|---|---|---|---|---|---|---|
| AI7503000993__24296925__f3__534 | 2221 | 5993 | 552 | 183 | 127 | 6.2e-08 |

Description
gp:[GI:e184374:g2104803] [LN:CBDNAPTCG] [AC:X87972] [GN:P-21] [OR:*Clostridium botulinum*] [DB:genpept-bct1] [DE:*C. botulinum* progenitor toxin complex genes.] [LE:2337] [RE:2882] [DI:direct]

| ORF Name | NT ID | AA ID | NT LN | AA LN | Score | P-Value |
|---|---|---|---|---|---|---|
| AI7503000993__24307677__c2__772 | 2222 | 5994 | 144 | 47 | | |

Description
NO-HIT

| ORF Name | NT ID | AA ID | NT LN | AA LN | Score | P-Value |
|---|---|---|---|---|---|---|
| AI7503000993__24334563__c2__789 | 2223 | 5995 | 453 | 150 | 109 | 1.5e-05 |

Description
gp:[GI:e1492342:g5262792] [LN:ATT13K14] [AC:AL080282] [PN:putative protein] [GN:T13K14.180] [OR:*Arabidopsis thaliana*] [SR:thale cress] [DB:genpept] [DE:*Arabidopsis thaliana* DNA chromosome 4, BAC clone T13K14 (ESSAproject).] [NT:similarity to desiccation-related protein,] [LE:67362:67832] [RE:67502:68491] [DI:directJoin]

| ORF Name | NT ID | AA ID | NT LN | AA LN | Score | P-Value |
|---|---|---|---|---|---|---|
| AI7503000993__24337750__c3__913 | 2224 | 5996 | 852 | 283 | 1238 | 4.8e-126 |

Description
sp:[LN:DAAA__STAHA] [AC:P54694] [GN:DAT] [OR:*STAPHYLOCOCCUS HAEMOLYTICUS*] [EC:2.6.1.21] [DE:TRANSAMINASE)] [SP:P54694] [DB:swissprot] >gp:[GI:g517475] [LN:SHU12238] [AC:U12238] [PN:D-amino acid transaminase] [GN:dat] [OR:*Staphylococcus haemolyticus*] [DB:genpept-bct1] [DE:*Staphylococcus haemolyticus* Y176 D-amino acid transaminase (dat) gene, complete cds.] [LE:216] [RE:1064] [DI:direct]

| ORF Name | NT ID | AA ID | NT LN | AA LN | Score | P-Value |
|---|---|---|---|---|---|---|
| AI7503000993__24407577__c1__724 | 2225 | 5997 | 738 | 245 | 833 | 4.0e-83 |

Description
sp:[LN:PHOP__BACSU] [AC:P13792] [GN:PHOP] [OR:*BACILLUS SUBTILIS*] [DE:PHOP] [SP:P13792] [DB:swissprot] >gp:[GI:g40056] [LN:BSPHOPDNA] [AC:X67676] [GN:phoP] [OR:*Bacillus subtilis*] [DB:genpept-bct1] [DE:*B. subtilis* phoP gene.] [SP:P13792] [LE:199] [RE:921] [DI:direct]

| ORF Name | NT ID | AA ID | NT LN | AA LN | Score | P-Value |
|---|---|---|---|---|---|---|
| AI7503000993__24407765__c1__710 | 2226 | 5998 | 795 | 264 | 413 | 1.3e-38 |

Description
sp:[LN:YCB9__PSEDE] [AC:P29942] [OR:*PSEUDOMONAS DENITRIFICANS*] [DE:HYPOTHETICAL 27.4 KD PROTEIN IN COBO 3' REGION (ORF9)] [SP:P29942] [DB:swissprot] >pir:[LN:I38164] [AC:I38164] [PN:hypothetical protein 9] [OR:*Pseudomonas* sp.] [DB:pir2] >gp:[GI:g551929] [LN:PSECOBGEN] [AC:M62866] [OR:*Pseudomonas denitrificans*] [SR:*Pseudomonas denitrificans* (strain SC510) DNA] [DB:genpept-bct1] [DE:*P. denitrificans* cobN, cobO, cobP, cobQ, cobW, and ORF6-9 genes, complete cds.] [NT:ORF9] [LE:12364] [RE:13149] [DI:complement]

| ORF Name | NT ID | AA ID | NT LN | AA LN | Score | P-Value |
|---|---|---|---|---|---|---|
| AI7503000993__24409803__c1__633 | 2227 | 5999 | 123 | 40 | 81 | 0.019 |

Description
pir:[LN:S75730] [AC:S75730:S50064] [PN:8-amino-7-oxononanoate

-continued synthase, :7-keto-8-aminopelargonic acid synthetase:protein slr0917:7-keto-8-aminopelargonic acid synthetase:protein slr0917] [GN:bioF] [CL:5-aminolevulinate synthase] [OR:*Synechocystis* sp.] [SR:PCC 6803, , PCC 6803] [SR:PCC 6803,] [EC:2.3.1.47] [DB:pir2] >gp:[GI:d1011116:g1673311] [LN:SYCSLLE] [AC:D64003:AB001339] [PN:7-keto-8-aminopelargonic acid synthetase] [GN:bioF] [OR:*Synechocystis* sp.] [SR:*Synechocystis* sp. (strain:PCC6803) DNA] [DB:genpept-bct1] [DE:*Synechocystis* sp. PCC6803 complete genome, 22/27, 2755703-2868766.] [NT:ORF_ID:slr0917] [LE:35986] [RE:37299] [DI:direct]

| ORF Name | NT ID | AA ID | NT LN | AA LN | Score | P-Value |
|---|---|---|---|---|---|---|
| AI7503000993_24417252_c3_902 | 2228 | 6000 | 1248 | 415 | 1038 | 7.5e-105 |

Description
pir:[LN:F70001] [AC:F70001] [PN:multidrug resistance protein homolog yttB] [GN:yttB] [OR:*Bacillus subtilis*] [DB:pir2] >gp:[GI:e1185908:g2635519] [LN:BSUB0016] [AC:Z99119:AL009126] [GN:yttB] [FN:unknown] [OR:*Bacillus subtilis*] [DB:genpept-bct1] [DE:*Bacillus subtilis* complete genome (section 16 of 21): from 2997771 to 3213410.] [NT:similar to multidrug resistance protein] [LE:108543] [RE:109736] [DI:complement] >gp:[g2293179] [LN:AF008220] [AC:AF008220] [PN:YttB] [GN:yttB] [OR:*Bacillus subtilis*] [DB:genpept-bct2] [DE:*Bacillus subtilis* rrnB-dnaB genomic region.] [NT:similarity to tetracycline resistance protein from] [LE:70691] [RE:71884] [DI:direct]

| ORF Name | NT ID | AA ID | NT LN | AA LN | Score | P-Value |
|---|---|---|---|---|---|---|
| AI7503000993_24428760_f3_509 | 2229 | 6001 | 129 | 42 | | |

Description
NO-HIT

| ORF Name | NT ID | AA ID | NT LN | AA LN | Score | P-Value |
|---|---|---|---|---|---|---|
| AI7503000993_24475377_f3_537 | 2230 | 6002 | 159 | 52 | | |

Description
NO-HIT

| ORF Name | NT ID | AA ID | NT LN | AA LN | Score | P-Value |
|---|---|---|---|---|---|---|
| AI7503000993_24490702_c1_616 | 2231 | 6003 | 405 | 134 | 74 | 0.011 |

Description
sp:[LN:Y70A_METJA] [AC:P81311] [GN:MJ0703.1] [OR:*METHANOCOCCUS JANNASCRII*] [DE:HYPOTHETICAL PROTEIN MJ0703.1] [SP:P81311] [DB:swissprot] >gp:[GI:g2826311] [LN:U67517] [AC:U67517:L77117] [PN:*M. jannaschii* predicted coding region MJ0703.1] [GN:MJ0703.1] [OR:*Methanococcus jannaschii*] [DB:genpept-bct2] [DE:*Methanococcus jannaschii* section 59 of 150 of the complete genome.] [NT:Brute Force ORF; identified by GeneMark; putative] [LE:94] [RE:402] [DI:direct]

| ORF Name | NT ID | AA ID | NT LN | AA LN | Score | P-Value |
|---|---|---|---|---|---|---|
| AI7503000993_24492130_f1_70 | 2232 | 6004 | 123 | 40 | | |

Description
NO-HIT

| ORF Name | NT ID | AA ID | NT LN | AA LN | Score | P-Value |
|---|---|---|---|---|---|---|
| AI7503000993_24508552_c3_971 | 2233 | 6005 | 1953 | 650 | 2471 | 1.1e-256 |

Description
sp:[LN:SYT1_BACSU] [AC:P18255:P06570] [GN:THRS:THRSV] [OR:*BACILLUS SUBTILIS*] [EC:6.1.1.3] [DE:(THRRS)] [SP:P18255:P06570] [DB:swissprot] >pir:[LN:YSBST1] [AC:B37770:E24720:B69723] [PN:threonine--tRNA ligase,, major (thrS) :threonyl-tRNA synthetase] [GN:thrS:thrSv] [CL:threonine-tRNA ligase] [OR:*Bacillus subtilis*] [EC:6.1.1.3] [DB:pir1] [MP:250 (degrees)] >gp:[GI:g143766] [LN:BACTRNASB] [AC:M36594] [OR:*Bacillus subtilis*] [SR:*B. subtilis* (strain 168) vegetative form DNA] [DB:genpept-bct1] [DE:*B. subtilis* threonyl-tRNA synthetase (thrSv) gene, complete cds.] [NT:(thrSv) (EC 6.1.1.3)] [LE:365] [RE:2296] [DI:direct] >gp:[GI:e1184144:g2635360] [LN:BSUB0015] [AC:Z99118:AL009126] [PN:threonyl-tRNA synthetase] [GN:thrS] [OR:*Bacillus subtilis*] [DB:genpept-bct1] [EC:6.1.1.3] [DE:*Bacillus subtilis* complete genome (section 15 of 21): from 2795131 to 3013540.] [SP:P18255] [LE:163202] [RE:165133] [DI:complement] >gp:[GI:e1165290:g1769999] [LN:BSZ75208]

-continued

[AC:Z75208] [PN:threonyl-tRNA-synthetase] [GN:thrS] [OR:*Bacillus subtilis*]
[DB:genpept-bct1] [EC:6.1.1.3] [DE:*B. subtilis* genomic sequence 89009bp.]
[NT:thrs (111–180); Major threonyl-tRNA synthetase] [SP:P18255] [LE:4774]
[RE:6705] [DI:direct] >gp:[GI:g2293284] [LN:AF008220] [AC:AF008220]
[PN:threonine tRNA synthetase] [GN:thrS] [OR:*Bacillus subtilis*]
[DB:genpept-bct2] [DE:*Bacillus subtilis* rrnB-dnaB genomic region.]
[LE:217934] [RE:219865] [DI:direct]

| ORF Name | NT ID | AA ID | NT LN | AA LN | Score | P-Value |
| --- | --- | --- | --- | --- | --- | --- |
| AI7503000993_24609676_c2_773 | 2234 | 6006 | 471 | 156 | 72 | 0.030 |

Description
sp:[LN:NULM_DASNO] [AC:O21333] [GN:MTND4L:ND4L:NADH4L] [OR:*DASYPUS NOVEMCINCTUS*] [SR:,NINE-BANDED ARMADILLO] [EC:1.6.5.3] [DE:NADH-UBIQUINONE OXIDOREDUCTASE CHAIN 4L,] [SP:O21333] [DB:swissprot]
>gp:[GI:e311022:g2252509] [LN:MTDNCOMGN] [AC:Y11832] [GN:NADH4L]
[OR:*Mitochondrion Dasypus novemcinctus*] [SR:nine-banded armadillo]
[DB:genpept-mam] [DE:*D. novemcinctus* complete mitochondrial genome.]
[SP:O21333] [LE:9903] [RE:10199] [DI:direct]

| ORF Name | NT ID | AA ID | NT LN | AA LN | Score | P-Value |
| --- | --- | --- | --- | --- | --- | --- |
| AI7503000993_24662915_c3_960 | 2235 | 6007 | 2718 | 905 | 2572 | 2.1e-267 |

Description
sp:[LN:DPO1_BACSU] [AC:O34996] [GN:POLA] [OR:*BACILLUS SUBTILIS*] [EC:2.7.7.7]
[DE:DNA POLYMERASE I, (POL I)] [SP:O34996] [DB:swissprot] >pir:[LN:E69680]
[AC:E69680] [PN:DNA polymerase I polA] [GN:polA] [CL:DNA-directed DNA
polymerase I] [OR:*Bacillus subtilis*] [DB:pir2] >gp:[GI:e1184158:g2635374]
[LN:BSUB0015] [AC:Z99118:AL009126] [PN:DNA polymerase I] [GN:polA]
[FN:replication and DNA repair] [OR:*Bacillus subtilis*], [DB:genpept-bct1]
[EC:2.7.7.7] [DE:*Bacillus subtilis* complete genome (section 15 of 21): from
2795131 to 3013540.] [SP:O34996] [LE:177125] [RE:17976711 [DI:complement]
>gp:[GI:g2293272] [LN:AF008220] [AC:AF008220] [PN:DNA-polymerase I]
[GN:polA] [OR:*Bacillus subtilis*] [DB:genpept-bct2] [DE:*Bacillus subtilis*
rrnB-dnaB genomic region.] [LE:203300] [RE:205942] [DI:direct]

| ORF Name | NT ID | AA ID | NT LN | AA LN | Score | P-Value |
| --- | --- | --- | --- | --- | --- | --- |
| AI7503000993_24692338_c3_895 | 2236 | 6008 | 474 | 157 | 540 | 4.5e-52 |

Description
sp:[LN:RISB_BACAM] [AC:Q44681] [GN:RIBH] [OR:*BACILLUS AMYLOLIQUEFACIENS*]
[EC:2.5.1.9] [DE:(LUMAZINE SYNTHASE) (RIBOFLAVIN SYNTHASE BETA CHAIN)]
[SP:Q44681] [DB:swissprot] >gp:[GI:e223995:g1212776] [:LN:BARIBGENS]
[AC:X95955] [PN:lumazine synthase (b-subunit)] [GN:ribH] [OR:*Bacillus amyloliquefaciens*] [DB:genpept-bct1] [DE:*B. amyloliquefaciens* ribB, ribG,
nbA, ribH & ribT genes.] [SP:Q44681] [LE:3639] [RE:4103] [DI:direct]

| ORF Name | NT ID | AA ID | NT LN | AA LN | Score | P-Value |
| --- | --- | --- | --- | --- | --- | --- |
| AI7503000993_24720291_f2_322 | 2237 | 6009 | 498 | 165 | | |

Description
NO-HIT

| ORF Name | NT ID | AA ID | NT LN | AA LN | Score | P-Value |
| --- | --- | --- | --- | --- | --- | --- |
| AI7503000993_24726077_c3_965 | 2238 | 6010 | 1026 | 341 | 1088 | 3.8e-110 |

Description
sp:[LN:G3P2_BACSU] [AC:O34425] [GN:GAPB] [OR:*BACILLUS SUBTILIS*]
[EC:1.2.1.12] [DE:GLYCERALDEHYDE 3-PHOSPHATE DEHYDROGENASE 2, (GAPDH)]
[SP:O34425] [DB:swissprot] >pir:[LN:G69628] [AC:G69628]
[PN:glyceraldehyde-3-phosphate dehydrogenase, gapB] [GN:gapB]
[CL:glyceraldehyde-3-phosphate dehydrogenase] [OR:*Bacillus subtilis*]
[EC:1.2.1.12] [DB:pir2] >gp:[GI:e1184151:g2635367] [LN:BSUB0015]
[AC:Z99118:AL009126] [PN:glyceraldehyde-3-phosphate dehydrogenase] [GN:gapB]
[FN:glycolysis] [OR:*Bacillus subtilis*] [DB:genpept-bct1] [EC:1.2.1.12]
[DE:*Bacillus subtilis* complete genome (section 15 of 21): from 2795131 to
3013540.] [SP:O34425] [LE:170976] [RE:171998] [DI:complement]
>gp:[GI:g2293277] [LN:AF008220] [AC:AF008220]
[PN:glyceraldehyde-3-P-dehydrogenase] [GN:gapB] [OR:*Bacillus subtilis*]
[DB:genpept-bct2] [DE:*Bacillus subtilis* rrnB-dnaB genomic region.]
[LE:211069] [RE:212091] [DI:direct]

| ORF Name | NT ID | AA ID | NT LN | AA LN | Score | P-Value |
| --- | --- | --- | --- | --- | --- | --- |

-continued

| | | | | | | |
|---|---|---|---|---|---|---|
| AI7503000993__24740701__c3__903 | 2239 | 6011 | 2508 | 835 | 3293 | 0.0 |

Description
sp:[LN:SYL__BACSU] [AC:P36430:O34465] [GN:LEUS] [OR:*BACILLUS SUBTILIS*]
[EC:6.1.1.4] [DE:LEUCYL-TRNA SYNTHETASE, (LEUCINE--TRNA LIGASE) (LEURS)]
[SP:P36430:O34465] [:DB:swissprot] >pir:[LN:D69650] [AC:D69650:A41882]
[PN:leucine--tRNA ligase, :leucyl-tRNA synthetase] [GN:leuS]
[CL:leucine--tRNA ligase] [OR:*Bacillus subtilis*] (EC:6.1.1.4] [DB:pir2]
>gp:[GI:e1185905:g2635516] [LN:BSUB0016] [AC:Z99119:AL009126]
[PN:leucyl-tRNA synthetase] [GN:leuS] [OR:*Bacillus subtilis*]
[DB:genpept-bct1] [EC:6.1.1.4] [DE:*Bacillus subtilis* complete genome
(section 16 of 21): from 2997771 to 3213410.] [SP:P36430] [LE:103940]
[RE:106354] [DI:complement] >gp:[GI:g2293181] [LN:AF008220] [AC:AF008220]
[PN:leucine tRNA synthetase] [GN:leuS] [OR:*Bacillus subtilis*]
[DB:genpept-bct2] [DE:*Bacillus subtilis* rrnB-dnaB genomic region.]
[LE:74073] [RE:76487] [DI:direct]

| ORF Name | NT ID | AA ID | NT LN | AA LN | Score | P-Value |
|---|---|---|---|---|---|---|
| AI7503000993__24744077__c2__739 | 2240 | 6012 | 183 | 60 | 74 | 0.011 |

Description
pir:[LN:B60608] [AC:B60608] [PN:myosin heavy chain] [CL:myosin heavy
chain:myosin motor domain homology] [OR:*Schistosoma mansoni*] [DB:pir2]

| ORF Name | NT ID | AA ID | NT LN | AA LN | Score | P-Value |
|---|---|---|---|---|---|---|
| AI7503000993__24797177__c1__689 | 2241 | 6013 | 3534 | 1177 | 1450 | 1.7e-148 |

Description
pir:[LN:C69999] [AC:C69999] [PN:DNA translocase stage III sporulation prot
homolog ytpT] [GN:ytpT] [OR:*Bacillus subtilis*] [DB:pir2]
>gp:[GI:e1185853:g2635464] [LN:BSUB0016] [AC:Z99119:AL009126] [GN:ytpT]
[FN:unknown] [OR:*Bacillus subtilis*] [DB:genpept-bct1] [DE:*Bacillus subtilis*
complete genome (section 16 of 21): from 2997771 to 3213410.] [NT:similar to
DNA translocase stage III sporulation] [LE:51038] [RE:53146] [DI:complement]
>gp:[GI:g2293215] [LN:AF008220] [AC:AF008220] [PN:YtpT] [GN:ytpT]
[OR:*Bacillus subtilisi*] [DB:genpept-bct2] [DE:*Bacillus subtilis* rrnB-dnaB
genomic region.] [NT:strong similarity to FtsK of *E. coli* and SpoIIIE of]
[LE:127280] [RE:129388] [DI:direct]

| ORF Name | NT ID | AA ID | NT LN | AA LN | Score | P-Value |
|---|---|---|---|---|---|---|
| AI7503000993__24853437__c1__661 | 2242 | 6014 | 831 | 276 | 423 | 1.1e-39 |

Description
pir:[LN:D69998] [AC:D69998] [PN:lysophospholipase homolog ytpA] [GN:ytpA]
[OR:*Bacillus subtilis*] [DB:pir2] >gp:[GI:e1185924:g2635535] [LN:BSUB0016]
[AC:Z99119:AL009126] [GN:ytpA] [FN:unknown] [OR:*Bacillus subtilis*]
[DB:genpept-bct1] [DE:*Bacillus subtilis* complete genome (section 16 of 21):
from 2997771 to 3213410.] [NT:similar to lysophospholipase] [LE:123973]
[RE:124752] [DI:complement] >gp:[GI:g2293167] [LN:AF008220] [AC:AF008220]
[PN:probable lysophospholipase] [GN:ytpA] [OR:*Bacillus subtilis*]
[DB:genpept-bct2] [DE:*Bacillus subtilis* rrnB-dnaB genomic region.]
[LE:55675] (RE:56454] [DI:direct]

| ORF Name | NT ID | AA ID | NT LN | AA LN | Score | P-Value |
|---|---|---|---|---|---|---|
| AI7503000993__2538252__c2__752 | 2243 | 6015 | 981 | 326 | 988 | 1.5e-99 |

Description
sp:[LN:HEMZ__BACSU] [AC:P32396] [GN:HEMH:HEMF] [OR:*BACILLUS SUBTILIS*]
[EC:4.99.1.1] [DE:SYNTHETASE)] [SP:P32396] [DB:swissprot]>pir:[LN:C47045]
[AC:C47045:H69639] [PN:ferrochelatase, hemH] [GN:hemH] [OR:*Bacillus
subtilis*] [EC:4.99.1.1] [DB:pir2] >gp:[GI:g143044] [LN:BACHEMEHY]
[AC:M97208] [PN:ferrochelatase] [GN:hemH] [FN:iron is inserted into
protoporphyrin IX giving] [OR:*Bacillus subtilis*] [SR:*Bacillus subtilis*
(strain W168) DNA] [DB:genpept-bct1] [EC:4.99.1.1] [DE:*Bacillus subtilis*
penicillin binding protein 1A (ponA) gene;uroporphyrinogen decarboxylase
(hemE) gene; ferrochelatase (hemH) gene complete cds, (hemY) gene, complete
cds; ORFA, complete cds; ORFB 5' end.] [LE:3038] [RE:3970] [DI:direct]
>gp:[GI:e1183015:g2633349] [LN:BSUB0006] [AC:Z99109:AL009126]
[PN:ferrochelatase] [GN:hemH] [FN:incorporation of iron into protoporphyrin
IX] [OR:*Bacillus subtilis*] [DB:genpept-bct1] [EC:4.99.1.1] [DE:*Bacillus
subtilis* complete genome (section 6 of 21): from 999501 to 1209940.]
[NT:alternate gene name:hemF] [SP:P32396] [LE:87223] [RE:88155] [DI:direct]
>gp:[GI:e1191886:g2226231] [LN:BSY14083] [AC:Y14083] [PN:Ferrochelatase (EC
4.99.1.1); incorporation of] [GN:hemH] [OR:*Bacillus subtilis*]
[DB:genpept-bct1] [DE:*Bacillus subtilis* chromosomal DNA, region 76–78
degrees:between glyB-aprE.] [NT:see Swiss Prot P32396; HEMZ__BACSU.]

-continued

[SP:P32396] [LE:7082] [RE:8014] [DI:direct]

| ORF Name | NT ID | AA ID | NT LN | AA LN | Score | P-Value |
|---|---|---|---|---|---|---|
| AI7503000993_25398425_c2_824 | 2244 | 6016 | 1167 | 388 | 731 | 2.6e-72 |

Description
pir:[LN:F69666] [AC:F69666 ] [PN:NifS protein homolog nifZ] [GN:nifZ]
[CL:nitrogen fixation protein nifS] [OR:*Bacillus subtilis*] [DB:pir2]
>gp:[GI:e1185832:g2635443] [LN:BSUB0016] [AC:Z99119:AL009126] [PN:NifS
protein homolog] [GN:nifZ] [FN:unknown] [OR:*Bacillus subtilis*]
[DB:genpept-bct1] [DE:*Bacillus subtilis* complete genome (section 16 of 21):
from 2997771 to 3213410.] [LE:28263] [RE:29408] [DI:complement]
>gp:[GI:g2293229] [LN:AF008220] [AC:AF008220] [PN:NifS2] [GN:nifS2]
[OR:*Bacillus subtilis*] [DB:genpept-bct2] [DE:*Bacillus subtilis* rrnB-dnaB
genomic region.] [NT:similar to *R. sphaeroides* nitrogenase stabilizer]
[LE:151019] [RE:152164] [DI:direct]

| ORF Name | NT ID | AA ID | NT LN | AA LN | Score | P-Value |
|---|---|---|---|---|---|---|
| AI7503000993_25476375_c2_813 | 2245 | 6017 | 135 | 44 | | |

Description
NO-HIT

| ORF Name | NT ID | AA ID | NT LN | AA LN | Score | P-Value |
|---|---|---|---|---|---|---|
| AI7503000993_2548537_c1_703 | 2246 | 6018 | 222 | 73 | | |

Description
NO-HIT

| ORF Name | NT ID | AA ID | NT LN | AA LN | Score | P-Value |
|---|---|---|---|---|---|---|
| AI7503000993_25586632_c2_759 | 2247 | 6019 | 135 | 44 | | |

Description
NO-HIT

| ORF Name | NT ID | AA ID | NT LN | AA LN | Score | P-Value |
|---|---|---|---|---|---|---|
| AI7503000993_25665878_c1_683 | 2248 | 6020 | 1665 | 554 | 1014 | 2.6e-102 |

Description
pir:[LN:G69992] [AC:G69992] [PN:spore cortex protein homolog ytgP] [GN:ytgP]
[OR:*Bacillus subtilis*] [DB:pir2] >gp:[GI:e1185878:g2635489] [LN:BSUB0016]
[AC:Z99119:AL009126] [GN:ytgP] [FN:unknown] [OR:*Bacillus subtilis*]
[DB:genpept-bct1] [DE:*Bacillus subtilis* complete genome (section 16 of 21):
from 2997771 to 3213410.] [NT:similar to spore cortex protein] [LE:74841]
[RE:76475] [DI:complement] >gp:[GI:g2293198] [LN:AF008220] [AC:AF008220]
[PN:YtgP] LGN:ytgP] [OR:*Bacillus subtilis*] [DB:genpept-bct2] [DE:*Bacillus
subtilis* rrnB-dnaB genomic region.] [NT:similar to SpoVB protein from *B.
subtilis*] [LE:103951] [RE:105585] [DI:direct]

| ORF Name | NT ID | AA ID | NT LN | AA LN | Score | P-Value |
|---|---|---|---|---|---|---|
| AI7503000993_25667217_c3_962 | 2249 | 6021 | 627 | 208 | 405 | 9.0e-38 |

Description
sp:[LN:YTAG_BACSU] [AC:O34932] [GN:YTAG] [OR:*BACILLUS SUBTILIS*]
[DE:HYPOTHETICAL 22.0 KD PROTEIN IN GAPB-MUTM INTERGENIC REGION] [SP:O34932]
[DB:swissprot] >pir:[LN:A69988] [AC:A69988] [PN:conserved hypothetical
protein ytaG] [GN:ytaG] [CL:conserved hypothetical protein YDR19Gc]
[OR:*Bacillus subtilis*] [DB:pir2] >gp:[GI:e1184155:g2635371] [LN:BSUB0015]
[AC:Z99118:AL009126] [GN:ytaG] [FN:unknown] [OR:*Bacillus subtilis*]
[DB:genpept-bct1] [DE:*Bacillus subtilis* complete genome (section 15 of 21):
from 2795131 to 3013540.] [NT:similar to hypothetical proteins] [SP:O34932]
[LE:174866] [RE:175459] [DI:complement] >gp:[GI:g2293275] [LN:AF008220]
[AC:AF008220] [PN:YtaG] [GN:ytaG] [OR:*Bacillus subtilis*] [DB:genpept-bct2]
[DE:*Bacillus subtilis* rrnB-dnaB genomic region.] [NT:similar to hypothetical
protein HI0890 from H.] [LE:207608] [RE:208201] [DI:direct]

| ORF Name | NT ID | AA ID | NT LN | AA LN | Score | P-Value |
|---|---|---|---|---|---|---|
| AI7503000993_25972087_c3_846 | 2250 | 6022 | 147 | 48 | | |

Description
NO-HIT

-continued

| ORF Name | NT ID | AA ID | NT LN | AA LN | Score | P-Value |
|---|---|---|---|---|---|---|
| AI7503000993_26175952_f3_532 | 2251 | 6023 | 258 | 85 | | |

Description
NO-HIT

| ORF Name | NT ID | AA ID | NT LN | AA LN | Score | P-Value |
|---|---|---|---|---|---|---|
| AI7503000993_26181551_c2_834 | 2252 | 6024 | 948 | 315 | 1016 | 1.6e-102 |

Description
sp:[LN:ACCA_BACSU] [AC:O34847] [GN:ACCA] [OR:*BACILLUS SUBTILIS*] [EC:6.4.1.2]
[DE:(EC 6.4.1.2)] [SP:O34847] [DB:swissprot] >pir:[LN:G69580] [AC:G69580]
[PN:acetyl-CoA carboxylase,, carboxyltransferase alpha chain] [GN:accA]
[CL:acetyl-CoA carboxylase, carboxyltransferase alpha chain] [OR:*Bacillus subtilis*] [EC:6.4.1.2] [DB:pir2] >gp:[GI:e1184169:g2635385] [LN:BSUB0015]
[AC:Z99118:AL009126] [PN:acetyl CoA carboxylase (alpha subunit)] [GN:accA]
[FN:long-chain fatty acid biosynthesis] [OR:*Bacillus subtilis*]
[DB:genpept-bct1] [DE:*Bacillus subtilis* complete genome (section 15 of 21):
from 2795131 to 3013540.] [SP:O34847] [LE:191674] [RE:192651] [DI:complement]
>gp:[GI:g2293263] [LN:AF008220] [AC:AF008220] [PN:acetyl-CoA carboxylase
subunit] [GN:accA] [OR:*Bacillus subtilis*] [DB:genpept-bct2] [DE:*Bacillus
subtilis* rrnB-dnaB genomic region.] [LE:190416] [RE:191393] [DI:direct]

| ORF Name | NT ID | AA ID | NT LN | AA LN | Score | P-Value |
|---|---|---|---|---|---|---|
| AI7503000993_26188891_f1_29 | 2253 | 6025 | 210 | 69 | 75 | 0.012 |

Description
pir:[LN:S58751] [AC:S58751] [PN:NADH dehydrogenase (ubiquinone), chain 3]
[CL:NADH dehydrogenase (ubiquinone) chain 3] [OR:mitochondrion *Hansenula wingei*] [EC:1.6.5.3] [DB:pir2]

| ORF Name | NT ID | AA ID | NT LN | AA LN | Score | P-Value |
|---|---|---|---|---|---|---|
| AI7503000993_26259686_f3_450 | 2254 | 6026 | 1242 | 413 | 801 | 9.8e-80 |

Description
pir:[LN:A69643] [AC:A69643] [PN:serine proteinase Do, heat-shock protein
htrA] [GN:htrA ] [CL:proteinase hhoB] [OR:*Bacillus subtilis*] [DB:pir2]
>gp:[GI:e118l491:g2632011] [LN:BSAJ2571] [AC:A]002571] [PN:YkdA] [GN:ykdA]
[OR:*Bacillus subtilis*] [DB:genpept-bct1] [DE:*Bacillus subtilis* 168 56 kb DNA
fragment between xlyA and ykoR.] [NT:putative serine protease, heat-shock
inducible;] [LE:10063] [RE:11412] [DI:complement] >gp:[GI:e1183310:g2633644]
[LN:BSUB0007] [AC:Z99110:AL009126] [PN:serine protease Do (heat-shock
protein)] [GN:htrA] [OR:*Bacillus subtilis*] [DB:genpept-bct1] [DE:*Bacillus
subtilis* complete genome (section 7 of 21): from 1194391 to 1411140.]
[NT:alternate gene name:ykdA] [LE:163012] [RE:1643611 [DI:complement]

| ORF Name | NT ID | AA ID | NT LN | AA LN | Score | P-Value |
|---|---|---|---|---|---|---|
| AI7503000993_26567062_c1_642 | 2255 | 6027 | 792 | 263 | 428 | 3.3e-40 |

Description
pir:[LN:A69996] [AC:A69996] [PN:hypothetical protein ytmA] [GN:ytmA]
[OR:*Bacillus subtilis*] [DB:pir2] >gp:[GI:e1185931:g2635542] [LN:BSUB0016]
[AC:Z99119:AL009126] [GN:ytmA] [FN:unknown] [OR:*Bacillus subtilis*]
[DB:genpept-bct1] [DE:*Bacillus subtilis* complete genome (section 16 of 21):
from 2997771 to 3213410.] [LE:132757] [RE:133530] [DI:complement]
>gp:[GI:g2293162] [LN:AF008220] [AC:AF008220] [PN:putative peptidase]
[GN:ytmA] [OR:*Bacillus subtilis*] [DB:genpept-bct2] [DE:*Bacillus subtilis*
rrnB-dnaB genomic region.] [LE:46897] [RE:47670] [DI:direct]

| ORF Name | NT ID | AA ID | NT LN | AA LN | Score | P-Value |
|---|---|---|---|---|---|---|
| AI7503000993_26596062_f3_484 | 2256 | 6028 | 1284 | 427 | 1198 | 8.3e-122 |

Description
gp:[GI:g2293312] [LN:AF008220] [AC:AF008220] [PN:YtfP] [GN:ytfP]
[OR:*Bacillus subtilis*] [DB:genpept-bct2] [DE:*Bacillus subtilis* rrnB-dnaB
genomic region.] [NT:similarity to hypothetical protein f400 from E.]
[LE:102487] [RE:103704] [DI:complement]

| ORF Name | NT ID | AA ID | NT LN | AA LN | Score | P-Value |
|---|---|---|---|---|---|---|
| AI7503000993_2741536_c2_805 | 2257 | 6029 | 162 | 53 | | |

-continued

| Description |
|---|
| NO-HIT |

| ORF Name | NT ID | AA ID | NT LN | AA LN | Score | P-Value |
|---|---|---|---|---|---|---|
| AI7503000993_2757633_c2_765 | 2258 | 6030 | 1494 | 497 | 1275 | 1.9e-164 |

| Description |
|---|
| sp:[LN:MENE_STAAU] [AC:Q53634] [GN:MENE] [OR:*STAPHYLOCOCCUS AUREUS*] [EC:6.2.1.26] [DE:(O-SUCCINYLBENZOATE-COA SYNTHASE)] [SP:Q53634] [DB:swissprot] [>gp:[GI:g1255259] [LN:SAU51132] [AC:U51132] [PN:o-succinylbenzoic acid (OSB) CoA ligase] [GN:mene] [FN:converts OSB to OSB-CoA in menaquinone] [OR:*Staphylococcus aureus*] [DB:genpept-bct1] [DE:*Staphylococcus aureus* o-succinylbenzoic acid CoA ligase (mene), and o-succinylbenzoic acid synthetase (menc) genes, complete cds.] [LE:491] [RE:1969] [DI:direct] |

| ORF Name | NT ID | AA ID | NT LN | AA LN | Score | P-Value |
|---|---|---|---|---|---|---|
| AI7503000993_2869676_f2_338 | 2259 | 6031 | 123 | 40 | | |

| Description |
|---|
| NO-HIT |

| ORF Name | NT ID | AA ID | NT LN | AA LN | Score | P-Value |
|---|---|---|---|---|---|---|
| AI7503000993_2923202_c1_699 | 2260 | 6032 | 1473 | 490 | 1202 | 3.1e-122 |

| Description |
|---|
| gp:[GI:g1732197] [LN:VFU65014] [AC:U65014] [PN:PTS permease for N-acetylglucosamine and] [GN:nagE] [OR:*Vibrio furnissii*] [DB:genpept-bct2] [DE:*Vibrio furnissii* PTS permease for N-acetylglucosamine and glucose (nagE) gene, complete cds.] [NT:PTS enzyme IINag] [LE:115] [RE:1605] [DI:direct] |

| ORF Name | NT ID | AA ID | NT LN | AA LN | Score | P-Value |
|---|---|---|---|---|---|---|
| AI7503000993_29562552_f3_555 | 2261 | 6033 | 276 | 91 | 281 | 1.2e-24 |

| Description |
|---|
| pir:[LN:H69993] [AC:H69993] [PN:hypothetical protein ytjA] [GN:ytjA] [CL:conserved hypothetical protein HI1000] [OR:*Bacillus subtilis*] [DB:pir2] >gp:[GI:e1185941:g2635552] [LN:BSUB001G] [AC:Z99119:AL009126] [GN:ytjA] [FN:unknown] [OR:*Bacillus subtilis*] [DB:genpept-bct1] [DE:*Bacillus subtilis* complete genome (section 16 of 21): from 2997771 to 3213410.] [LE:139407] [RE:139634] [DI:direct] >gp:[GI:g2293294] [LN:AF008220] [AC:AF008220] [PN:YtjA] [GN:ytjA] [OR:*Bacillus subtilis*] [DB:genpept-bct2] [DE:*Bacillus subtilis* rrnB-dnaB genomic region.] [NT:similar to hypothetical 9.3 kD protein from P.] [LE:40793] [RE:41020] [DI:complement] |

| ORF Name | NT ID | AA ID | NT LN | AA LN | Score | P-Value |
|---|---|---|---|---|---|---|
| AI7503000993_30079651_f1_66 | 2262 | 6034 | 1620 | 539 | 1135 | 4.0e-115 |

| Description |
|---|
| sp:[LN:SERA_BACSU] [AC:P35136:O32011] [GN:SERA] [OR:*BACILLUS SUBTILIS*] [EC:1.1.1.95] [DE:D-3-PHOSPHOGLYCERATE DEHYDROGENASE, (PGDH)] [SP:P35136:O32011] [DB:swissprot] >pir:[LN:C69705] [AC:C69705:S45534] [PN:phosphoglycerate dehydrogenase, serA] [GN:serA] [CL:*Bacillus* phosphoglycerate dehydrogenase] [OR:*Bacillus subtilis*] [EC:1.1.1.95] [DB:pir2] >gp:[GI:e1185576:g2634742] [LN:BSUB0013] [AC:Z99116:AL009126] [PN:phosphoglycerate dehydrogenase] [GN:serA] [FN:serine biosynthesis] [OR:*Bacillus subtilis*] [DB:genpept-bct1] [EC:1.1.1.95] [DE:*Bacillus subtilis* complete genome (section 13 of 21): from 2395261 to 2613730.] [SP:P35136] [LE:15060] [RE:16637] [DI:direct] >gp:[GI:g1146196] [LN:BACSERA] [AC:L47648] [PN:phosphoglycerate dehydrogenase] [GN:serA] [FN:serine biosynthesis] [OR:*Bacillus subtilis*] [DB:genpept-bct2] [DE:*Bacillus subtilis* phosphoglycerate dehydrogenase (serA), ypaA,ferredoxin (fer), ypbB, recS, ypbD, ypbE, ypbF, ypbG, ypbH, glutamate dehydrogenase (ypcA), ypdA, ypdB, ypdC, spore cortexlytic enzyme (sleB), ypeB, ypfA, ypfB, cytidine monophosphatekinase (cmk), ypfD, ypgA, yphA, yphB, yphC, NAD+ dependentglycerol-3-phosphate dehydrogenase (glyc), yphE and yphF genes, complete cds.] [LE:40] [RE:1617] [DI:complement] |

| ORF Name | NT ID | AA ID | NT LN | AA LN | Score | P-Value |
|---|---|---|---|---|---|---|
| AI7503000993_30084402_f3_446 | 2263 | 6035 | 1188 | 395 | 716 | 1.0e-70 |

| Description |
|---|
| sp:[LN:DHSS_SYNP1] [AC:P14776] [OR:*SYNECHOCOCCUS* SP] [SR:PCC 6716,] |

-continued

[EC:1.12.—.—] [DE:SUBUNIT)] [SP:P14776] [DB:swissprot] [>pir:[LN:HQYCSS] [AC:S06919] [PN:soluble hydrogenase, small chain] [CL:serine--pyruvate aminotransferase] [OR:*Synechococcus* sp.] [EC:1.12.—.—] [DB:pir1] >gp:[GI:g480541 [LN:SYNSOLHY] [AC:X16658] [OR:*Synechococcus* sp.] [SR:*Synechococcus* sp] [DB:genpept-bct1] [DE:Synechococcus DNA for the small subunit of soluble hydrogenase.] [NT:small subunit of soluble hydrogenase (AA 1-384)] [SP:P14776] [LE:226] [RE:1380] [DI:direct]

| ORF Name | NT ID | AA ID | NT LN | AA LN | Score | P-Value |
|---|---|---|---|---|---|---|
| AI7503000993_30114637_c3_847 | 2264 | 6036 | 1167 | 388 | 1177 | 1.4e-119 |

Description
pir:[LN:E69820] [AC:E69820 ] [PN:conserved hypothetical protein yhbA] [GN:yhbA ] [OR:*Bacillus subtilis*] [DB:pir2] >gp:[GI:e1182880:g2633214] [LN:BSUB0005] [AC:Z99108:AL009126] [GN:yhbA] [FN:unknown] [OR:*Bacillus subtilis*] [DB:genpept-bct1] [DE:*Bacillus subtilis* complete genome (section 5 of 21): from 802821 to 1011250.] [NT:alternate gene name:ygaP; similar to hypothetical] [LE:164477] [RE:165784] [DI:direct] >gp:[GI:e308636:g1903044] [LN:BSZ93102] [AC:Z93102] [PN:hypothetical 48.5 kd protein] [GN:ygaP] [OR:*Bacillus subtilis*] [DB:genpept-bct1] [DE:*B. subtilis* yga[L,M,N,O,P,Q,R,S,T], yzdB and yze[A,C} genes.] [LE:6803] [RE:8110] [DI:direct]

| ORF Name | NT ID | AA ID | NT LN | AA LN | Score | P-Value |
|---|---|---|---|---|---|---|
| AI7503000993_30274187_f3_522 | 2265 | 6037 | 969 | 322 | 1317 | 2.0e-134 |

Description
pir:[LN:D69999] [AC:D69999 ] [PN:conserved hypothetical protein ytqA] [GN:ytqA ] [CL:*Methanococcus jannaschii* conserved hypothetical protein MJ0486] [OR:*Bacillus subtilis*] [DB:pir2] >gp:[GI:e1185921:g2635532] [LN:BSUB0016] [AC:Z99119:AL009126] [GN:ytqA] [FN:unknown] [OR:*Bacillus subtilis*] [DB:genpept-bct1] [DE:*Bacillus subtilis* complete genome (section 16 of 21): from 2997771 to 3213410.] [NT:similar to hypothetical proteins] [LE:121310] [RE:122278] [DI:direct] >gp:[GI:g2293302] [LN:AF008220] [AC:AF008220] [PN:YtqA] [GN:ytqA] [OR:*Bacillus subtilis*] [DB:genpept-bct2] [DE:*Bacillus subtilis* rrnB-driaB genomic region.] [NT:similarity to biotine synthase from *B. sphaericus*] [LE:58149] [RE:59117] [DI:complement]

| ORF Name | NT ID | AA ID | NT LN | AA LN | Score | P-Value |
|---|---|---|---|---|---|---|
| AI7503000993_30508255_c3_912 | 2266 | 6038 | 1416 | 471 | 1011 | 5.5e-102 |

Description
pir:[LN:S43914] [AC:S43914] [PN:hypothetical protein 1] [CL:peptidase V] [OR:*Bacillus stearothermophilus*] [DB:pir2] >gp:[GI:g436965] [LN:BACMALA] [AC:L13418] [OR:*Bacillus stearothermophilus*] [SR:*Bacillus stearothermophilus* (library:ATCC 7953) DNA] [DB:genpept-bct1] [DE:*Bacillus stearothermophilus* maltose permease (malA) gene, complete cds.] [LE:24] [RE:1376] [DI:direct]

| ORF Name | NT ID | AA ID | NT LN | AA LN | Score | P-Value |
|---|---|---|---|---|---|---|
| AI7503000993_31256568_c2_817 | 2267 | 6039 | 201 | 66 | 114 | 6.2e-07 |

Description
pir:[LN:F71011] [AC:F71011] [PN:hypothetical protein PH1388] [GN:PH1388] [OR:*Pyrococcus horikoshii*] [DB:pir2] >gp:[GI:d1031437:g3257811] [LN APO 00006] [AC:AP000006:AB005215:AB009510:AB009511:AB009512:AB009513:AB009514] [PN:119aa long hypothetical protein] [GN:PH1388] [OR:*Pyrococcus horikoshii*] [SR:*Pyrococcus horikoshii* (strain:OT3) DNA, clone:*Pyrococcus horikoshi*] [DB:genpept-bct1] [DE:*Pyrococcus horikoshii* OT3 genomic DNA, 1166001-1485000 nt. position (6/7).] [LE:86760] [RE:87119] [DI:direct]

| ORF Name | NT ID | AA ID | NT LN | AA LN | Score | P-Value |
|---|---|---|---|---|---|---|
| AI7503000993_3140917_c3_954 | 2268 | 6040 | 189 | 62 | | |

Description
NO-HIT

| ORF Name | NT ID | AA ID | NT LN | AA LN | Score | P-Value |
|---|---|---|---|---|---|---|
| AI7503000993_31539156_c3_874 | 2269 | 6041 | 204 | 67 | | |

Description
NO-HIT

-continued

| ORF Name | NT ID | AA ID | NT LN | AA LN | Score | P-Value |
|---|---|---|---|---|---|---|
| AI7503000993_3158502_c2_792 | 2270 | 6042 | 225 | 74 | 122 | 2.7e-07 |

Description
pir:[LN:A69997] [AC:A69997] [PN:hypothetical protein ytmP] [GN:ytmP]
[OR:*Bacillus subtilis*] [DB:pir2] >gp:[GI:e1185865:g2635476] [LN:BSUB0016]
[AC:Z99119:AL009126] [GN:ytmP] [FN:unknown] [OR:*Bacillus subtilis*]
[DB:genpept-bct1] [DE:*Bacillus subtilis* complete genome (section 16 of 21):
from 2997771 to 3213410.] [LE:61986] [RE:62795] [DI:complement]
>gp:[GI:g2293206] [LN:AF008220] AC:AF008220] [PN:YtmP] [GN:ytmP]
[OR:*Bacillus subtilis*] [DB:genpept-bct2] [DE:*Bacillus subtilis* rrnB-dnaB
genomic region.] [LE:117631] [RE:118440] [DI:direct]

| ORF Name | NT ID | AA ID | NT LN | AA LN | Score | P-Value |
|---|---|---|---|---|---|---|
| AI7503000993_33209677_c2_831 2271 | 6043 | 972 | 323 | 764 | 8.2e-76 | |

Description
pir:[LN:F69999] [AC:F69999] [PN:conserved hypothetical protein ytqI]
[GN:ytqI] [OR:*Bacillus subtilis*] [DB:pir2] >gp:[GI:e1184174:g2635390]
[LN:BSUB0015] [AC:Z99118:AL009126] [GN:ytqI] [FN:unknown] [OR:*Bacillus
subtilis*] [DB:genpept-bct1] [DE:*Bacillus subtilis* complete genome (section
15 of 21): from 2795131 to 3013540.] [NT:similar to hypothetical proteins]
[LE:199851] [RE:200792] [DI:complement] >gp:[GI:g2293259] [LN:AF008220]
[AC:AF008220] [PN:YtqI] [GN:ytqI] [OR:*Bacillus subtilis*] [DB:genpept-bct2]
[DE:*Bacillus subtilis* rrnB-dnaB genomic region.] [NT:similarity to MGPA
protein from *M. genitalium*] [LE:182275] [RE:183216] [DI:direct]

| ORF Name | NT ID | AA ID | NT LN | AA LN | Score | P-Value |
|---|---|---|---|---|---|---|
| AI7503000993_33287515_f1_122 | 2272 | 6044 | 330 | 109 | 89 | 0.0022 |

Description
gp:[GI:g4091929] [LN:AF069752] [AC:AF069752] [PN:C5,6 desaturase] [GN:ERG3]
[OR:*Candida albicans*] [DB:genpept-pln2] [DE:*Candida albicans* C5,6 desaturase
(ERG3) gene, complete cds.] [LE:387] [RE:1547] [DI:direct]

| ORF Name | NT ID | AA ID | NT LN | AA LN | Score | P-Value |
|---|---|---|---|---|---|---|
| AI7503000993_33292165_f1_155 | 2273 | 6045 | 156 | 51 | | |

Description
NO-HIT

| ORF Name | NT ID | AA ID | NT LN | AA LN | Score | P-Value |
|---|---|---|---|---|---|---|
| AI7503000993_33317002_f1_114 | 2274 | 6046 | 123 | 40 | | |

Description
NO-HIT

| ORF Name | NT ID | AA ID | NT LN | AA LN | Score | P-Value |
|---|---|---|---|---|---|---|
| AI7503000993_33360312_f1_74 | 2275 | 6047 | 420 | 139 | 295 | 1.6e-25 |

Description
gp:[GI:e1284114:g2982646] [LN:SPAJ2293] [AC:AJ002293] [PN:penicillin-binding
protein lb] [GN:pbp1b] [OR:*Streptococcus pneumoniae*] [DB:genpept-bct1]
[DE:*Streptococcus pneumoniae* pbp1b gene, partial, beta-lactamresistant.]
[LE:<1] [RE:>1600] [DI:direct]

| ORF Name | NT ID | AA ID | NT LN | AA LN | Score | P-Value |
|---|---|---|---|---|---|---|
| AI7503000993_33647577_c2_740 | 2276 | 6048 | 1386 | 461 | 1586 | 6.4e-163 |

Description
gp:[GI:e1249821:g2832825] [LN:BS43KBDNA] [AC:AJ223978] [PN:fumarase protein,
CitG] [GN:citG] [OR:*Bacillus subtilis*] [DB:genpept-bct1] [DE:*Bacillus
subtilis* 42.7kB DNA fragment from yvsA to yvqA.] [LE:37816] [RE:39204]
[DI:direct] >gp:[GI:e1184383:g2635801] [LN:BSUB0017] [AC:Z99120:AL009126]
[PN:fumarate hydratase] [GN:citG] [OR:*Bacillus subtilis*] [DB:genpept-bct1]
[EC:4.2.1.2] [DE:*Bacillus subtilis* complete genome (section 17 of 21): from
3197001 to 3414420.] [LE:191083] [RE:192471] [DI:complement]

| ORF Name | NT ID | AA ID | NT LN | AA LN | Score | P-Value |
|---|---|---|---|---|---|---|
| AI7503000993_33650137_c2_794 | 2277 | 6049 | 207 | 68 | 177 | 1.3e-13 |

-continued

Description
pir:[LN:A69999] [AC:A69999] [PN:phenylalanyl-tRNA synthetase (beta subunit) homolog ytpR] [GN:ytpR] [CL:*Mycoplasma genitalium* hypothetical protein MG449] [OR:*Bacillus subtilis*] [DB:pir2] >gp:[GI:e1185855:g2635466] [LN:BSUB0016] [AC:Z99119:AL009126] [GN:ytpR] [FN:unknown] [OR:*Bacillus subtilis*] [DB:genpept-bct1] [DE:*Bacillus subtilis* complete genome (section 16 of 21): from 2997771 to 3213410.] [NT:similar to phenylalanyl-tRNA synthetase (beta) [LE:54055] RE:54660] [DI:complement] >gp:[GI:g2293213] [LN:AF008220] [AC:AF008220] [PN:YtpR] [GN:ytpR] [OR:*Bacillus subtilis*] [DB:genpept-bct2] [DE:*Bacillus subtilis* rrnB-dnaB genomic region.] [NT:similarity to phenylalanine tRNA ligase of *E. coli*] [LE:125766] [RE:126371] [DI:direct]

| ORF Name | NT ID | AA ID | NT LN | AA LN | Score | P-Value |
|---|---|---|---|---|---|---|
| AI7503000993_3365887_c2_791 | 2278 | 6050 | 630 | 209 | 501 | 6.0e-48 |

Description
pir:[LN:A69997] [AC:A69997] [PN:hypothetical protein ytmP] [GN:ytmP] [OR:*Bacillus subtilis*] [DB:pir2] >gp:[GI:e1185865:g2635476] [LN:BSUB0016] [AC:Z99119:AL009126] [GN:ytmP] [FN:unknown] [OR:*Bacillus subtilis*] [DB:genpept-bct1] [DE:*Bacillus subtilis* complete genome (section 16 of 21): from 2997771 to 3213410.] [LE:61986] [RE:62795] [DI:complement] >gp:[GI:g2293206] [LN:AF008220] [AC:AF008220] [PN:YtmP] [GN:ytmP] [OR:*Bacillus subtilis*] [DB:genpept-bct2] [DE:*Bacillus subtilis* rrnB-dnaB genomic region.] [LE:117631] [RE:118440] [DI:direct]

| ORF Name | NT ID | AA ID | NT LN | AA LN | Score | P-Value |
|---|---|---|---|---|---|---|
| AI7503000993_33792687_c1_629 | 2279 | 6051 | 129 | 42 | | |

Description
NO-HIT

| ORF Name | NT ID | AA ID | NT LN | AA LN | Score | P-Value |
|---|---|---|---|---|---|---|
| AI7503000993_33831512_f2_373 | 2280 | 6052 | 234 | 77 | 82 | 0.0093 |

Description
gp:[GI:e1346461:g3876981] [LN:CEF40D4] [AC:Z81536] [GN:F40D4.10] [OR:*Caenorhabditis elegans*] [DB:genpept-inv1] [DE:*Caenorhabditis elegans* cosmid F40D4, complete sequence.] [LE:20486:20882:21041:21585] [RE:20830:20997:21200:21746] [DI:directJoin]

| ORF Name | NT ID | AA ID | NT LN | AA LN | Score | P-Value |
|---|---|---|---|---|---|---|
| AI7503000993_33985077_c1_720 | 2281 | 6053 | 1230 | 409 | 1529 | 7.0e-157 |

Description
pir:[LN:C70001] [AC:C70001] [PN:malate dehydrogenase homolog ytsJ] [GN:ytsJ] [CL:malate dehydrogenase (oxaloacetate-decarboxylating)] [OR:*Bacillus subtilis*] [DB:pir2] >gp:[GI:e1184171:g2635387] [LN:BSUB0015] [AC:Z99118:AL009126] [GN:ytsJ] [FN:unknown] [OR:*Bacillus subtilis*] [DB:genpept-bct1] [DE:*Bacillus subtilis* complete genome (section 15 of 21): from 2795131 to 3013540.] [NT:similar to malate dehydrogenase] [LE:193843] [RE:195075] [DI:complement] >gp:[GI:g2293261] [LN:AF008220] [AC:AF008220] [PN:YtsJ] [GN:ytsJ] [OR:*Bacillus subtilis*] [DB:genpept-bct2] [DE:*Bacillus subtilis* rrnB-dnaB genomic region.] [NT:similarity to malate dehydrogenase (NADP+) from] [LE:18799211 [RE:189224] [DI:direct]

| ORF Name | NT ID | AA ID | NT LN | AA LN | Score | P-Value |
|---|---|---|---|---|---|---|
| AI7503000993_34177127_c1_721 | 2282 | 6054 | 1806 | 601 | 1853 | 3.3e-191 |

Description
sp:[LN:KPYK_BACLI] [AC:P51181] [GN:PYK] [OR:*BACILLUS LICHENIFORMIS*] [EC:2.7.1.40] [DE:PYRUVATE KINASE, (PK)] [SP:P51181] [DB:swissprot] >pir:[LN:JC4220] [AC:JC4220] [PN:pyruvate kinase, :ATP:pyruvate 2-O-phosphotransferase] [CL:pyruvate kinase] [OR:*Bacillus licheniformis*] [EC:2.7.1.40] [DB:pir2] >gp:[GI:d1007299:g1041099] [LN:BACPYK2] [AC:D31955] [PN:Pyruvate Kinase] [OR:*Bacillus licheniformis*] [SR:*Bacillus licheniformis* DNA] [DB:genpept-bct1] [DE:*Bacillus licheniformis* gene for pyruvate kinase, complete cds.] [LE:132] [RE:1889] [DI:direct]

| ORF Name | NT ID | AA ID | NT LN | AA LN | Score | P-Value |
|---|---|---|---|---|---|---|
| AI7503000993_34178128_c3_888 | 2283 | 6055 | 216 | 71 | | |

Description

-continued

NO-HIT

| ORF Name | NT ID | AA ID | NT LN | AA LN | Score | P-Value |
|---|---|---|---|---|---|---|
| AI7503000993_34181551_c2_841 | 2284 | 6056 | 924 | 307 | 618 | 2.4e-60 |

Description
Sp:[LN:DNAI_BACSU] [AC:P06567] [GN:DNAI] [OR:*BACILLUS SUBTILIS*]
[DE:PRIMOSOMAL PROTEIN DNAI] [SP:P06567] [DB:swissprot] >pir:[LN:IQBS44]
[AC:B24720:C26580:F69617] [PN:primosome component (helicase loader)
dnaI:dnaA protein homolog, 44K:hypothetical protein Y (dnaB 3' region)]
[GN:dnaI] [CL:44K dnaA protein homolog] [OR:*Bacillus subtilis*] [DB:pir1]
>gp:[GI:g39881] [LN:BSDNAB] [AC:X04963] [OR:*Bacillus subtilis*]
[DB:genpept-bct1] [DE:*Bacillus subtilis* dnaB gene for initiation of
chromosomal replication.] [NT:ORF 311 (AA 1-311)] [SP:P06567] [LE:1843]
[RE:2778] [DI:direct] >gp:[GI:e1184147:g2635363] [LN:BSUB0015]
[AC:Z99118:AL00912G] [PN:helicase loader] [GN:dnaI] [FN:DNA synthesis]
[OR:*Bacillus subtilis*] [DB:genpept-bct1] [DE:*Bacillus subtilis* complete
genome (section 15 of 21): from 2795131 to 3013540.] [NT:alternate gene name:
ytxA, dnaY] [SP:P06567] [LE:167129] [RE:168064] [DI:complement]
>gp:[GI:e1165286:g1769996] [LN:BSZ75208] [AC:Z75208] [PN:replication
protein] [GN:dnaI] [OR:*Bacillus subtilis*] [DB:genpept-bct1] [DE:*B. subtilis*
genomic sequence 89009bp.] [NT:DNA synthesis; putative primosome component]
[SP:P06567] [LE:1843] [RE:2778] [DI:direct] >gp:[GI:g2293281] [LN:AF008220]
[AC:AF008220] [PN:DnaI] [GN:dnaI] [OR:*Bacillus subtilis*] [DB:genpept-bct2]
[DE:*Bacillus subtilis* rrnB-dnaB genomic region.] [LE:2150031 [RE:215938]
[DI:direct]

| ORF Name | NT ID | AA ID | NT LN | AA LN | Score | P-Value |
|---|---|---|---|---|---|---|
| AI7503000993_34199077_c3_883 | 2285 | 6057 | 1017 | 338 | 864 | 2.1e-86 |

Description
gp:[GI:g1255260] [LN:SAU51132] [AC:U51132] [PN:o-succinylbenzoic acid (OSB)
synthetase] [GN:menc] [FN:converts SHCHC to OSB in menaquinone]
[OR:*Staphylococcus aureus*] [DB:genpept-bct1] [DE:*Staphylococcus aureus*
o-succinylbenzoic acid CoA ligase (mene), and o-succinylbenzoic acid
synthetase (menc) genes, complete cds.] [LE:1974] [RE:2975] [DI:direct]

| ORF Name | NT ID | AA ID | NT LN | AA LN | Score | P-Value |
|---|---|---|---|---|---|---|
| AI7503000993_34272752_c3_862 | 2286 | 6058 | 963 | 320 | 1413 | 1.4e-144 |

Description
gp:[GI:g710422] [LN:SAU21636] [AC:U21636] [PN:cmp-binding-factor 1]
[GN:cbf1] [OR:*Staphylococcus aureus*] [DB:genpept-bct2] [DE:*Staphylococcus
aureus* cmp-binding-factor 1 (cbf1) and ORF X genes,complete cds.] [LE:1155]
[RE:2096] [DI:direct]

| ORF Name | NT ID | AA ID | NT LN | AA LN | Score | P-Value |
|---|---|---|---|---|---|---|
| AI7503000993_34415925_c3_914 | 2287 | 6059 | 654 | 217 | 540 | 4.5e-52 |

Description
pir:[LN:B69997] [AC:B69997] [PN:conserved hypothetical protein ytmQ]
[GN:ytmQ] [CL:hypothetical protein H10340] [OR:*Bacillus subtilis*] [DB:pir2]
>gp:[GI:e1185863:g2635474] [LN:BSUB0016] [AC:Z99119:AL009126] [GN:ytmQ]
[FN:unknown] [OR:*Bacillus subtilis*] [DB:genpept-bct1] [DE:*Bacillus subtilis*
complete genome (section 16 of 21): from 2997771 to 3213410.] [NT:similar to
hypothetical proteins] [LE:60859] [RE:61500] [DI:complement]
>gp:[GI:g2293207] [LN:AF008220] [AC:AF008220] [PN:YtmQ] [GN:ytmQ]
[OR:*Bacillus subtilis*] [DB:genpept-bct2] [DE:*Bacillus subtilis* rrnB-dnaB
genomic region.] [NT:similar to hypothetical protein HI0340 from H.]
[LE:118926] [RE:119567] [DI:direct]

| ORF Name | NT ID | AA ID | NT LN | AA LN | Score | P-Value |
|---|---|---|---|---|---|---|
| AI7503000993_34429838_c3_884 | 2288 | 6060 | 483 | 160 | 261 | 1.6e-22 |

Description
pir:[LN:E69994] [AC:E69994 ] [PN:hypothetical protein ytkD] [GN:ytkD]
[OR:*Bacillus subtilis*] [DB:pir2] >gp:[GI:e1185936:g2635547] [LN:BSUB0016]
[AC:Z99119:AL009126] [GN:ytkD] [FN:unknown] [OR:*Bacillus subtilis*]
[DB:genpept-bct1] [DE:*Bacillus subtilis* complete genome (section 16 of 21):
from 2997771 to 3213410.] [LE:136293] [RE:136769] [DI:complement]
>gp:[GI:g2293161] [LN:AF008220] [AC:AF008220] [PN:YtkD] [GN:ytkD]
[OR:*Bacillus subtilis*] [DB:genpept-bct2] [DE:*Bacillus subtilis* rrnB-dnaB
genomic region.] [LE:43658] [RE:44134] [DI:direct]

-continued

| ORF Name | NT ID | AA ID | NT LN | AA LN | Score | P-Value |
|---|---|---|---|---|---|---|
| AI7503000993_34610925_f3_445 | 2289 | 6061 | 462 | 153 | 274 | 6.9e-24 |

Description
pir:[LN:F69883] [AC:F69883] [PN:conserved hypothetical protein ymaD]
[GN:ymaD] [OR:*Bacillus subtilis*] [DB:pir2] >gp:[GI:e1183387:g2634112]
[LN:BSUB0010] [AC:Z99113:AL009126] [GN:ymaD] [FN:unknown] [OR:*Bacillus subtilis*] [DB:genpept-bct1] [DE:*Bacillus subtilis* complete genome (section 10 of 21): from 1781201 to 2014980.] [NT:similar to hypothetical proteins] [LE:82267] [RE:82719] [DI:direct]

| ORF Name | NT ID | AA ID | NT LN | AA LN | Score | P-Value |
|---|---|---|---|---|---|---|
| AI7503000993_34617017_c3_869 | 2290 | 6062 | 759 | 252 | 773 | 9.1e-77 |

Description
sp:[LN:ECSA_BACSU] [AC:P55339] [GN:ECSA:PRST] [OR:*BACILLUS SUBTILIS*]
[DE:ABC-TYPE TRANSPORTER ATP-BINDING PROTEIN ECSA] [SP:P55339]
[DB:swissprot] >pir:[LN:F69619] [AC:F69619] [PN:ABC transporter
(ATP-binding protein) ecsA] [GN:ecsA] [CL:ATP-binding cassette homology]
[OR:*Bacillus subtilis*] [DB:pir2] >gp:[GI:e183449:g1177253] [LN:BSECSABCG]
[AC:X87807] [PN:putative ATP-binding protein of ABC-type] [GN:ecsA]
[OR:*Bacillus subtilis*] [DB:genpept-bct1] [DE:*B. subtilis* ecsA, ecsB, and ecsC
genes.] [SP:P55339] [LE:248] [RE:991] [DI:direct] >gp:[GI:e1183006:g2633340]
[LN:BSUB0006] [AC:Z99109:AL009126] [PN:ABC transporter (ATP-binding
protein)] [GN:ecsA] [FN:regulates both components of the protein]
[OR:*Bacillus subtilis*] [DB:genpept-bct1] [DE:*Bacillus subtilis* complete
genome (section 6 of 21): from 999501 to 1209940.] [NT:alternate gene name:
prsT, ecs-26, yhaD] [SP:P55339] [LE:77413] [RE:78156] [DI:direct]
>gp:[GI:e324952:g2226115] [LN:BSY14077] [AC:Y14077] [PN:Hypothetical
protein] LGN:yhaD] [OR:*Bacillus subtilis*] [DB:genpept-bct1] [DE:*Bacillus subtilis 10.6 Kb chromosomal DNA:glyB-prsA region.*] [NT:Identified as ecsA.
Similar to many ATP binding ABC] [SP:P55339] [LE:2757] [RE:3500]
[DI:complement]

| ORF Name | NT ID | AA ID | NT LN | AA LN | Score | P-Value |
|---|---|---|---|---|---|---|
| AI7503000993_35360932_c3_944 | 2291 | 6063 | 1278 | 425 | 1493 | 4.6e-153 |

Description
sp:[LN:ACKA_BACSU] [AC:P37877] [GN:ACKA] [OR:*BACILLUS SUBTILIS*] [EC:2.7.2.1]
[DE:ACETATE KINASE, (ACETOKINASE)] [SP:P37877] [DB:swissprot]
>pir:[LN:B499351 [AC:B49935:C69581] [PN:acetate kinase, ackA] [GN:ackA]
[CL:acetate kinase] [OR:*Bacillus subtilis*] [EC:2.7.2.1] [DB:pir2]
>gp:[GI:e1185820:g2635431] [LN:BSUB0016] [AC:Z99119:AL009126] [PN:acetate
kinase] [GN:ackA] [OR:*Bacillus subtilis*] [DB:genpept-bct1] [EC:2.7.2.1]
[DE:*Bacillus subtilis* complete genome (section 16 of 21): from 2997771 to
3213410.] [SP:P37877][LE:16413] [RE:17600] [DI:complement]
>gp:[GI:g2293240] [LN:AF008220] [AC:AF008220] [PN:acetate kinase] [GN:ackA]
[OR:*Bacillus subtilis*] [DB:genpept-bct2] [DE:*Bacillus subtilis* rrnB-dnaB
genomic region.] [LE:162827] [RE:164014] [DI:directll >gp:[GI:g405134]
[LN:BACACKA] [AC:L17320] [PN:acetate kinase] [GN:ackA] [OR:*Bacillus subtilis*] [SR:*Bacillus subtilis* (strain W168) DNA] [DB:genpept-bct2]
[DE:*Bacillus subtilis* acetate kinase (ackA) gene, complete cds.] [LE:698]
[RE:1885] [DI:direct]

| ORF Name | NT ID | AA ID | NT LN | AA LN | Score | P-Value |
|---|---|---|---|---|---|---|
| AI7503000993_36152191_c3_863 | 2292 | 6064 | 126 | 41 | | |

Description
NO-HIT

| ORF Name | NT ID | AA ID | NT LN | AA LN | Score | P-Value |
|---|---|---|---|---|---|---|
| AI7503000993_36541078_c1_647 | 2293 | 6065 | 171 | 56 | | |

Description
NO-HIT

| ORF Name | NT ID | AA ID | NT LN | AA LN | Score | P-Value |
|---|---|---|---|---|---|---|
| AI7503000993_3906642_c1_632 | 2294 | 6066 | 600 | 199 | 244 | 1.0e-20 |

Description
pir:[LN:H69778] [AC:H69778] [PN:hypothetical protein ydeN] [GN:ydeN]
[OR:*Bacillus subtilis*] [DB:pir2] >gp:[GI:d1020114:g1881334] [LN:AB001488]
[AC:AB001488] [GN:ydeN] [OR:*Bacillus subtilis*] [SR:*Bacillus subtilis*

-continued (strain:168) DNA] [DB:genpept-bct1] [DE:*Bacillus subtilis* genome sequence,
148 kb sequence of the region between 35 and 47 degree.] [NT:FUNCTION
UNKNOWN.] [LE:106671] RE:107243] [DI:complement] >gp:[GI:e1182492:g2632826]
[LN:BSUB0003] [AC:Z99106:AL009126] [GN:ydeN] [FN:unknown] [OR:*Bacillus
subtilis*] [DB:genpept-bct1] [DE:*Bacillus subtilis* complete genome (section 3
of 21): from 402751 to 611850.] [LE:170416] [RE:170988] [DI:complement]

| ORF Name | NT ID | AA ID | NT LN | AA LN | Score | P-Value |
|---|---|---|---|---|---|---|
| AI7503000993_3944015_c1_608 | 2295 | 6067 | 540 | 179 | 331 | 6.2e-30 |

Description
pir:[LN:S68867] [AC:568867:554422] [PN:probable transport protein arpJ:ABC
transporter arpJ] [OR:*Listeria monocytogenes*] [DB:pir2]

| ORF Name | NT ID | AA ID | NT LN | AA LN | Score | P-Value |
|---|---|---|---|---|---|---|
| AI7503000993_4073892_c1_631 | 2296 | 6068 | 1458 | 485 | 1083 | 1.3e-109 |

Description
sp:[LN:PPOX_BACSU] [AC:P32397] [GN:HEMY:HEMG] [OR:*BACILLUS SUBTILIS*]
[EC:1.3.3.4] [DE:PROTOPORPHYRINOGEN OXIDASE, (PPO)] [SP:P32397]
[DB:swissprot] >pir:[LN:D47045] [AC:D47045:D69640] [PN:coproporphyrinogen
III oxidase/protoporphyrinogen IX oxidase hemY] [GN:hemY] [OR:*Bacillus
subtilis*] [DB:pir2] >gp:[GI:g143045] [LN:BACHEMEHY] [AC:M97208] [GN:hemY]
[FN:involved in a late step of protoheme IX] [OR:*Bacillus subtilis*]
[SR:*Bacillus subtilis* (strain W168) DNA] [DB:genpept-bct1] [DE:*Bacillus
subtilis* penicillin binding protein 1A (ponA) gene; uroporphyrinogen
decarboxylase (hemE) gene; ferrochelatase (hemH) gene complete cds, (hemY)
gene, complete cds; ORFA, complete cds; ORFB 5' end.] [LE:3985] [RE:5397]
[DI:direct] >gp:[GI:e1183016:g2633350] [LN:BSUB0006] [AC:Z99109:AL009126]
[PN:protoporphyrinogen IX and coproporphyrinogen III] [GN:hemY] [FN:late
steps of protoheme IX synthesis (porphyrin] [OR:*Bacillus subtilis*]
[DB:genpept-bct1] [EC:1.3.3.4] [DE:*Bacillus subtilis* complete genome
(section 6 of 21): from 999501 to 1209940.] [NT:alternate gene name:hemG]
[SP:P32397] [LE:88170] [RE:89582] [DI:direct] >gp:[GI:e325009:g2226232]
[LN:BSY14083] [AC:Y14083] [PN:Protoporphyrinogen IX oxidase] [GN:hemY]
[OR:*Bacillus subtilis*] [DB:genpept-bct1] [DE:*Bacillus subtilis* chromosomal
DNA, region 76–78 degrees: between glyB-aprE.] [NT:see Swiss Prot P32397;
HEMG_BACSU.] [SP:P32397] [LE:8029] [RE:9441] [DI:direct]

| ORF Name | NT ID | AA ID | NT LN | AA LN | Score | P-Value |
|---|---|---|---|---|---|---|
| AI7503000993_4110882_f3_473 | 2297 | 6069 | 351 | 116 | 90 | 0.00022 |

Description
pir:[LN:D70004] [AC:D70004] [PN:hypothetical protein ytzB] [GN:ytzB]
[OR:*Bacillus subtilis*] [DB:pir2] >gp:[GI:e1185860:g2635471] [LN:BSUB0016]
[AC:Z99119:AL009126] [GN:ytzB] [FN:unknown] [OR:*Bacillus subtilis*]
[DB:genpept-bct1] [DE:*Bacillus subtilis* complete genome (section 16 of 21):
from 2997771 to 3213410.] [LE:57791] [RE:58108] [DI:direct]

| ORF Name | NT ID | AA ID | NT LN | AA LN | Score | P-Value |
|---|---|---|---|---|---|---|
| AI7503000993_4173427_c2_742 | 2298 | 6070 | 474 | 157 | 82 | 0.0020 |

Description
pir:[LN:A64334] [AC:A64334] [PN:hypothetical protein MJ0272]
[OR:*Methanococcus jannaschii*] [DB:pir2] [MP:FOR257413-257652]
>gp:[GI:g1590997] [LN:U67482] [AC:U67482:L77117] [PN:repressor protein,
putative (yorfE)] [GN:MJ0272] [OR:*Methanococcus jannaschii*]
[DB:genpept-bct2] [DE:*Methanococcus jannaschii* section 24 of 150 of the
complete genome.] [NT:similar to GP:1536960 percent identity:40.32;]
[LE:563311 [RE:5872] [DI:direct]

| ORF Name | NT ID | AA ID | NT LN | AA LN | Score | P-Value |
|---|---|---|---|---|---|---|
| AI7503000993_4183428_c3_921 | 2299 | 6071 | 1329 | 442 | 1966 | 3.5e-203 |

Description
sp:[LN:MURC_STAAU] [AC:O31211] [GN:MURC] [OR:*STAPHYLOCOCCUS AUREUS*]
[EC:6.3.2.8] [DE:ACETYLMURANOYL-L-ALANINE SYNTHETASE)] [SP:O31211]
[DB:swissprot] >gp:[GI:g2642659] [LN:AF034076] [AC:AF034076]
[PN:UDP-N-acetylmuramoyl-L-alanine synthetase] [GN:murC] [FN:cell wall
biosynthesis] [OR:*Staphylococcus aureus*] [DB:genpept-bct2]
[DE:*Staphylococcus aureus* UDP-N-acetylmuramoyl-L-alanine synthetase (murC)
gene, complete cds.] [NT:MurC; UDP-N-acetylmuramate-alanine ligase] [LE:1]
[RE:1314] [DI:direct]

-continued

| ORF Name | NT ID | AA ID | NT LN | AA LN | Score | P-Value |
|---|---|---|---|---|---|---|
| AI7503000993_4296950_c2_764 | 2300 | 6072 | 198 | 65 | | |

Description
NO-HIT

| ORF Name | NT ID | AA ID | NT LN | AA LN | Score | P-Value |
|---|---|---|---|---|---|---|
| AI7503000993_4299175_c1_637 | 2301 | 6073 | 240 | 79 | 102 | 0.00012 |

Description
pir:[LN:T00158] [AC:T00158] [PN:amidase,] [OR:*Staphylococcus aureus* phage
phi PVL] [EC:3.5.—.—] [DB:pir3] >gp:[GI:d1032859:g3341932] [LN:AB009866]
[AC:AB009866] [PN:amidase (peptidoglycan hydrolase)] [OR:*bacteriophage phi
PVL*] [SR:*bacteriophage phi* PVL (specific_host:*Staphylococcus aureus* ATC]
[DB:genpept-phg] [DE:*Bacteriophage phi* PVL proviral DNA, complete sequence.]
[NT:orf 25] [LE:20199] [RE:21653] [DI:direct]

| ORF Name | NT ID | AA ID | NT LN | AA LN | Score | P-Value |
|---|---|---|---|---|---|---|
| AI7503000993_4345967_f2_357 | 2302 | 6074 | 441 | 146 | 368 | 7.5e-34 |

Description
sp:[LN:HIT_BACSU] [AC:O07513] [GN:HIT] [OR:*BACILLUS SUBTILIS*] [DE:HIT
PROTEIN] [SP:O07513] [DB:swissprot] >pir:[LN:A69642] [AC:A69642]
[PN:cell-cycle regulation histidine triad (HIT) protein] [GN:hit]
[CL:protein kinase C inhibitor:histidine triad homology] [OR:*Bacillus
subtilis*] [DB:pir2] >gp:[GI:e1183005:g2633339] [LN:BSUB000S]
[AC:Z99109:AL009126] [PN:Hit-like protein] [GN:hit] [FN:cell-cycle
regulation (inhibition of cell] [OR:*Bacillus subtilis*] [DB:genpept-bct1]
[DE:*Bacillus subtilis* complete genome (section 6 of 21): from 999501
to 1209940.] [NT:alternate gene name:yhaE] [SP:O07513] [LE:76488] [RE:76925]
[DI:complement] >gp:[GI:e325178:g2226116] [LN:BSY14077] [AC:Y14077]
[PN:Hypothetical protein] [GN:yhaE] [OR:*Bacillus subtilis*] [DB:genpept-bct1]
[DE:*Bacillus subitlis* 10.6 Kb chromosomal DNA:glyB-prsA region.]
[NT:Similarity to the Hit family of proteins] [SP:007513] [LE:3988]
[RE:4425] [DI:direct]

| ORF Name | NT ID | AA ID | NT LN | AA LN | Score | P-Value |
|---|---|---|---|---|---|---|
| AI7503000993_4453537_c3_937 | 2303 | 6075 | 159 | 52 | | |

Description
NO-HIT

| ORF Name | NT ID | AA ID | NT LN | AA LN | Score | P-Value |
|---|---|---|---|---|---|---|
| AI7503000993_4459380_c1_712 | 2304 | 6076 | 207 | 68 | | |

Description
NO-HIT

| ORF Name | NT ID | AA ID | NT LN | AA LN | Score | P-Value |
|---|---|---|---|---|---|---|
| AI7503000993_4502308_c2_812 | 2305 | 6077 | 636 | 211 | 502 | 4.7e-48 |

Description
pir:[LN:E69826] [AC:E69826] [PN:1-acylglycerol-3-phosphate O-acyltransfera
homolog yhdO] [GN:yhdO] [OR:*Bacillus subtilis*] [DB:pir2]
>gp:[GI:e1182955:g2633289] [LN:BSUB0006] [AC:Z99109:AL009126] [GN:yhdO]
[FN:unknown] [OR:*Bacillus subtilis*] [DB:genpept-bct1] [DE:*Bacillus subtilis*
complete genome (section 6 of 21): from 999501 to 1209940.] [NT:similar to
1-acylglycerol-3-phosphate] [LE:31375] [RE:31974] [DI:direct]
>gp:[GI:e325031:g22262101 LN:BSY14082] [AC:Y14082] [PN:hypothetical
protein] [GN:yhdO] [OR:*Bacillus subtilis*] [DB:genpept-bct11] [DE:*Bacillus
subtilis* chromosomal DNA, region 72 to 75 degrees: spoVR to sspB.]
[NT:Similarity to a hypothetical protein from] [LE:18023] [RE:18622]
[DI:direct]

| ORF Name | NT ID | AA ID | NT LN | AA LN | Score | P-Value |
|---|---|---|---|---|---|---|
| AI7503000993_4511283_c3_859 | 2306 | 6078 | 153 | 50 | | |

Description
NO-HIT

| ORF Name | NT ID | AA ID | NT LN | AA LN | Score | P-Value |
|---|---|---|---|---|---|---|

| -continued | | | | | | |
|---|---|---|---|---|---|---|
| AI7503000993__4568761__c1__630 | 2307 | 6079 | 1116 | 371 | 1257 | 4.7e-128 |

Description
sp:[LN:DCUP_BACSU] [AC:P32395] [GN:HEME] [OR:*BACILLUS SUBTILIS*]
[EC:4.1.1.37] [DE:UROPORPHYRINOGEN DECARBOXYLASE, (UPD)] [SP:P32395]
[DB:swissprot] >pir:[LN:B47045] [AC:B47045:G69639] [PN:uroporphyrinogen
decarboxylase, hemE:uroporphyrinogen III decarboxylase hemE] [GN:hemE]
[CL:uroporphyrinogen decarboxylase] [OR:*Bacillus subtilisil [EC:4.1.1.37]*
[DB:pir2] >gp:[GI:g143043] [LN:BACHEMEHY] [AC:M97208] [PN:uroporphyrinogen
decarboxylase] [GN:hemE] [OR:*Bacillus subtilis*] [SR:*Bacillus subtilis*
(strain W168) DNA] [DB:genpept-bct1] [EC:4.1.1.37] [DE:*Bacillus subtilis*
penicillin binding protein 1A (ponA) gene; uroporphyrinogen decarboxylase
(hemE) gene; ferrochelatase (hemH) gene complete cds, (hemY) gene, complete
cds; ORFA, complete cds; ORFB 5' end.] [LE:1905] [RE:2966] [DI:direct]
>gp:[GI:e1183014:g2633348] [LN:BSUB0006] [AC:Z99109:AL009126]
[PN:uroporphyrinogen III decarboxylase] [GN:hemE] [FN:porphyrin
biosynthesis] [OR:*Bacillus subtilis*] [DB:genpept-bct1] [EC:4.1.1.37]
[DE:*Bacillus subtilis* complete genome (section 6 of 21): from 999501
to 1209940.] [SP:P32395] [LE:86090] [RE:87151] [DI:direct]
>gp:[GI:e325194:g2226230] [LN:BSY14083] [AC:Y14083] [PN:Uroporphyrinogen III
decarboxylase] [GN:hemE] [OR:*Bacillus subtilis*] [DB:genpept-bct1]
[EC:4.1.1.37] [DE:*Bacillus subtilis* chromosomal DNA, region 76–78 degrees:
between glyB-aprE.] [NT:see Swiss Prot P32395; DCUP_BACSU.] [SP:P32395]
[LE:5949] [RE:7010] [DI:direct]

| ORF Name | NT ID | AA ID | NT LN | AA LN | Score | P-Value |
|---|---|---|---|---|---|---|
| AI7503000993__4579675__f3__569 | 2308 | 6080 | 129 | 42 | | |

Description
NO-HIT

| ORF Name | NT ID | AA ID | NT LN | AA LN | Score | P-Value |
|---|---|---|---|---|---|---|
| AI7503000993__4693800__f2__225 | 2309 | 6081 | 570 | 189 | 191 | 4.3e-15 |

Description
pir:[LN:A69220] [AC:A69220] [PN:conserved hypothetical protein MTH898]
[GN:MTH898] [CL:*Escherichia coli* ybdQ protein] [OR:*Methanobacterium
thermoautotrophicum*] [DB:pir2] >gp:[GI:g2621993] [LN:AE000865]
[AC:AE000865:AE000666] [PN:conserved protein] [GN:MTH898]
[OR:*Methanobacterium thermoautotrophicum*] [DB genpept-bct1]
[DE:*Methanobacterium thermoautotrophicum* from bases 808939 to 820180 (section
71 of 148) of the complete genome.] [NT:Function Code:14.01 - Unknown,
Conserved protein;] CLE:6700] [RE:7149] [DI:direct]

| ORF Name | NT ID | AA ID | NT LN | AA LN | Score | P-Value |
|---|---|---|---|---|---|---|
| AI7503000993__4697318__c3__919 | 2310 | 6082 | 867 | 288 | 671 | 5.8e-66 |

Description
pir:[LN:H69998] [AC:H69998] [PN:hypothetical protein ytpQ] [GN:ytpQ]
[OR:*Bacillus subtilis*] [DB:pir2] >gp:[GI:e1185856:g2635467] [LN:BSUB0016]
[AC:Z99119:AL009126] [GN:ytpQ] [FN:unknown] [OR:*Bacillus subtilis*]
[DB:genpept-bct1] [DE:*Bacillus subtilis* complete genome (section 16 of 21):
from 2997771 to 3213410.] [LE:54676] [RE:55485] [DI:complement]
>gp:[GI:g2293212] [LN:AF008220] [AC:AF008220] [PN:YtpQ] [GN:ytpQ]
[OR:*Bacillus subtilis*] [DB:genpept-bct2] [DE:*Bacillus subtilis* rrnB-dnaB
genomic region.] [LE:124941] [RE:125750] [DI:direct]

| ORF Name | NT ID | AA ID | NT LN | AA LN | Score | P-Value |
|---|---|---|---|---|---|---|
| AI7503000993__472538__c1__707 | 2311 | 6083 | 144 | 47 | | |

Description
NO-HIT

| ORF Name | NT ID | AA ID | NT LN | AA LN | Score | P-Value |
|---|---|---|---|---|---|---|
| AI7503000993__4776702__c1__669 | 2312 | 6084 | 312 | 103 | 164 | 3.1e-12 |

Description
sp:[LN:YRKF_BACSU] [AC:P54433] [GN:YRKF] [OR:*BACILLUS SUBTILIS*]
[DE:HYPOTHETICAL 20.7 KD PROTEIN IN BLTR-SPOIIIC INTERGENIC REGION]
[SP:P54433] [DB:swissprot] >pir:[LN:D69976] [AC:D69976] [PN:conserved
hypothetical protein yrkF] [GN:yrkF] [OR:*Bacillus subtilis*] [DB:pir2]
>gp:[GI:d1013040:g1303705] [LN:BACJH642] [AC:D84432:D82370] [PN:YrkF]
[OR:*Bacillus subtilis*] [SR:*Bacillus subtilis* (strain:JH642 (trpC2 PheA1))
DNA] [DB:genpept-bct1] [DE:*Bacillus subtilis* DNA, 283 Kb region containing -continued skin element.] [LE:6477] [RE:7034] [DI:direct] >gp:[GI:e1183882:g2635098] [LN:BSUB0014] [AC:Z99117:AL009126] [GN:yrkF] [FN:unknown] [OR:*Bacillus subtilis*] [DB:genpept-bct1] [DE:*Bacillus subtilis* complete genome (section 14 of 21): from 2599451 to 2812870.] [NT:similar to hypothetical proteins from *B. subtilis*] [SP:P54433] [LE:112396] [RE:112953] [DI:complement]

| ORF Name | NT ID | AA ID | NT LN | AA LN | Score | P-Value |
|---|---|---|---|---|---|---|
| AI7503000993_4876300_c2_806 | 2313 | 6085 | 1695 | 564 | 1845 | 2.3e-190 |

Description
sp:[LN:FTHS_STRMU] [AC:Q59925:Q59926] [GN:FHS] [OR:*STREPTOCOCCUS MUTANS*] [EC:6.3.4.3] [DE:SYNTHETASE) (FHS) (FTHFS)] [SP:Q59925:Q59926] [DB:swissprot] >gp:[GI:g1103865] [LN:SMU39612] [AC:U39612] [PN:formyl-tetrahydrofolate synthetase] [GN:fhs] [FN:enzyme involved in the formation of] [OR:*Streptococcus mutans*] [DB:genpept-bct1] [EC:6.3.4.3] [DE:*Streptococcus mutans* formyl-tetrahydrofolate synthetase (fhs) gene, complete cds.] [NT:formyl-tetrahydrofolate ligase; ATP-dependant] [LE:115] [RE:1785] [DI:direct]

| ORF Name | NT ID | AA ID | NT LN | AA LN | Score | P-Value |
|---|---|---|---|---|---|---|
| AI7503000993_4876718_c1_617 | 2314 | 6086 | 1143 | 380 | 810 | 1.1e-80 |

Description
pir:[LN:E69824] [AC:E69824] [PN:two-component sensor histidine kinase homolog yhcY] [GN:yhcY] [OR:*Bacillus subtilis*] [DB:pir2] >gp:[GI:e1182921:g2633255] [LN:BSUB0005] [AC:Z99108:AL009126] [GN:yhcY] [FN:unknown] [OR:*Bacillus subtilis*] [DB:genpept-bct1] [DE:*Bacillus subtilis* complete genome (section 5 of 21): from 802821 to 1011250.] [NT:similar to two-component sensor histidine kinase] [LE:205305] [RE:206444] [DI:direct] >gp:[GI:e1182933:g2633267] [LN:BSUB0006] [AC:Z99109:AL009126] [GN:yhcY] [FN:unknown] [OR:*Bacillus subtilis*] [DB:genpept-bct1] [DE:*Bacillus subtilis* complete genome (section 6 of 21): from 999501 to 1209940.] [NT:similar to two-component sensor histidine kinase] [LE:8625] [RE:9764] [DI:direct] >gp:[GI:e1191876:g2226140] [LN:BSY14079] [AC:Y14079] [PN:hypothetical protein] [GN:yhcY] [OR:*Bacillus subtilis*] [DB:genpept-bct1] [DE:*Bacillus subtilis* chromosomal DNA, region 75 degrees: glpPFKDoperon and downstream.] [NT:similarity to the sensory transduction kinase degS] [LE:8273] [RE:9412] [DI:direct]

| ORF Name | NT ID | AA ID | NT LN | AA LN | Score | P-Value |
|---|---|---|---|---|---|---|
| AI7503000993_4882963_f3_591 | 2315 | 6087 | 834 | 277 | 457 | 2.8e-43 |

Description
sp:[LN:YHCT_BACSU] [AC:P54604] [GN:YHCT] [OR:*BACILLUS SUBTILIS*] [DE:HYPOTHETICAL 33.7 KD PROTEIN IN CSPB-GLPP INTERGENIC REGION] [SP:P54604] [DB:swissprot] >pir:[LN:H69823] [AC:H69823] [PN:conserved hypothetical protein yhcT] [GN:yhcT] [CL:conserved hypothetical protein H10176] [OR:*Bacillus subtilis*] [DB:pir2] >gp:[GI:e233879:g1239996] [LN:BS75DGREG] [AC:X96983] [PN:hypothetical protein] [GN:yhcT] [OR:*Bacillus subtilis*] [DB:genpept-bct1] [DE:*B. subtilis* chromosomal DNA (region 75 degrees:cspB upstream of glpPFKD operon).] [NT:Similarity to DRAP deaminase from *Saccharomyces*] [SP:P54604] [LE:16504] [RE:17412] [DI:complement] >gp:[GI:e1182910:g2633244] [LN:BSUB0005] [AC:Z99108:AL009126] [GN:yhcT] [FN:unknown] [OR:*Bacillus subtilis*] [DB:genpept-bct1] [DE:*Bacillus subtilis* complete genome (section 5 of 21): from 802821 to 1011250.] [NT:similar to hypothetical proteins] [SP:P54604] [LE:192310] [RE:193218] [DI:complement]

| ORF Name | NT ID | AA ID | NT LN | AA LN | Score | P-Value |
|---|---|---|---|---|---|---|
| AI7503000993_4938877_c2_778 | 2316 | 6088 | 147 | 48 | | |

Description
NO-HIT

| ORF Name | NT ID | AA ID | NT LN | AA LN | Score | P-Value |
|---|---|---|---|---|---|---|
| AI7503000993_5081252_f2_327 | 2317 | 6089 | 360 | 119 | 199 | 6.1e-16 |

Description
pir:[LN:A70341] [AC:A70341] [PN:conserved hypothetical protein aq_449] [GN:aq_449] [CL:hypothetical protein MJ1523] [OR:*Aquifex aeolicus*] [DB:pir2] >gp:[GI:g2983116] [LN:AE000690] [AC:AE000690:AE000657] [PN:hypothetical protein] [GN:aq_449] [OR:*Aquifex aeolicus*] [DB:genpept-bct2] [DE:*Aquifex aeolicus* section 22 of 109 of the complete genome.] [LE:10789] [RE:11163] [DI:direct]

-continued

| ORF Name | NT ID | AA ID | NT LN | AA LN | Score | P-Value |
|---|---|---|---|---|---|---|
| AI7503000993_5132078_c3_845 | 2318 | 6090 | 729 | 242 | 752 | 1.5e-74 |

Description
pir:[LN:H69334] [AC:H69334] [PN:glutamine transport protein glnQ] [GN:glnQ]
[CL:inner membrane protein malK:ATP-binding cassette homology]
[OR:*Archaeoglobus fulgidus*] [DB:pir2] >gp:[GI:g2649950] [LN:AE001058]
[AC:AE001058:AE000782] [PN:glutamine ABC transporter, ATP-binding protein]
[GN:AF0680] [OR:*Archaeoglobus fulgidus*] [DB:genpept-bct2] [DE:*Archaeoglobus fulgidus* section 49 of 172 of the complete genome.] [NT:similar to GB:M61017 SP:P27675 PID:142988 percent] [LE:10147] [RE:10875] [DI:complement]

| ORF Name | NT ID | AA ID | NT LN | AA LN | Score | P-Value |
|---|---|---|---|---|---|---|
| AI7503000993_5135265_c3_967 | 2319 | 6091 | 504 | 167 | 438 | 2.9e-41 |

Description
gp:[GI:g4982284] [LN:AE001810] [AC:AE001810:AE000512] [PN:conserved hypothetical protein] [GN:TM1707] [OR:*Thermotoga maritima*] [DB:genpept-bct2]
[DE:*Thermotoga maritima* section 122 of 136 of the complete genome.]
[NT:similar to GB:M15183 PID:468267 PID:2293279] [LE:13832] [RE:14302]
[DI:complement]

| ORF Name | NT ID | AA ID | NT LN | AA LN | Score | P-Value |
|---|---|---|---|---|---|---|
| AI7503000993_5273425_c2_735 | 2320 | 6092 | 1053 | 350 | 473 | 5.6e-45 |

Description
gp:[GI:g4981111] [LN:AE001734] [AC:AE001734:AE000512] [PN:amino acid ABC transporter, permease protein] [GN:TM0592] [OR:*Thermotoga maritima*]
[DB:genpept-bct2] [DE:*Thermotoga maritima* section 46 of 136 of the complete genome.] [NT:similar to GB:AE000782 percent identity:72.86;] [LE:3214]
[RE:3864] [DI:complement]

| ORF Name | NT ID | AA ID | NT LN | AA LN | Score | P-Value |
|---|---|---|---|---|---|---|
| AI7503000993_5355250_c1_696 | 2321 | 6093 | 1284 | 427 | 1343 | 3.6e-137 |

Description
sp:[LN:SYY_BACST] [AC:P00952] [GN:TYRS] [OR:*BACILLUS STEAROTHERMOPHILUS*]
[EC:6.1.1.1] [DE:TYROSYL-TRNA SYNTHETASE, (TYROSINE--TRNA LIGASE] [TYRRS)]
[SP:P00952] [DB:swissprot] >pir:[LN:SYBSYF] [AC:A01179:I40506]
[PN:tyrosine--tRNA ligase, :tyrosyl-tRNA synthetase] [CL:tyrosine--tRNA
ligase] [OR:*Bacillus stearothermophilus*] [EC:6.1.1.1] [DB:pir1]

| ORF Name | NT ID | AA ID | NT LN | AA LN | Score | P-Value |
|---|---|---|---|---|---|---|
| AI7503000993_551907_f3_559 | 2322 | 6094 | 708 | 235 | 183 | 3.0e-14 |

Description
gp:[GI:g2897104] [LN:AF020798] [AC:AF020798] [PN:putative host cell
surface-exposed lipoprotein] [OR:*Streptococcus thermophilus* bacteriophage
TP-J34] [DB:genpept-phg] [DE:*Streptococcus thermophilus* bacteriophage
lysogeny module, integrase homolog (int), putative host cell surface-exposed
lipoprotein, putative metallo-proteinase, repressor, Cro-like
regulatory protein, and P1-antirepressor homolog genes, complete cds.]
[NT:orf142] [LE:3941] [RE:4369] [DI:complement]

| ORF Name | NT ID | AA ID | NT LN | AA LN | Score | P-Value |
|---|---|---|---|---|---|---|
| AI7503000993_572186_c1_692 | 2323 | 6095 | 1284 | 427 | 190 | 2.4e-11 |

Description
pir:[LN:I51116] [AC:I51116] [PN:NF-180] [OR:*Petromyzon marinus*] [SR:, sea
lamprey] [DB:pir2] >gp:[GI:g632549] [LN:PMU19361] [AC:U19361] [PN:NF-180]
[OR:*Petromyzon marinus*] [SR:sea lamprey] [DB:genpept-vrtll] [DE:*Petromyzon marinus* neurofilament subunit NF-180 mRNA, complete cds.] [NT:180 kDa
neurofilament subunit] [LE:122] [RE:3454] [DI:direct]

| ORF Name | NT ID | AA ID | NT LN | AA LN | Score | P-Value |
|---|---|---|---|---|---|---|
| AI7503000993_581382_f2_281 | 2324 | 6096 | 183 | 60 | 46 | 0.040 |

Description
sp:[LN:PA2A_PSETE] [AC:P23026] [OR:*PSEUDONAJA TEXTILIS*] [SR:,EASTERN BROWN
SNAKE] [EC:3.1.1.4] [DE:PHOSPHOLIPASE A2 HOMOLOG, TEXTILOTOXIN A CHAIN,]
[SP:P23026] [DB:swissprot] >pir:[LN:S29651] [AC:S29651] [PN:textilotoxin
chain A] [CL:phospholipase A2] [OR:*Pseudonaja textilis*] [SR:, eastern brown -continued snake] [DB:pir2]

| ORF Name | NT ID | AA ID | NT LN | AA LN | Score | P-Value |
|---|---|---|---|---|---|---|
| AI7503000993_5882753_c3_956 | 2325 | 6097 | 273 | 90 | | |

Description
NO-HIT

| ORF Name | NT ID | AA ID | NT LN | AA LN | Score | P-Value |
|---|---|---|---|---|---|---|
| AI7503000993_5911592_c3_887 | 2326 | 6098 | 924 | 307 | 89 | 0.0048 |

Description
gp:[GI:e1347496:g3877859] [LN:CEF58G6] [AC:Z68217] [GN:F58G6.1] [OR:*Caenorhabditis elegans*] [DB:genpept-inv1] [DE:*Caenorhabditis elegans* cosmid F58G6, complete sequence.] [NT:Similarity to Chicken amphiphysin (PIR Acc. No.] [LE:4939:5597:5746] [RE:5253:5662:5844] [DI:complementJoin]

| ORF Name | NT ID | AA ID | NT LN | AA LN | Score | P-Value |
|---|---|---|---|---|---|---|
| AI7503000993_6070392_c3_911 | 2327 | 6099 | 708 | 235 | 458 | 2.2e-43 |

Description
gp:[GI:g4980760] [LN:AE001708] [AC:AE001708:AE000512] [PN:16S pseudouridylate synthase] [GN:TM0264] [OR:*Thermotoga maritima*] [DB:genpept-bct2] [DE:*Thermotoga maritima* section 20 of 136 of the complete genome.] [NT:similar to SP:P33918 PID:405907 GB:U00096] [LE:17059] [RE:1777811 [DI:direct]

| ORF Name | NT ID | AA ID | NT LN | AA LN | Score | P-Value |
|---|---|---|---|---|---|---|
| AI7503000993_6100150_c3_881 | 2328 | 6100 | 189 | 62 | | |

Description
NO-HIT

| ORF Name | NT ID | AA ID | NT LN | AA LN | Score | P-Value |
|---|---|---|---|---|---|---|
| AI7503000993_6125262_c2_840 | 2329 | 6101 | 192 | 63 | 71 | 0.022 |

Description
pir:[LN:S72295] [AC:572295] [PN:ribosomal protein S8] [GN:rps8] [OR:plastid *Plasmodium falciparum*] [DB:pir2] >gp:IIGI:e220199:g1171601] [LN:PFCOMPIRB] [AC:X95276] [GN:rps8] [OR:*Plasmodium falciparum*] [SR:malaria parasite *P. falciparum*] [DB:genpept-inv1] [DE:*P. falciparum* complete gene map of plastid-like DNA (IR-B).] [LE:5492] [RE:5878] [DI:direct]

| ORF Name | NT ID | AA ID | NT LN | AA LN | Score | P-Value |
|---|---|---|---|---|---|---|
| AI7503000993_6317_c1_687 | 2330 | 6102 | 411 | 136 | 267 | 3.8e-23 |

Description
pir:[LN:G69998] [AC:G69998] [PN:thioredoxin Hi homolog ytpP] [GN:ytpP] [CL:thioredoxin:thioredoxin homology] [OR:*Bacillus subtilis*] [DB:pir2] >gp:[GI:e1185857:g2635468] [LN:BSUB0016] [AC:Z99119:AL009126] [GN:ytpP] [FN:unknown] [OR:*Bacillus subtilis*] [DB:genpept-bct1] [DE:*Bacillus subtilis* complete genome (section 16 of 21): from 2997771 to 3213410.] [NT:similar to thioredoxin H1] [LE:55500] [RE:55823] [DI:complement] >gp:[GI:g2293211] [LN:AF008220] [AC:AF008220] [PN:putative thioredoxin] [GN:ytpP] [OR:*Bacillus subtilis*] [DB:genpept-bct2] [DE:*Bacillus subtilis* rrnB-dnaB genomic region.] [LE:124603] [RE:124926] [DI:direct]

| ORF Name | NT ID | AA ID | NT LN | AA LN | Score | P-Value |
|---|---|---|---|---|---|---|
| AI7503000993_6689717_c3_849 | 2331 | 6103 | 615 | 204 | 72 | 0.0043 |

Description
gp:[GI:g4105715] [LN:AF050754] [AC:AF050754] [PN:glucose 6-phosphate isomerase] [GN:GPI1] [OR:*Giardia intestinalis*] [DB:genpept-inv2] [EC:5.3.1.10] [DE:*Giardia intestinalis* glucose 6-phosphate isomerase (GPI1) gene, complete cds.] [NT:aminating isomerase] [LE:432] [RE:1232] [DI:direct]

| ORF Name | NT ID | AA ID | NT LN | AA LN | Score | P-Value |
|---|---|---|---|---|---|---|
| AI7503000993_6828305_f3_438 | 2332 | 6104 | 132 | 43 | | |

Description
NO-HIT

-continued

| ORF Name | NT ID | AA ID | NT LN | AA LN | Score | P-Value |
|---|---|---|---|---|---|---|
| AI7503000993_6906300_c2_826 | 2333 | 6105 | 1014 | 337 | 519 | 7.5e-50 |

Description
sp:[LN:YTXK_BACSU] [AC:P37876] [GN:YTXK] [OR:*BACILLUS SUBTILIS*]
[DE:HYPOTHETICAL 37.4 KD PROTEIN IN ACKA-SSPA INTERGENIC REGION] [SP:P37876]
[DB:swissprot] >pir:[LN:G70003] [AC:G70003:A49935] [PN:hypothetical protein
ytxK:hypothetical protein (ackA 5' region)] [GN:ytxK] [OR:*Bacillus
subtilis*] [DB:pir2] >gp:[GI:e1185821:g2635432] [LN:BSUB0016]
[AC:Z99119:AL009126] [GN:ytxK] [FN:unknown] [OR:*Bacillus subtilis*]
[DB:genpept-bct1] [DE:*Bacillus subtilis* complete genome (section 16 of 21):
from 2997771 to 3213410.] [NT:alternate gene name:ythI] [SP:P37876]
[LE:17948] [RE:18937] [DI:complement] >gp:[GI:g2293239] [LN:AF008220]
[AC:AF008220] [PN:YtxK] [GN:ytxK] [OR:*Bacillus subtilis*] [DB:genpept-bct2]
[DE:*Bacillus subtilis* rrnB-dnaB genomic region.] [NT:similarity to
modification metilase AccI] [LE:161490] [RE:162479] [DI:direct]

| ORF Name | NT ID | AA ID | NT LN | AA LN | Score | P-Value |
|---|---|---|---|---|---|---|
| AI7503000993_6929651_c3_858 | 2334 | 6106 | 366 | 121 | 289 | 1.8e-25 |

Description
pir:[LN:A69828] [AC:A69828] [PN:hypothetical protein yheA] [GN:yheA]
[OR:*Bacillus subtilis*] [DB:pir2] >gp:[GI:e118298l:g2633315] [LN:BSUB0006]
[AC:Z99109:AL009126] [GN:yheA] [FN:unknown] [OR:*Bacillus subtilis*]
[DB:genpept-bct1] [DE:*Bacillus subtilis* complete genome (section 6 of 21):
from 999501 to 1209940.] LE:54726] [RE:55079] [DI:direct]
>gp:[GI:e324964:g2226157] [LN:BSY14080] [AC:Y14080] [PN:hypothetical
protein] [GN:yheA] [OR:*Bacillus subtilis*] [DB:genpept-bct1] [DE:*Bacillus
subtilis* chromosomal DNA, region 75 degrees:sspB upstream of glyB.]
[LE:6651] [RE:7004] [DI:complement]

| ORF Name | NT ID | AA ID | NT LN | AA LN | Score | P-Value |
|---|---|---|---|---|---|---|
| AI7503000993_2335 | 6107 | 3204 | 1067 | 1849 | 5.1e-212 | |

Description
sp:[LN:DP3A_BACSU] [AC:O34623] [GN:DNAE] [OR:*BACILLUS SUBTILIS*] [EC:2.7.7.7]
[DE:DNA POLYMERASE III, ALPHA CHAIN,] [SP:O346231 [DB:swissprot]
>pir:[LN:D69617] [AC:D69617] [PN:DNA polymerase III (alpha subunit) dnaE]
[GN:dnaE] [CL:DNA-directed DNA polymerase III alpha chain] [OR:*Bacillus
subtilis*] [DB:pir2] >gp:[GI:e1184172:g2635388] [LN:BSUB0015]
[AC:Z99118:AL009126] [PN:DNA polymerase III (alpha subunit)] [GN:dnaE]
[OR:*Bacillus subtilis*] [DB:genpept-bct1] [DE:*Bacillus subtilis* complete
genome (section 15 of 21): from 2795131 to 3013540.] [SP:O34623] [LE:195212]
[RE:198559] [DI:complement] >gp:[GI:g2293260] [LN:AF008220] [AC:AF008220]
[PN:DNA-polymerase III alpha-chain] [GN:dnaE] [OR:*Bacillus subtilis*]
[DB:genpept-bct2] [DE:*Bacillus subtilis* rrnB-dnaB genomic region.]
[LE:184508] [RE:187855][DI:direct]

| ORF Name | NT ID | AA ID | NT LN | AA LN | Score | P-Value |
|---|---|---|---|---|---|---|
| AI7503000993_7244012_c1_723 | 2336 | 6108 | 1287 | 428 | 1768 | 3.3e-182 |

Description
gp:[GI:e320380:g2168132] [LN:BIISOCIT] [AC:Y13358] [PN:isocitrate
dehydrogenase] [OR:*Bacillus israeli] [DB:genpept-bct1] [DE:Bacillus israeli*
isocitrate dehydrogenase gene.] [LE:242] [RE:15191 [DI:direct]

| ORF Name | NT ID | AA ID | NT LN | AA LN | Score | P-Value |
|---|---|---|---|---|---|---|
| AI7503000993_785952_c1_688 | 2337 | 6109 | 459 | 152 | 380 | 4.0e-35 |

Description
pir:[LN:A69999] [AC:A69999] [PN:phenylalanyl-tRNA synthetase (beta subunit)
homolog ytpR] [GN:ytpR] [CL:*Mycoplasma genitalium* hypothetical protein
MG449] [OR:*Bacillus subtilis*] [DB:pir2] >gp:[GI:e1185855:g2635466]
[LN:BSUB0016] [AC:Z99119:AL009126] [GN:ytpR] [FN:unknown] [OR:*Bacillus
subtilis*] [DB:genpept-bct1] [DE:*Bacillus subtilis* complete genome (section
16 of 21): from 2997771 to 3213410.] [NT:similar to phenylalanyl-tRNA
synthetase (beta) [LE:54055] [RE:54660] [DI:complement] >gp:[GI:g2293213]
[LN:AF008220] [AC:AF008220] [PN:YtpR] [GN:ytpR] [OR:*Bacillus subtilis*]
[DB:genpept-bct2] [DE:*Bacillus subtilis* rrnB-dnaB genomic region.]
[NT:similarity to phenylalanine tRNA ligase of *E. coli*] [LE:125766]
[RE:126371] [DI:direct]

| ORF Name | NT ID | AA ID | NT LN | AA LN | Score | P-Value |
|---|---|---|---|---|---|---|

|  | -continued | | | | | |
|---|---|---|---|---|---|---|
| AI7503000993_803393_c3_947 | 2338 | 6110 | 732 | 243 | 536 | 1.2e-51 |

Description
pir:[LN:H69407] [AC:H69407] [PN:conserved hypothetical protein AF1265]
[CL:conserved hypothetical protein MJ1163] [OR:*Archaeoglobus fulgidus*]
[DB:pir2] >gp:[GI:g2649315] [LN:AE001017] [AC:AE001017:AE000782]
[PN:conserved hypothetical protein] [GN:AF1265] [OR:*Archaeoglobus fulgidus*]
[DB:genpept-bct2] [DE:*Archaeoglobus fulgidus* section 90 of 172 of the
complete genome.] [NT:similar to GB:L77117 PID:1591789 percent identity:]
[LE:9248] [RE:9943] [DI:complement]

| ORF Name | NT ID | AA ID | NT LN | AA LN | Score | P-Value |
|---|---|---|---|---|---|---|
| AI7503000993_817555_f2_358 | 2339 | 6111 | 447 | 148 | | |

Description
NO-HIT

| ORF Name | NT ID | AA ID | NT LN | AA LN | Score | P-Value |
|---|---|---|---|---|---|---|
| AI7503000993_824086_c3_952 | 2340 | 6112 | 882 | 293 | 859 | 7.0e-86 |

Description
pir:[LN:G70001] [AC:G70001] [PN:acetyl-CoA carboxylase homolog yttI]
[GN:yttI] [CL:acetyl-CoA carboxylase, carboxyltransferase beta chain]
[OR:*Bacillus subtilis*] [DB:pir2] >gp:[GI:e1184170:g2635386] [LN:BSUB0015]
[AC:Z99118:AL009126] [GN:yttI] [FN:unknown] [OR:*Bacillus subtilis*]
[DB:genpept-bct1] [DE:*Bacillus subtilis* complete genome (section 15 of 21):
from 2795131 to 3013540.] [NT:similar to acetyl-CoA carboxylase] [LE:192636]
[RE:193424] [DI:complement] >gp:[GI:g2293262] [LN:AF008220] [AC:AF008220]
[PN:acetyl-CoA carboxylase subunit] [GN:yttI] [OR:*Bacillus subtilis*]
[DB:genpept-bct2] [DE:*Bacillus subtilis* rrnB-dnaB genomic region.]
[LE:189643] [RE:19043111] [DI:direct]

| ORF Name | NT ID | AA ID | NT LN | AA LN | Score | P-Value |
|---|---|---|---|---|---|---|
| AI7503000993_82562_f3_523 | 2341 | 6113 | 1110 | 369 | 680 | 6.5e-67 |

Description
pir:[LN:H69758] [AC:H69758] [PN:proline oxidase homolog ycgM] [GN:ycgM]
[CL:proline dehydrogenase homolog yusM] [OR:*Bacillus subtilis*] [DB:pir2]
>gp:[GI:e1182272:g2632606] [LN:BSUB0002] [AC:Z99105:AL009126] [GN:ycgM]
[FN:unknown] [OR:*Bacillus subtilis*] [DB:genpept-bct1] [DE:*Bacillus subtilis*
complete genome (section 2 of 21): from 194651 to 415810.] [NT:similar to
proline oxidase] [LE:149473] [RE:150384] [DI:direct]
>gp:[GI:d1009589:g1805392] [LN:D50453] [AC:D50453] [GN:ycgM] [OR:*Bacillus
subtilis*] [SR:*Bacillus subtilis* (strain:168 trpC2) DNA] [DB:genpept-bct1]
[DE:*Bacillus subtilis* DNA for 25–36 degree region containing the amyE-srfA
region, complete cds.] [LE:23774] [RE:24685] [DI:direct]

| ORF Name | NT ID | AA ID | NT LN | AA LN | Score | P-Value |
|---|---|---|---|---|---|---|
| AI7503000993_867187_c3_851 | 2342 | 6114 | 126 | 41 | | |

Description
NO-HIT

| ORF Name | NT ID | AA ID | NT LN | AA LN | Score | P-Value |
|---|---|---|---|---|---|---|
| AI7503000993_954768_c3_892 | 2343 | 6115 | 1053 | 350 | 611 | 1.3e-59 |

Description
sp:[LN:RIBG_BACSU] [AC:P17618] [GN:RIBG] [OR:*BACILLUS SUBTILIS*] [EC:3.5.4.—]
[DE:RIBOFLAVIN-SPECIFIC DEAMINASE,] [SP:P17618] [DB:swissprot]
>pir:[LN:PN0100] [AC:S45543:PN0100:E69692] [PN:riboflavin-specific
deaminase ribG] [GN:ribG] [OR:*Bacillus subtilis*] [DB:pir2] >gp:[GI:g4l0125]
[LN:BACDIA] [AC:L09228] [GN:ribG] [OR:*Bacillus subtilis*] [SR:*Bacillus
subtilis* (strain 168, sub_species Marburg) DNA] [DB:genpept-bct1]
[DE:*Bacillus subtilis* spoVA to serA region.] [LE:8266] [RE:9351] [DI:direct]
>gp:[GI:g40085] [LN:BSRIB] [AC:X51510] [OR:*Bacillus subtilis*]
[DB:genpept-bct1] [DE:*B. subtilis* riboflavin biosynthesis operon ribG, ribB,
ribA, ribH, and ribT genes.] [NT:ribG protein product (AA 1–361)] [SP:P17618]
[LE:1212] [RE:2297] [DI:direct] >gp:[GI:e1185597:g2634763] [LN:BSUB0013]
[AC:Z99116:AL009126] [PN:riboflavin-specific deaminase] [GN:ribG]
[FN:riboflavin biosynthesis] [OR:*Bacillus subtilis*] [DB:genpept-bct1]
[DE:*Bacillus subtilis* complete genome (section 13 of 21): from 2395261 to
2613730.] [SP:P17618] [LE:34232] [RE:35317] [DI:complement]

-continued

| ORF Name | NT ID | AA ID | NT LN | AA LN | Score | P-Value |
|---|---|---|---|---|---|---|
| AI7503000993_960012_c1_663 | 2344 | 6116 | 450 | 149 | 123 | 6.9e-08 |

Description
gp:[GI:g3283053] [LN:AF054173] [AC:AF054173] [PN:*staphylococcal* accessory
regulator A homolog] [GN:sarA] [OR:*Staphylococcus epidermidis*]
[DB:genpept-bct2] [DE:*Staphylococcus epidermidis staphylococcal* accessory
regulator Ahomolog (sarA) gene, complete cds.] [LE:887] [RE:1261]
[DI direct]

| ORF Name | NT ID | AA ID | NT LN | AA LN | Score | P-Value |
|---|---|---|---|---|---|---|
| AI7503000993_961562_f3_433 | 2345 | 6117 | 126 | 41 | | |

Description
NO-HIT

| ORF Name | NT ID | AA ID | NT LN | AA LN | Score | P-Value |
|---|---|---|---|---|---|---|
| AI7503000993_9785187_c3_867 | 2346 | 6118 | 171 | 56 | | |

Description
NO-HIT

| ORF Name | NT ID | AA ID | NT LN | AA LN | Score | P-Value |
|---|---|---|---|---|---|---|
| AI7503000993_9845327_c1_648 | 2347 | 6119 | 192 | 63 | | |

Description
NO-HIT

| ORF Name | NT ID | AA ID | NT LN | AA LN | Score | P-Value |
|---|---|---|---|---|---|---|
| AI7503000993_9884378_c3_916 | 2348 | 6120 | 156 | 51 | | |

Description
NO-HIT

| ORF Name | NT ID | AA ID | NT LN | AA LN | Score | P-Value |
|---|---|---|---|---|---|---|
| AI7503000994_10240925_c2_505 | 2349 | 6121 | 252 | 83 | 65 | 0.024 |

Description
gp:[GI:d1037669:g4126667] [LN:AB016427] [AC:AB016427] [PN:transmembrane
protein] [GN:bacM] [OR:*Bacillus licheniformis*] [SR:*Bacillus licheniformis*
(strain:ATCC 10716) DNA] [DB:genpept-bct1] [DE:*Bacillus licheniformis* genes
for transmemibrane protein, thioesterase II-like protein and bacitracin
synthetase 1 (BA1),complete and partial cds.] [NT:putative] [LE:694]
(RE:>1956) [DI:direct]

| ORF Name | NT ID | AA ID | NT LN | AA LN | Score | P-Value |
|---|---|---|---|---|---|---|
| AI7503000994_10553827_c3_663 | 2350 | 6122 | 216 | 71 | 132 | 7.6e-09 |

Description
pir:[LN:F69808] [AC:F69808] [PN:hypothetical protein yfkK] [GN:yfkK]
[OR:*Bacillus subtilis*] [DB:pir2] >gp:[GI:e1182777:g2633111] [LN:BSUB0005]
[AC:Z99108:AL009126] [GN:yfkK] [FN:unknown] [OR:*Bacillus subtilis*]
[DB:genpept-bct1] [DE:*Bacillus subtilis* complete genome (section 5 of 21):
from 802821 to 1011250.] [LE:58273] [RE:58488] [DI:complement]
>gp:[GI:d1024280:g2626823] [LN:D83967] [AC:D83967] [PN:YfkK] [OR:*Bacillus
subtilis*] [SR:*Bacillus subtilis* (strain:AC327) DNA] [DB:genpept-bct1]
[DE:*Bacillus subtilis* genomic DNA, 74 degree region.] [LE:9433] [RE:9648]
[DI direct]

| ORF Name | NT ID | AA ID | NT LN | AA LN | Score | P-Value |
|---|---|---|---|---|---|---|
| AI7503000994_11125052_c1_439 | 2351 | 6123 | 1497 | 498 | 1715 | 1.4e-176 |

Description
pir:[LN:D70008] [AC:D70008] [PN:nicotinate phosphoribosyltransferase
homolog yueK] [GN:yueK] [OR:*Bacillus subtilis*] [DB:pir2]
>gp:[GI:e1184252:g2635670] [LN:BSUB0017] [AC:Z99120:AL009126] [GN:yueK]
[FN:unknown] [OR:*Bacillus subtilis*] [DB:genpept-bct1] [DE:*Bacillus subtilis*
complete genome (section 17 of 21): from 3197001 to 3414420.] [NT:similar to
nicotinate phosphoribosyltransferase] [LE:61479] [RE:62951] [DI:complement]

-continued

| ORF Name | NT ID | AA ID | NT LN | AA LN | Score | P-Value |
|---|---|---|---|---|---|---|
| AI7503000994_11755317_c3_655 | 2352 | 6124 | 759 | 252 | 135 | 4.4e-07 |

Description
pir:[LN:G70045] [AC:G70045] [PN:hypothetical protein yvqF] [GN:yvqF]
[OR:*Bacillus subtilis*] [DB:pir2] >gp:[GI:e1249815:g2832819] [LN:BS43KBDNA]
[AC:AJ223978] [PN:YvqF protein] [GN:yvqF] [OR:*Bacillus subtilis*]
[DB:genpept-bct1] [DE:*Bacillus subtilis* 42.7kB DNA fragment from yvsA to
yvqA.] [LE:31389] [RE:32114] [DI:direct] >gp:[GI:e1184389:g2635807]
[LN:BSUB0017] [AC:Z99120:AL009126] [GN:yvqF] [FN:unknown] [OR:*Bacillus subtilis*] [DB:genpept-bct1] [DE:*Bacillus subtilis* complete genome (section
17 of 21): from 3197001 to 3414420.] LE:198173] [RE:198898] [DI:complement]

| ORF Name | NT ID | AA ID | NT LN | AA LN | Score | P-Value |
|---|---|---|---|---|---|---|
| AI7503000994_117687_c1_441 | 2353 | 6125 | 1377 | 458 | 1704 | 2.0e-175 |

Description
sp:[LN:PUR8_BACSU] [AC:P12047] [GN:PURB:PURE] [OR:*BACILLUS SUBTILIS*]
[EC:4.3.2.2] [DE:ADENYLOSUCCINATE LYASE, (ADENYLOSUCCINASE) ASL)]
[SP:P12047] [DB:swissprot] >pir:[LN:WZBSDS] [AC:C29326:A69684]
[PN:adenylosuccinate lyase,] [GN:purB] [CL:fumarate hydratase] [OR:*Bacillus subtilis*] [EC:4.3.2.2] [DB:pir1] [MP:18 min] >gp:[GI:g143366] [LN:BACPURF]
[AC:J02732:K00047] [OR:*Bacillus subtilis*] [SR:*B. subtilis* (strain DE1
(prototroph DER. or W168)) DNA, clone pPZ] [DB:genpept-bct1] [DE:*B. subtilis*
pur operon encoding purine biosynthesis enzymes, 12 genes.]
[NT:adenylosuccinate lyase (PUR-B) [LE:2056] [RE:3351] [DI:direct]
>gp:[GI:e1182624:g2632958] [LN:BSUB0004] [AC:Z99107:AL009126]
[PN:adenylosuccinate lyase] [GN:purB] [FN:purine biosynthesis] [OR:*Bacillus subtilis*] [DB:genpept-bct1] [EC:4.3.2.2] [DE:*Bacillus subtilis* complete
genome (section 4 of 21): from 600701 to 813890.] [SP:P12047] [LE:99038]
[RE:100333] [DI:direct]

| ORF Name | NT ID | AA ID | NT LN | AA LN | Score | P-Value |
|---|---|---|---|---|---|---|
| AI7503000994_11959438_c2_534 | 2354 | 6126 | 135 | 44 | | |

Description
NO-HIT

| ORF Name | NT ID | AA ID | NT LN | AA LN | Score | P-Value |
|---|---|---|---|---|---|---|
| AI7503000994_1214075_f3_332 | 2355 | 6127 | 507 | 168 | 328 | 1.3e-29 |

Description
gp:[GI:g4981674] [LN:AE001770] [AC:AE001770:AE000512] [PN:ferritin]
[GN:TM1128] [OR:*Thermotoga maritima*] [DB:genpept-bct2] [DE:*Thermotoga maritima* section 82 of 136 of the complete genome.] [NT:similar to
GB:AE000782 percent identity:71.95;] [LE:15936] [RE:16430] [DI:direct]

| ORF Name | NT ID | AA ID | NT LN | AA LN | Score | P-Value |
|---|---|---|---|---|---|---|
| AI7503000994_12142768_f1_9 | 2356 | 6128 | 300 | 99 | 110 | 4.2e-06 |

Description
pir:[LN:D71245] [AC:D71245] [PN:hypothetical protein PH0221] [GN:PH0221]
[OR:*Pyrococcus horikoshii*] [DB:pir2] >gp:[GI:d1030234:g3256608]
[LN:AP000001]
[AC:AP000001:AB009465:AB009464:AB009466:AB009467:AB009468:AB009469]
[PN:235aa long hypothetical protein] [GN:PH0221] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1-287000 nt. position (1/7).] [LE:194212]
[RE:194919] [DI:complement]

| ORF Name | NT ID | AA ID | NT LN | AA LN | Score | P-Value |
|---|---|---|---|---|---|---|
| AI7503000994_12270011_f2_269 | 2357 | 6129 | 180 | 59 | 239 | 3.5e-20 |

Description
gp:[GI:e1311097:g3320009] [LN:SEHLDGN] [AC:Z49220] [GN:agrD]
[OR:*Staphylococcus epidermidis*] [DB:genpept-bct1] [DE:*Staphylococcus epidermidis* hld and agr[A,B,C,D] genes.] [LE:1327] [RE:1467] [DI:direct]

| ORF Name | NT ID | AA ID | NT LN | AA LN | Score | P-Value |
|---|---|---|---|---|---|---|
| AI7503000994_12531558_f3_283 | 2358 | 6130 | 351 | 116 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000994_12603166_f3_301 | 2359 | 6131 | 303 | 100 | 100 | 1.9e-05 |

Description
pir:[LN:G71244] [AC:G71244] [PN:hypothetical protein PH0217] [GN:PH0217]
[OR:*Pyrococcus horikoshii*] [DB:pir2] >gp:[GI:d1030229:g3256603]
[LN:AP000001]
[AC:AP000001:AB009465:AB009464:A5009466:AB009467:AB009468:AB009469]
[PN:106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1-287000 nt. position (1/7).] [LE:191072]
[RE:191392] [DI:complement]

| ORF Name | NT ID | AA ID | NT LN | AA LN | Score | P-Value |
|---|---|---|---|---|---|---|
| AI7503000994_1287557_f1_56 | 2360 | 6132 | 213 | 70 | | |

| Description | | | | | | |
|---|---|---|---|---|---|---|
| NO-HIT | | | | | | |
| ORF Name | NT ID | AA ID | NT LN | AA LN | Score | P-Value |
| AI7503000994_13678131_f3_393 | 2361 | 6133 | 840 | 279 | 299 | 1.5e-26 |

Description
pir:[LN:E69787] [AC:E69787] [PN:hypothetical protein ydiL] [GN:ydiL]
[OR:*Bacillus subtilis*] [DB:pir2] >gp:[GI:e1182580:g2632914] [LN:BSUB0004]
[AC:Z99107:AL009126] [GN:ydiL] [FN:unknown] [OR:*Bacillus subtilis*]
[DB:genpept-bct1] [DE:*Bacillus subtilis* complete genome (section 4 of 21):
from 600701 to 813890.] [LE:47946] [RE:48680] [DI:complement]
>gp:[GI:d1020504:g1945117] [LN:D88802] [AC:D88802] [GN:ydiL] [OR:*Bacillus subtilis*] [SR:*Bacillus subtilis* (sub_species:Marburg, strain:168,
isolate:JH642] [DB:genpept-bct1] [DE:*Bacillus subtilis* DNA for
phoB-rrnE-groESL region, complete cds.] [NT:transmembrane] [LE:34948]
[RE:35682] [DI:complement]

| ORF Name | NT ID | AA ID | NT LN | AA LN | Score | P-Value |
|---|---|---|---|---|---|---|
| AI7503000994_1377337_c3_668 | 2362 | 6134 | 840 | 279 | 602 | 1.2e-58 |

Description
gp:[GI:g310603] [LN:STAORFPHI] [AC:L19300] [OR:*Staphylococcus aureus*]
[SR:*Staphylococcus aureus* (library:NCTC 8325) DNA] [DB:genpept-bct1]
[DE:*Staphylococcus aureus* DNA sequence encoding three ORFs, complete cds;
prophage phi-11 sequence homology, 5' flank.] [LE:2651] [RE:3100]
[DI:direct]

| ORF Name | NT ID | AA ID | NT LN | AA LN | Score | P-Value |
|---|---|---|---|---|---|---|
| AI7503000994_13837927_c2_518 | 2363 | 6135 | 1155 | 384 | 621 | 1.2e-60 |

Description
sp:[LN:TNPA_STAAU] [AC:P06696] [GN:TNPA] [OR:*STAPHYLOCOCCUS AUREUS*]
[DE:TRANSPOSASE A (TRANSPOSON TN554)] [SP:P06696] [DB:swissprot]
>pir:[LN:A24584] [AC:A24584] [PN:transposition regulatory protein tnpA]
[GN:tnpA] [OR:*Staphylococcus aureus*] [DB:pir2] >gp:[GI:g581277]
[LN:ISTN554] [AC:X03216:K02987] [PN:tnpA protein] [GN:tnpA]
[OR:*Staphylococcus aureus*] [DB genpept-bct1] [DE:*Staphylococcus aureus*
transposon Tn554.] [NT:(aa 1-361)] [SP:P06696] [LE:134] [RE:1219]
[DI:direct] >gp:[GI:d1046007:g5360831] [LN:D86934] [AC:D86934]
[PN:transposaseA] [OR:*Staphylococcus aureus*] [SR:*Staphylococcus aureus*
(strain:N315) DNA, clone_lib:library of N31] [DB:genpept] [DE:*Staphylococcus aureus* genes, mec region, partial and complete cds.] [NT:ORF N045; tnpA]
[LE:29383] [RE:30468] [DI:direct]

| ORF Name | NT ID | AA ID | NT LN | AA LN | Score | P-Value |
|---|---|---|---|---|---|---|
| AI7503000994_13851088_c3_609 | 2364 | 6136 | 1089 | 362 | 185 | 6.2e-14 |

Description
gp:[GI:g1947171] [LN:CELE03H12] [AC:AF000299] [GN:E03H12.5]
[OR:*Caenorhabditis elegans*] [SR:*Caenorhabditis elegans* strain=Bristol N2]
[DB:genpept-inv2] [DE:*Caenorhabditis elegans* cosmid E03H12.] [NT:coded for -continued by *C. elegans* cDNA yk170g3.5] [LE:1043:1176:1733] [RE:1131:1689:1762]
[DI:directJoin]

| ORF Name | NT ID | AA ID | NT LN | AA LN | Score | P-Value |
|---|---|---|---|---|---|---|
| AI7503000994__1385927__c1__442 | 2365 | 6137 | 711 | 236 | 851 | 4.9e-85 |

Description
sp:[LN:PCRB_STAAU] [AC:Q53726] [OR:*STAPHYLOCOCCUS AUREUS*] [DE:PCRB PROTEIN]
[SP:Q53726] [DB:swissprot] >pir:[LN:S39922] [AC:S39922:S27666 ] [PN:pcrB
protein] [CL:pcrB protein] [OR:*Staphylococcus aureus*] [DB:pir2]
>gp:[GI:g153061] [LN:STAPCRA] [AC:M63176] [GN:pcrA] [OR:*Staphylococcus
aureus*] [SR:*Staphylococcus aureus* (strain SA20) DNA] [DB:genpept-bct1]
[DE:*Staphylococcus aureus* helicase required for T181 replication (pcrA) gene,
complete cds.] [LE:256] [RE:939] [DI:direct]

| ORF Name | NT ID | AA ID | NT LN | AA LN | Score | P-Value |
|---|---|---|---|---|---|---|
| AI7503000994__1410277__f1__15 | 2366 | 6138 | 153 | 50 | | |

Description
NO-HIT

| ORF Name | NT ID | AA ID | NT LN | AA LN | Score | P-Value |
|---|---|---|---|---|---|---|
| AI7503000994__1414005__c1__477 | 2367 | 6139 | 579 | 192 | 324 | 3.4e-29 |

Description
pir:[LN:F69815] [AC:F69815] [PN:hypothetical protein ygaC] [GN:ygaC]
[OR:*Bacillus subtilis*] [DB:pir2] >gp:[GI:e1182857:g2633191] [LN:BSUB0005]
[AC:Z99108:AL009126] [GN:ygaC] [FN:unknown] [OR:*Bacillus subtilis*]
[DB:genpept-bct1] [DE:*Bacillus subtilis* complete genome (section 5 of 21):
from 802821 to 1011250.] [LE:135417] [RE:135734] [DI:direct]
>gp]GI:e281578:g1673391] [LN:BSZ82044] [AC:Z82044] [PN:hypothetical 12.2 kd
protein] [GN:ygaC] [OR:*Bacillus subtilis*] [DB:genpept-bct1] [DE:*B. subtilis*
25 kb genomic DNA segment (from sspE to katA).] [LE:2267] [RE:2584]
[DI:direct]

| ORF Name | NT ID | AA ID | NT LN | AA LN | Score | P-Value |
|---|---|---|---|---|---|---|
| AI7503000994__14460882__c3__694 | 2368 | 6140 | 240 | 79 | 365 | 1.6e-33 |

Description
gp:[GI:g1022726] [LN:SHU35635] [AC:U35635] [PN:unknown] [OR:*Staphylococcus
haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000994__14460882__f2__232 | 2369 | 6141 | 126 | 41 | 99 | 9.9e-05 |

Description
gp:[GI:g1022726] [LN:SHU35635] [AC:U35635][PN:unknown] [OR:*Staphylococcus
haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000994__14581306__f3__377 | 2370 | 6142 | 303 | 100 | 160 | 8.2e-12 |

Description
gp:[GI:g3676415] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf149] [LE:2068] [RE:2484]
[DI:complement]

| ORF Name | NT ID | AA ID | NT LN | AA LN | Score | P-Value |
|---|---|---|---|---|---|---|
| AI7503000994__14642137__f3__381 | 2371 | 6143 | 168 | 55 | | |

Description
NO-HIT

| ORF Name | NT ID | AA ID | NT LN | AA LN | Score | P-Value |
|---|---|---|---|---|---|---|
| AI7503000994__14714077__c1__445 | 2372 | 6144 | 1209 | 402 | 715 | 1.3e-70 |

-continued

Description
pir:[LN:G69794] [AC:G69794] [PN:hypothetical protein yerH] [GN:yerH]
[OR:*Bacillus subtilis*] [DB:pir2] >gp:[GI:e1182643:g2632977] [LN:BSUB0004]
[AC:Z99107:AL009126] [GN:yerH] [FN:unknown] [OR:*Bacillus subtilis*]
[DB:genpept-bct1] [DE:*Bacillus subtilis* complete genome (section 4 of 21):
from 600701 to 813890.] [LE:122441] [RE:123631] [DI:direct]
>gp:[GI:e1167977:g2577966] [LN:BSYERABCD] [AC:Y15254] [PN:YerH protein]
[GN:yerH] [OR:*Bacillus subtilis*] [DB:genpept-bct1] [DE:*Bacillus subtilis*
13kB DNA fragment, from yerA to sapB gene.] [LE:10086] [RE:11276]
[DI:direct]

| ORF Name | NT ID | AA ID | NT LN | AA LN | Score | P-Value |
|---|---|---|---|---|---|---|
| AI7503000994_14845336_f1_44 | 2373 | 6145 | 147 | 48 | | |

Description
NO-HIT

| ORF Name | NT ID | AA ID | NT LN | AA LN | Score | P-Value |
|---|---|---|---|---|---|---|
| AI7503000994_14849093_c3_686 | 2374 | 6146 | 294 | 97 | 133 | 6.0e-09 |

Description
pir:[LN:F71245] [AC:F71245] [PN:hypothetical protein PHS004] [GN:PHS004]
[OR:*Pyrococcus horikoshii*] [DB:pir2] >gp:[GI:d1030236:g3256610]
[LN:AP000001]
[AC:AP000001:AB009465:AB009464:AB009466:AB009467:AB009468:A1B009469] [PN:58aa
long hypothetical protein] [GN:PHS004] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1-287000 nt. position (1/7).] [NT:similar to
GENPEPT:Z47547 percent identity:50.000] [LE:195255] [RE:195431] DI:direct]

| ORF Name | NT ID | AA ID | NT LN | AA LN | Score | P-Value |
|---|---|---|---|---|---|---|
| AI7503000994_14883592_c1_429 | 2375 | 6147 | 2076 | 691 | 600 | 2.0e-58 |

Description
pir:[LN:S40098] [AC:S40098] [PN:hypothetical protein] [OR:*Clostridium
butyricum*] [DB:pir2] >gp:[GI:g436133] [LN:CBPYFOLY] [AC:Z29084]
[OR:*Clostridium butyricum*] [DB:genpept-bct1] [DE:*C. butyricum* transposon
containing tbcC gene.] [NT:product is similar to TnpB of transposon Tn554
from] [LE:1088] [RE:3070] [DI:direct]

| ORF Name | NT ID | AA ID | NT LN | AA LN | Score | P-Value |
|---|---|---|---|---|---|---|
| AI7503000994_14900826_c2_587 | 2376 | 6148 | 351 | 116 | 188 | 8.9e-15 |

Description
gp:[GI:g208931] [LN:SYNORFLAC] [AC:M15619] [OR:synthetic construct]
[SR:*E. coli* (strain SE5000) synthetic DNA, clone pKB1] [DB:genpept-syn]
[DE:Synthetic *E. coli* ORF16/lacZ fusion protein, partial cds.] [NT:ORF16-lacZ
fusion protein] [LE:29] [RE:>232] [DI:direct]

| ORF Name | NT ID | AA ID | NT LN | AA LN | Score | P-Value |
|---|---|---|---|---|---|---|
| AI7503000994_15033167_c3_671 | 2377 | 6149 | 126 | 41 | | |

Description
NO-HIT

| ORF Name | NT ID | AA ID | NT LN | AA LN | Score | P-Value |
|---|---|---|---|---|---|---|
| AI7503000994_15041430_c2_563 | 2378 | 6150 | 249 | 82 | | |

Description
NO-HIT

| ORF Name | NT ID | AA ID | NT LN | AA LN | Score | P-Value |
|---|---|---|---|---|---|---|
| AI7503000994_15121077_c1_448 | 2379 | 6151 | 1476 | 491 | 1626 | 3.7e-167 |

Description
pir:[LN:B69795] [AC:B69795] [PN:amidase homolog yerM] [GN:yerM]
[CL:indoleacetamide hydrolase] [OR:*Bacillus subtilis*] [DB:pir2]

-continued

>gp:[GI:e1182648:g2632982] [LN:BSUB0004] [AC:Z99107:AL009126] [GN:yerM]
[FN:unknown] [OR:*Bacillus subtilis*] [DB:genpept-bct1] [DE:*Bacillus subtilis*
complete genome (section 4 of 21): from 600701 to 813890.] [NT:alternate gene
name: yedB; similar to amidase] [LE:127844] [RE:129301] [DI:direct]

| ORF Name | NT ID | AA ID | NT LN | AA LN | Score | P-Value |
|---|---|---|---|---|---|---|
| AI7503000994_16110257_f3_287 | 2380 | 6152 | 126 | 41 | | |

Description
NO-HIT

| ORF Name | NT ID | AA ID | NT LN | AA LN | Score | P-Value |
|---|---|---|---|---|---|---|
| AI7503000994_16209675_c3_674 | 2381 | 6153 | 159 | 52 | | |

Description
NO-HIT

| ORF Name | NT ID | AA ID | NT LN | AA LN | Score | P-Value |
|---|---|---|---|---|---|---|
| AI7503000994_16219007_f3_366 | 2382 | 6154 | 921 | 306 | 1319 | 1.3e−134 |

Description
sp:[LN:BLAC_STAAU] [AC:P00807] [GN:BLAZ] [OR:*STAPHYLOCOCCUS AUREUS*]
[EC:3.5.2.6] [DE:BETA-LACTAMASE PRECURSOR, (PENICILLINASE)] [SP:P00807]
[DB:swissprot] >pir:[LN:PNSAP]
[AC:A01002:A23600:A90289:S06757:A45789:B45789:D45789::S11784:A60992]
[PN:beta-lactamase, precursor:cephalosporinase:penicillinase] [GN:blaZ]
[CL:beta-lactamase I] [OR:*Staphylococcus aureus*] [EC:3.5.2.6] [DB:pir1]
>gp:[GI:g551850] [LN:ENEBELAA] [AC:M60253] [PN:beta-lactamase] [GN:blaZ]
[OR:*Enterococcus faecalis*] [SR:*Enterococcus faecalis* (strain HH22) cDNA to
mRNA] [DB:genpept-bct1] [EC:3.5.2.6] [DE:*E. faecalis* beta-lactamase mRNA,
complete cds.] [LE:142] [RE:987] [DI:direct] >gp:[GI:g150717] [LN:PI25BLAZA]
[AC:M15526] [PN:beta-lactamase] [GN:blaZ] [OR:Plasmid pI258] [SR:Plasmid
pI258 (clone: pWN101) DNA] [DB:genpept-bct1] [EC:3.5.2.6] [DE:Plasmid pI258
(from *S. aureus*) beta-lactamase (blaZ), complete cds.] [LE:140] [RE:985]
[DI:direct] >gp:[GI:g581568] [LN:SAPBLAZ] [AC:X04121] [OR:*Staphylococcus
aureus*] [DB:genpept-bct1] [DE:*S. aureus* PC1 beta-lactamase gene blaZ from
plasmid pI258.] [NT:beta-lactamase (aa 1–281)] [SP:P00807] [LE:140] [RE:985]
[DI:direct] >gp:[GI:g581590] [LN:SATN552] [AC:X52734] [OR:*Staphylococcus
aureus*] [DB:genpept-bct1] [DE:*S. aureus* Tn552 transposable element.] [NT:blaZ
protein (AA 1–281)] [SP:P00807] [LE:5399] [RE:6244] [DI:direct]
>gp:[GI:g581591] [LN:SATNBLAZ] [AC:X16471] [OR:*Staphylococcus aureus*]
[DB:genpept-bct1] [DE:*Staphylococcus aureus* transposon Tn4002 blaZ gene
forbeta-lactamase.] [NT:beta-lactamase (AA 1–281)] [SP:P00807] [LE:142]
[RE:987] [DI:direct] >gp:[GI:g1575125] [LN:SAU58139] [AC:U58139]
[PN:beta-lactamase] [GN:blaZ] [OR:*Staphylococcus aureus*] [SR:*Staphylococcus
aureus* strain = a53] [DB:genpept-bct1] [DE:*Staphylococcus aureus*
beta-lactamase (blaz) gene, complete cds.] [LE:142] [RE:987] [DI:direct]
>gp:[GI:g537336] [LN:STALACBAA] [AC:M25252] [PN:beta-lactamase]
[OR:*Staphylococcus aureus*] [SR:*Staphylococcus aureus* DNA] [DB:genpept-bct1]
[DE:*Staphylococcus aureus* (clone pPC1) beta-lactamase gene, complete cds.]
[LE:123] [RE:968] [DI:direct] >gp:[GI:g537337] [LN:STALACBAB] [AC:M25253]
[PN:beta-lactamase] [OR:*Staphylococcus aureus*] [SR:*Staphylococcus aureus*
DNA] [DB:genpept-bct1] [DE:*Staphylococcus aureus* (clone pS1) beta-lactamase
gene, complete cds.] [LE:29] [RE:874] [DI:direct]

| ORF Name | NT ID | AA ID | NT LN | AA LN | Score | P-Value |
|---|---|---|---|---|---|---|
| AI7503000994_16677343_c1_412 | 2383 | 6155 | 447 | 148 | 111 | 1.3e−06 |

Description
sp:[LN:Y357_METJA] [AC:Q57803] [GN:MJ0357] [OR:*METHANOCOCCUS JANNASCHII*]
[DE:HYPOTHETICAL PROTEIN MJ0357] [SP:Q57803] [DB:swissprot] >pir:[LN:E64344]
[AC:E64344] [PN:hypothetical protein MJ0357] [OR:*Methanococcus jannaschii*]
[DB:pir2] [MP:REV326407–325940] >gp:[GI:g1591066] [LN:U67489]
[AC:U67489:L77117] [PN:*M. jannaschii* predicted coding region MJ0357]
[GN:MJ0357] [OR:*Methanococcus jannaschii*] [DB:genpept-bct2]
[DE:*Methanococcus jannaschii* section 31 of 150 of the complete genome.]
[NT:hypothetical protein; identified by GeneMark;] [LE:1632] [RE:2099]
[DI:complement]

| ORF Name | NT ID | AA ID | NT LN | AA LN | Score | P-Value |
|---|---|---|---|---|---|---|
| AI7503000994_16695300_f3_307 | 2384 | 6156 | 1113 | 370 | 586 | 5.9e−57 |

Description
pir:[LN:H69815] [AC:H69815] [PN:hypothetical protein ygaE] [GN:ygaE]

-continued

[OR:*Bacillus subtilis*] [DB:pir2] >gp:[GI:e1182859:g2633193] [LN:BSUB0005]
[AC:Z99108:AL009126] [GN:ygaE] [FN:unknown] [OR:*Bacillus subtilis*]
[DB:genpept-bct1] [DE:*Bacillus subtilis* complete genome (section 5 of 21):
from 802821 to 1011250.] [LE:137853] [RE:138914] [DI:complement]
>gp:[GI:e281580:g1673393] [LN:BSZ82044] [AC:Z82044] [PN:hypothetical 40.7 kd
protein] [GN:ygaE] [OR:*Bacillus subtilis*] [DB:genpept-bct1] [DE:*B. subtilis*
25 kb genomic DNA segment (from sspE to katA).] [LE:4703] [RE:5764]
[DI:complement]

| ORF Name | NT ID | AA ID | NT LN | AA LN | Score | P-Value |
|---|---|---|---|---|---|---|
| AI7503000994__19536693_c3__645 | 2385 | 6157 | 318 | 105 | 232 | 1.9e−19 |

Description
pir:[LN:A69795] [AC:A69795] [PN:conserved hypothetical protein yerL]
[GN:yerL] [CL:probable glu-tRNA amidotransferase C chain] [OR:*Bacillus
subtilis*] [DB:pir2] >gp:[GI:g2589194] [LN:AF008553] [AC:AF008553]
[PN:Glu-tRNAGln amidotransferase subunit C] [GN:gatC] [OR:*Bacillus subtilis*]
[DB:genpept-bct1] [DE:*Bacillus subtilis* Glu-tRNAGln amidotransferase
subunits C (gatC), A (gatA) and B (gatB) genes, complete cds.] [LE:412]
[RE:702] [DI:direct] >gp:[GI:g2114425] [LN:BSU92466] [AC:U92466]
[OR:*Bacillus subtilis*] [DB:genpept-bct1] [DE:*Bacillus subtilis* strain JH642
amidase-like protein, partial cds, osmoregulated proline transporter (opuE)
gene, complete cds and SapB (sapB) gene, partial cds.] [NT:similar to
*Synechocystis* sp. hypothetical protein,] [LE:278] [RE:568] [DI:complement]
>gp:[GI:e1182647:g2632981] [LN:BSUB0004] [AC:Z99107:AL009126] [GN:yerL]
[FN:unknown] [OR:*Bacillus subtilis*] [DB:genpept-bct1] [DE:*Bacillus subtilis*
complete genome (section 4 of 21): from 600701 to 813890.] [NT:alternate gene
name: yedA; similar to hypothetical] [LE:127538] [RE:127828] [DI:direct]

| ORF Name | NT ID | AA ID | NT LN | AA LN | Score | P-Value |
|---|---|---|---|---|---|---|
| AI7503000994__19570253_f2__152 | 2386 | 6158 | 213 | 70 | | |

Description
NO-HIT

| ORF Name | NT ID | AA ID | NT LN | AA LN | Score | P-Value |
|---|---|---|---|---|---|---|
| AI7503000994__1958183_f1__121 | 2387 | 6159 | 648 | 215 | 976 | 2.8e−98 |

Description
gp:[GI:e1311096:g3320008] [LN:SEHLDGN] [AC:Z49220] [GN:agrB]
[OR:*Staphylococcus epidermidis*] [DB:genpept-bct1] [DE:*Staphylococcus
epidermidis* hld and agr[A,B,C,D] genes.] [LE:759] [RE:1343] [DI:direct]

| ORF Name | NT ID | AA ID | NT LN | AA LN | Score | P-Value |
|---|---|---|---|---|---|---|
| AI7503000994__1972278_f3__306 | 2388 | 6160 | 300 | 99 | 316 | 2.4e−28 |

Description
sp:[LN:GSAB_BACSU] [AC:P71084] [GN:GSAB] [OR:*BACILLUS SUBTILIS*] [EC:5.4.3.8]
[DE:(GLUTAMATE-1-SEMIALDEHYDE AMINOTRANSFERASE) (GSA-AT)] [SP:P71084]
[DB:swissprot] >gp:[GI:e281581:g1673394] [LN:BSZ82044] [AC:Z82044]
[PN:glutamate-1-semialdehyde aminotransferase] [GN:gsaB] [OR:*Bacillus
subtilis*] [DB:genpept-bct1] [DE:*B. subtilis* 25 kb genomic DNA segment (from
sspE to katA).] [SP:P71084] [LE:5984] [RE:7273] [DI:complement]

| ORF Name | NT ID | AA ID | NT LN | AA LN | Score | P-Value |
|---|---|---|---|---|---|---|
| AI7503000994__1988811_c3__672 | 2389 | 6161 | 1083 | 360 | 779 | 2.1e−77 |

Description
pir:[LN:A69802] [AC:A69802] [PN:A/G-specific adenine glycosylase homolog
yfhQ] [GN:yfhQ] [OR:*Bacillus subtilis*] [DB:pir2] >gp:[GI:e1182852:g2633186]
[LN:BSUB0005] [AC:Z99108:AL009126] [GN:yfhQ] [FN:unknown] [OR:*Bacillus
subtilis*] [DB:genpept-bct1] [DE:*Bacillus subtilis* complete genome (section 5
of 21): from 802821 to 1011250.] [NT:similar to A/G-specific adenine
glycosylase] [LE:132342] [RE:133451] [DI:direct] >gp:[GI:d1025399:g2804547]
[LN:D85082] [AC:D85082] [PN:YfhQ] [OR:*Bacillus subtilis*] [SR:*Bacillus
subtilis* DNA] [DB:genpept-bct1] [DE:*Bacillus subtilis* DNA, genome sequence,
79 to 81 degree region.] [LE:25233] [RE:26342] [DI:direct]

| ORF Name | NT ID | AA ID | NT LN | AA LN | Score | P-Value |
|---|---|---|---|---|---|---|
| AI7503000994__20100206_f2__137 | 2390 | 6162 | 165 | 54 | | |

-continued

| Description |
|---|
| NO-HIT |

| ORF Name | NT ID | AA ID | NT LN | AA LN | Score | P-Value |
|---|---|---|---|---|---|---|
| AI7503000994__20344411__c2__508 | 2391 | 6163 | 336 | 111 | 440 | 1.8e−41 |

| Description |
|---|
| sp:[LN:CH10_STAEP] [AC:P48227] [GN:GROES:HSP10] [OR:*STAPHYLOCOCCUS EPIDERMIDIS*] [DE:10)] [SP:P48227] [DB:swissprot] >gp:[GI:g535341] [LN:SEU13618] [AC:U13618] [PN:heat shock protein 10] [GN:hsp10] [OR:*Staphylococcus epidermidis*] [DB:genpept-bct1] [DE:*Staphylococcus epidermidis* 9759 heat shock protein 10 (hsp10) and heat shock protein 60 (hsp60) genes, complete cds.] [LE:105] [RE:389] [DI:direct] |

| ORF Name | NT ID | AA ID | NT LN | AA LN | Score | P-Value |
|---|---|---|---|---|---|---|
| AI7503000994__20348427__c2__578 | 2392 | 6164 | 126 | 41 | | |

| Description |
|---|
| NO-HIT |

| ORF Name | NT ID | AA ID | NT LN | AA LN | Score | P-Value |
|---|---|---|---|---|---|---|
| AI7503000994__2037838__f2__223 | 2393 | 6165 | 249 | 82 | 122 | 8.8e−08 |

| Description |
|---|
| pir:[LN:A71136] [AC:A71136] [PN:hypothetical protein PH0853] [GN:PH0853] [CL:isoleucine--tRNA ligase] [OR:*Pyrococcus horikoshii*] [DB:pir2] >gp:[GI:d1030890:g3257264] [LN:AP000003] [AC:AP000003:AB009484:AB009485:AB009486:AB009487:AB009488:AB009489] [PN:134aa long hypothetical protein] [GN:PH0853] [OR:*Pyrococcus horikoshii*] [SR:*Pyrococcus horikoshii* (strain:OT3) DNA] [DB:genpept-bct1] [DE:*Pyrococcus horikoshii* OT3 genomic DNA, 544001–777000 nt. position(3/7).] [LE:216446] [RE:216850] [DI:direct] |

| ORF Name | NT ID | AA ID | NT LN | AA LN | Score | P-Value |
|---|---|---|---|---|---|---|
| AI7503000994__20414052__f1__49 | 2394 | 6166 | 129 | 42 | | |

| Description |
|---|
| NO-HIT |

| ORF Name | NT ID | AA ID | NT LN | AA LN | Score | P-Value |
|---|---|---|---|---|---|---|
| AI7503000994__20735686__f1__87 | 2395 | 6167 | 957 | 318 | 853 | 3.0e−85 |

| Description |
|---|
| sp:[LN:YYBQ_BACSU] [AC:P37487] [GN:YYBQ] [OR:*BACILLUS SUBTILIS*] [DE:HYPOTHETICAL 34.0 KD PROTEIN IN COTF-TETB INTERGENIC REGION] [SP:P37487] [DB:swissprot] >pir:[LN:S65980] [AC:S65980:D70088] [PN:conserved hypothetical protein yybQ] [GN:yybQ] [CL:conserved hypothetical protein MJ0608] [OR:*Bacillus subtilis*] [DB:pir2] >gp:[GI:d1005728:g467340] [LN:BAC180K] [AC:D26185] [PN:unknown] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:16200] [RE:17129] [DI:direct] >gp:[GI:e1184781:g2636602] [LN:BSUB0021] [AC:Z99124:AL009126] [GN:yybQ] [FN:unknown] [OR:*Bacillus subtilis*] [DB:genpept-bct1] [DE:*Bacillus subtilis* complete genome (section 21 of 21): from 3999281 to 4214814.] [NT:similar to hypothetical proteins] [SP:P37487] [LE:168132] [RE:169061] [DI:direct] |

| ORF Name | NT ID | AA ID | NT LN | AA LN | Score | P-Value |
|---|---|---|---|---|---|---|
| AI7503000994__20881510__c2__510 | 2396 | 6168 | 492 | 163 | 216 | 9.6e−18 |

| Description |
|---|
| gp:[GI:g3688823] [LN:AF084104] [AC:AF084104] [PN:hypothetical protein] [OR:*Bacillus firmus*] [DB:genpept-bct2] [DE:*Bacillus firmus* AcsA (acsA) gene, partial cds; SspA (sspA), hypothetical protein, maltose transportor ATP-binding protein (malK), leucine-rich protein transcriptional regulator (lrpR), hypothetical proteins, ABC transporter ATP-binding protein (natC), NatA (natA), NatB (natB), and hypothetical protein genes, complete cds; and SpoIIIJ (spoIIIJ) gene, partial cds.] [NT:Orf15; similar to transcription regulator YtrA from] [LE:9870] [RE:10229] [DI:direct] |

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000994__2125637__f3__294 | 2397 | 6169 | 150 | 49 | | |

Description
NO-HIT

| ORF Name | NT ID | AA ID | NT LN | AA LN | Score | P-Value |
|---|---|---|---|---|---|---|
| AI7503000994__21494536__c3__644 | 2398 | 6170 | 132 | 43 | | |

Description
NO-HIT

| ORF Name | NT ID | AA ID | NT LN | AA LN | Score | P-Value |
|---|---|---|---|---|---|---|
| AI7503000994__21516287__f1__17 | 2399 | 6171 | 135 | 44 | 100 | 1.9e−05 |

Description
pir:[LN:G64564] [AC:G64564] [PN:hypothetical protein HP0359]
[OR:*Helicobacter pylori*] [DB:pir2] >gp:[GI:g2313473] [LN:AE000553]
[AC:AE000553:AE000511] [PN:*H. pylori* predicted coding region HP0359]
[GN:HP0359] [OR:*Helicobacter pylori* 26695] [DB:genpept-bct2]
[DE:*Helicobacter pylori* 26695 section 31 of 134 of the complete genome.]
[NT:hypothetical protein; identified by GeneMark;] [LE:250] [RE:315]
[DI:direct]

| ORF Name | NT ID | AA ID | NT LN | AA LN | Score | P-Value |
|---|---|---|---|---|---|---|
| AI7503000994__21616078__c1__440 | 2400 | 6172 | 192 | 63 | 135 | 3.7e−09 |

Description
pir:[LN:C69792] [AC:C69792] [PN:hypothetical protein yebG] [GN:yebG]
[OR:*Bacillus subtilis*] [DB:pir2] >gp:[GI:g2239294] [LN:BSU51115] [AC:U51115]
[PN:unknown] [OR:*Bacillus subtilis*] [DB:genpept-bct1] [DE:*Bacillus subtilis*
CotA (cotA), GabP (gabP), YeaB (yeaB), YeaC (yeaC), YebA (yebA), GMP
synthetase (guaA) genes, complete cds, and AIR carboxylase I (purE) gene,
partial cds.] [NT:yebG] [LE:15312] [RE:15509] [DI:direct]
>gp:[GI:e1182621:g2632955] [LN:BSUB0004] [AC:Z99107:AL009126] [GN:yebG]
[FN:unknown] [OR:*Bacillus subtilis*] [DB:genpept-bct1] [DE:*Bacillus subtilis*
complete genome (section 4 of 21): from 600701 to 813890.] [LE:96901]
[RE:97098] [DI:direct]

| ORF Name | NT ID | AA ID | NT LN | AA LN | Score | P-Value |
|---|---|---|---|---|---|---|
| AI7503000994__21676433__c3__634 | 2401 | 6173 | 1137 | 378 | 192 | 3.3e−12 |

Description
gp:[GI:e1292355:g3127839] [LN:SC1A6] [AC:AL023496] [PN:hypothetical protein]
[GN:SC1A6.07c] [OR:*Streptomyces coelicolor*] [DB:genpept-bct1]
[DE:*Streptomyces coelicolor* cosmid 1A6.] [NT:SC1A6.07c, unknown, len: 813]
[LE:7442] [RE:9070] [DI:complement]

| ORF Name | NT ID | AA ID | NT LN | AA LN | Score | P-Value |
|---|---|---|---|---|---|---|
| AI7503000994__22289077__c2__514 | 2402 | 6174 | 546 | 181 | | |

Description
NO-HIT

| ORF Name | NT ID | AA ID | NT LN | AA LN | Score | P-Value |
|---|---|---|---|---|---|---|
| AI7503000994__22688428__c2__584 | 2403 | 6175 | 144 | 47 | | |

Description
NO-HIT

| ORF Name | NT ID | AA ID | NT LN | AA LN | Score | P-Value |
|---|---|---|---|---|---|---|
| AI7503000994__23438461__c1__413 | 2404 | 6176 | 687 | 228 | 103 | 0.029 |

Description
gp:[GI:g5306158] [LN:AF160864] [AC:AF160864] [PN:orf1386] [GN:orf1386]
[OR:*Mitochondrion Tetrahymena pyriformis*] [SR:*Tetrahymena pyriformis*]
[DB:genpept] [DE:*Tetrahymena pyriformis* mitochondrial DNA, complete genome.]
[NT:Open reading frame ymf77 (CPGN); ATA initiation] [LE:22317] [RE:26477]
[DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000994_23495437_f2_262 | 2405 | 6177 | 1305 | 434 | 1004 | 3.0e−101 |

Description
pir:[LN:JC4864] [AC:JC4864] [PN:*aspartate transaminase*,] [GN:aspAT]
[OR:*Bacillus circulans*] [EC:2.6.1.1] [DB:pir2] >gp:[GI:e216734:g1147557]
[LN:BCASPAMIN] [AC:X94433] [PN:*Aspartate aminotransferase*] [OR:*Bacillus circulans* subsp. *alkalophilus*] [DB:genpept-bct1] [EC:2.6.1.1]
[DE:*B. circulans aspartate aminotransferase* gene.] [LE:367] [RE:1665]
[DI:direct]

| ORF Name | NT ID | AA ID | NT LN | AA LN | Score | P-Value |
|---|---|---|---|---|---|---|
| AI7503000994_23572125_c2_571 | 2406 | 6178 | 534 | 177 | 393 | 1.7e−36 |

Description
sp:[LN:YKHA_BACSU] [AC:P49851] [GN:YKHA] [OR:*BACILLUS SUBTILIS*]
[DE:HYPOTHETICAL 20.1 KD PROTEIN IN HMP 5'REGION (ORF1)] [SP:P49851]
[DB:swissprot] >gp:[GI:d1011919:g1063246] [LN:BAC168TRP2] [AC:D78189]
[OR:*Bacillus subtilis*] [SR:*Bacillus subtilis* (strain:168trpC2) DNA]
[DB:genpept-bct1] [DE:*Bacillus subtilis* hmp DNA for 7 ORFs, complete cds.]
[NT:low homology to P14 protein of *Heamophilus*] [LE:241] [RE:780]
[DI:direct]

| ORF Name | NT ID | AA ID | NT LN | AA LN | Score | P-Value |
|---|---|---|---|---|---|---|
| AI7503000994_23595386_c1_484 | 2407 | 6179 | 627 | 208 | 271 | 1.4e−23 |

Description
pir:[LN:H70032] [AC:H70032] [PN:glycerate dehydrogenase homolog yvcT]
[GN:yvcT] [OR:*Bacillus subtilis*] [DB:pir2] >gp:[GI:e1186156:g2635981]
[LN:BSUB0018] [AC:Z99121:AL009126] [GN:yvcT] [FN:unknown] [OR:*Bacillus subtilis*] [DB:genpept-bct1] [DE:*Bacillus subtilis* complete genome (section 18 of 21): from 3399551 to 3609060.] [NT:similar to glycerate dehydrogenase]
[LE:162076] [RE:163053] [DI:direct]

| ORF Name | NT ID | AA ID | NT LN | AA LN | Score | P-Value |
|---|---|---|---|---|---|---|
| AI7503000994_23600175_f2_274 | 2408 | 6180 | 123 | 40 | | |

Description
NO-HIT

| ORF Name | NT ID | AA ID | NT LN | AA LN | Score | P-Value |
|---|---|---|---|---|---|---|
| AI7503000994_23629202_c1_433 | 2409 | 6181 | 381 | 126 | 598 | 3.2e−58 |

Description
sp:[LN:BLAI_STAAU] [AC:P18415] [GN:BLAI:PENI] [OR:*STAPHYLOCOCCUS AUREUS*]
[DE:REPRESSOR PROTEIN)] [SP:P18415] [DB:swissprot] >pir:[LN:S11782]
[AC:S11782:S34446] [PN:regulatory protein blaI] [GN:blaI] [CL:regulatory protein blaI] [OR:*Staphylococcus aureus*] [DB:pir2] >gp:[GI:g46758]
[LN:SATN552] [AC:X52734] [OR:*Staphylococcus aureus*] [DB:genpept-bct1]
[DE:*S. aureus* Tn552 transposable element.] [NT:blaI protein (AA 1–126)]
[SP:P18415] [LE:3165] [RE:3545] [DI:complement] >gp:[GI:g152967] [LN:STABLA]
[AC:M62650] [GN:blaI] [FN:putative blaZ repressor] [OR:*Staphylococcus aureus*] [SR:*Staphylococcus aureus* DNA] [DB:genpept-bct1] [DE:*Staphylococcus aureus* blaZ gene, 5' end; blaR1 gene, complete cds; blaI gene, complete cds; and binR gene, 5' end.] [LE:1903] [RE:2283] [DI:direct] >gp:[GI:g152970]
[LN:STABLAIA] [AC:M92376] [PN:beta-lactamase repressor] [GN:BlaI]
[FN:represses the production of the blaZ product] [OR:*Staphylococcus aureus*]
[SR:*Staphylococcus aureus* (strain RN4) DNA] [DB:genpept-bct1]
[DE:*Staphylococcus aureus* beta-lactamase repressor (BlaI) gene, complete cds.] [NT:no obvious promoters were found in the region] [LE:16] [RE:396]
[DI:direct]

| ORF Name | NT ID | AA ID | NT LN | AA LN | Score | P-Value |
|---|---|---|---|---|---|---|
| AI7503000994_23672302_f3_302 | 2410 | 6182 | 156 | 51 | | |

Description
NO-HIT

| ORF Name | NT ID | AA ID | NT LN | AA LN | Score | P-Value |
|---|---|---|---|---|---|---|
| AI7503000994_23672562_c1_411 | 2411 | 6183 | 297 | 98 | 86 | 0.0034 |

Description
gp:[GI:e8900:g1335718] [LN:PFRESAR1] [AC:X05182] [PN:ring-infected eryrthrocyte surface antigen] [GN:RESA] [OR:*Plasmodium falciparum*]

-continued

[SR:malaria parasite *P. falciparum*] [DB:genpept-inv1] [DE:*P. falciparum* FC27 Ag46 RESA mRNA for ring-infected eryrthrocyte surface antigen.] [SP:P13830] [LE:<1] [RE:>955] [DI:direct]

| ORF Name | NT ID | AA ID | NT LN | AA LN | Score | P-Value |
|---|---|---|---|---|---|---|
| AI7503000994__23727212__f2__175 | 2412 | 6184 | 303 | 100 | 87 | 0.00045 |

Description
pir:[LN:B69818] [AC:B69818] [PN:conserved hypothetical protein yhaH] [GN:yhaH] [OR:*Bacillus subtilis*] [DB:pir2] >gp:[GI:e1183002:g2633336] [LN:BSUB0006] [AC:Z99109:AL009126] [GN:yhaH] [FN:unknown] [OR:*Bacillus subtilis*] [DB:genpept-bct1] [DE:*Bacillus subtilis* complete genome (section 6 of 21): from 999501 to 1209940.] [NT:similar to hypothetical proteins from *B. subtilis*] [LE:73870] [RE:74226] [DI:complement] >gp:[GI:e325179:g2226119] [LN:BSY14077] [AC:Y14077] [PN:Hypothetical protein] [GN:yhaH] [OR:*Bacillus subtilis*] [DB:genpept-bct1] [DE:*Bacillus subtilis* 10.6 Kb chromosomal DNA: glyB-prsA region.] [LE:6687] [RE:7043] [DI:direct]

| ORF Name | NT ID | AA ID | NT LN | AA LN | Score | P-Value |
|---|---|---|---|---|---|---|
| AI7503000994__23727250__f3__362 | 2413 | 6185 | 1395 | 464 | 1167 | 1.6e−118 |

Description
sp:[LN:DHA2_BACSU] [AC:P39616] [GN:YWDH:IPA-58R] [OR:*BACILLUS SUBTILIS*] [EC:1.2.1.3] [DE:PROBABLE ALDEHYDE DEHYDROGENASE YWDH,] [SP:P39616] [DB:swissprot] >pir:[LN:S39713] [AC:S39713:C70054] [PN:aldehyde dehydrogenase homolog ywdH:protein ipa-58r] [GN:ywdH] [CL:aldehyde dehydrogenase (NAD+):aldehyde dehydrogenase homology] [OR:*Bacillus subtilis*] [DB:pir2] >gp:[GI:g413982] [LN:BSGENR] [AC:X73124] [GN:ipa-58r] [OR:*Bacillus subtilis*] [DB:genpept-bct1] [DE:*B. subtilis* genomic region (325 to 333).] [SP:P39616] [LE:59908] [RE:61281] [DI:complement] >gp:[GI:e1186295:g2636331] [LN:BSUB0020] [AC:Z99123:AL009126] [GN:ywdH] [FN:unknown] [OR:*Bacillus subtilis*] [DB:genpept-bct1] [DE:*Bacillus subtilis* complete genome (section 20 of 21): from 3798401 to 4010550.] [NT:alternate gene name: ipa-58r; similar to aldehyde] [SP:P39616] [LE:96681] [RE:98054] [DI:direct]

| ORF Name | NT ID | AA ID | NT LN | AA LN | Score | P-Value |
|---|---|---|---|---|---|---|
| AI7503000994__2379658__f2__144 | 2414 | 6186 | 225 | 74 | | |

Description
NO-HIT

| ORF Name | NT ID | AA ID | NT LN | AA LN | Score | P-Value |
|---|---|---|---|---|---|---|
| AI7503000994__23850907__f1__109 | 2415 | 6187 | 201 | 66 | | |

Description
NO-HIT

| ORF Name | NT ID | AA ID | NT LN | AA LN | Score | P-Value |
|---|---|---|---|---|---|---|
| AI7503000994__24017175__f2__202 | 2416 | 6188 | 150 | 49 | | |

Description
NO-HIT

| ORF Name | NT ID | AA ID | NT LN | AA LN | Score | P-Value |
|---|---|---|---|---|---|---|
| AI7503000994__24218791__f1__86 | 2417 | 6189 | 588 | 195 | 525 | 1.7e−50 |

Description
pir:[LN:C70008] [AC:C70008] [PN:pyrazinamidase/nicotinamidase homolog yueJ] [GN:yueJ] [CL:hypothetical protein b1011] [OR:*Bacillus subtilis*] [DB:pir2] >gp:[GI:e1184253:g2635671] [LN:BSUB0017] [AC:Z99120:AL009126] [GN:yueJ] [FN:unknown] [OR:*Bacillus subtilis*] [DB:genpept-bct1] [DE:*Bacillus subtilis* complete genome (section 17 of 21): from 3197001 to 3414420.] [NT:similar to pyrazinamidase/nicotinamidase] [LE:62967] [RE:63518] [DI:complement]

| ORF Name | NT ID | AA ID | NT LN | AA LN | Score | P-Value |
|---|---|---|---|---|---|---|
| AI7503000994__24225632__f2__253 | 2418 | 6190 | 171 | 56 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000994_24257827_c2_511 | 2419 | 6191 | 387 | 128 | | |

Description
NO-HIT

| ORF Name | NT ID | AA ID | NT LN | AA LN | Score | P-Value |
|---|---|---|---|---|---|---|
| AI7503000994_24265676_f1_120 | 2420 | 6192 | 144 | 47 | | |

Description
NO-HIT

| ORF Name | NT ID | AA ID | NT LN | AA LN | Score | P-Value |
|---|---|---|---|---|---|---|
| AI7503000994_24350953_f2_151 | 2421 | 6193 | 132 | 43 | 72 | 0.017 |

Description
pir:[LN:G71244] [AC:G71244] [PN:hypothetical protein PH0217] [GN:PH0217]
[OR:*Pyrococcus horikoshii*] [DB:pir2] >gp:[GI:d1030229:g3256603]
[LN:AP000001]
[AC:AP000001:AB009465:AB009464:AB009466:AB009467:AB009468:AB009469]
[PN:106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:191072]
[RE:191392] [DI:complement]

| ORF Name | NT ID | AA ID | NT LN | AA LN | Score | P-Value |
|---|---|---|---|---|---|---|
| AI7503000994_24353382_c3_608 | 2422 | 6194 | 1623 | 540 | 2592 | 1.6e−269 |

Description
gp:[GI:g535342] [LN:SEU13618] [AC:U13618] [PN:heat shock protein 60]
[GN:hsp60] [OR:*Staphylococcus epidermidis*] [DB:genpept-bct1]
[DE:*Staphylococcus epidermidis* 9759 heat shock protein 10 (hsp10) and heat
shock protein 60 (hsp60) genes, complete cds.] [LE:445] [RE:2064]
[DI:direct]

| ORF Name | NT ID | AA ID | NT LN | AA LN | Score | P-Value |
|---|---|---|---|---|---|---|
| AI7503000994_24407787_c1_483 | 2423 | 6195 | 354 | 117 | 84 | 0.029 |

Description
sp:[LN:SERX_YEAST] [AC:P40054] [GN:YER081W] [OR:*SACCHAROMYCES CEREVISIAE*]
[SR:,BAKER'S YEAST] [EC:1.1.1.95] [DE:(PGDH)] [SP:P40054] [DB:swissprot]
>pir:[LN:S50584] [AC:S50584] [PN:probable phosphoglycerate dehydrogenase,
YER081w] [OR:*Saccharomyces cerevisiae*] [EC:1.1.1.95] [DB:pir2] [MP:5R]

| ORF Name | NT ID | AA ID | NT LN | AA LN | Score | P-Value |
|---|---|---|---|---|---|---|
| AI7503000994_24415942_c2_516 | 2424 | 6196 | 840 | 279 | | |

Description
NO-HIT

| ORF Name | NT ID | AA ID | NT LN | AA LN | Score | P-Value |
|---|---|---|---|---|---|---|
| AI7503000994_24475252_c2_533 | 2425 | 6197 | 162 | 53 | | |

Description
NO-HIT

| ORF Name | NT ID | AA ID | NT LN | AA LN | Score | P-Value |
|---|---|---|---|---|---|---|
| AI7503000994_24475252_f1_2 | 2426 | 6198 | 159 | 52 | | |

Description
NO-HIT

| ORF Name | NT ID | AA ID | NT LN | AA LN | Score | P-Value |
|---|---|---|---|---|---|---|
| AI7503000994_24885938_c3_639 | 2427 | 6199 | 642 | 213 | 302 | 7.4e−27 |

Description
pir:[LN:B69792] [AC:B69792] [PN:hypothetical protein yebF] [GN:yebF]
[OR:*Bacillus subtilis*] [DB:pir2] >gp:[GI:g2239293] [LN:BSU51115] [AC:U51115]
[PN:unknown] [OR:*Bacillus subtilis*] [DB:genpept-bct1] [DE:*Bacillus subtilis*
CotA (cotA), GabP (gabP), YeaB (yeaB), YeaC (yeaC), YebA (yebA), GMP
synthetase (guaA) genes, complete cds, and AIR carboxylase I (purE) gene,
partial cds.] [NT:yebF] [LE:15046] [RE:15312] [DI:direct]

-continued

>gp:[GI:e1182620:g2632954] [LN:BSUB0004] [AC:Z99107:AL009126] [GN:yebF]
[FN:unknown] [OR:*Bacillus subtilis*] [DB:genpept-bct1] [DE:*Bacillus subtilis*
complete genome (section 4 of 21): from 600701 to 813890.] [LE:96635]
[RE:96901] [DI:direct]

| ORF Name | NT ID | AA ID | NT LN | AA LN | Score | P-Value |
| --- | --- | --- | --- | --- | --- | --- |
| AI7503000994_25428507_c1_457 | 2428 | 6200 | 576 | 191 | 109 | 0.0063 |

Description
pir:[LN:G71609] [AC:G71609] [PN:hypothetical protein PFB0650w] [GN:PFB0650w]
[OR:*Plasmodium falciparum*] [DB:pir2] >gp:[GI:g3845240] [LN:AE001408]
[AC:AE001408:AE001362] [PN:hypothetical protein] [GN:PFB0650w]
[OR:*Plasmodium falciparum*] [SR:malaria parasite *P. falciparum*]
[DB:genpept-inv2] [DE:*Plasmodium falciparum* chromosome 2, section 45 of 73
of the complete sequence.] [NT:predicted by GlimmerM] [LE:4458] [RE:11960]
[DI:direct]

| ORF Name | NT ID | AA ID | NT LN | AA LN | Score | P-Value |
| --- | --- | --- | --- | --- | --- | --- |
| AI7503000994_25595387_f1_93 | 2429 | 6201 | 432 | 143 | 326 | 2.1e−29 |

Description
gp:[GI:g3676415] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf149] [LE:2068] [RE:2484]
[DI:complement]

| ORF Name | NT ID | AA ID | NT LN | AA LN | Score | P-Value |
| --- | --- | --- | --- | --- | --- | --- |
| AI7503000994_25603388_f1_122 | 2430 | 6202 | 1293 | 430 | 2112 | 1.2e−218 |

Description
gp:[GI:g2981295] [LN:AF012132] [AC:AF012132] [PN:histidine kinase] [GN:agrC]
[OR:*Staphylococcus epidermidis*] [DB:genpept-bct2] [DE:*Staphylococcus
epidermidis* agr system including response regulator(agrA), histidine kinase
(agrC), AgrD (agrD), AgrB (agrB) and deltatoxin (hld) genes, complete cds.]
[NT:AgrC; similar to *S. aureus* and *S. lugdunensis* AgrC] [LE:975] [RE:2264]
[DI:complement]

| ORF Name | NT ID | AA ID | NT LN | AA LN | Score | P-Value |
| --- | --- | --- | --- | --- | --- | --- |
| AI7503000994_256265_c2_564 | 2431 | 6203 | 1092 | 363 | 538 | 7.3e−52 |

Description
pir:[LN:F70045] [AC:F70045] [PN:two-component sensor histidine kinase
homolog yvqE] [GN:yvqE] [OR:*Bacillus subtilis*] [DB:pir2]
>gp:[GI:e1249816:g2832820] [LN:BS43KBDNA] [AC:AJ223978] [PN:YvqE protein]
[GN:yvqE] [OR:*Bacillus subtilis*] [DB:genpept-bct1] [DE:*Bacillus subtilis*
42.7 kB DNA fragment from yvsA to yvqA.] [LE:32111] [RE:33193] [DI:direct]
>gp:[GI:e1184388:g2635806] [LN:BSUB0017] [AC:Z99120:AL009126] [GN:yvqE]
[FN:unknown] [OR:*Bacillus subtilis*] [DB:genpept-bct1] [DE:*Bacillus subtilis*
complete genome (section 17 of 21): from 3197001 to 3414420.] [NT:similar to
two-component sensor histidine kinase] [LE:197094] [RE:198176]
[DI:complement]

| ORF Name | NT ID | AA ID | NT LN | AA LN | Score | P-Value |
| --- | --- | --- | --- | --- | --- | --- |
| AI7503000994_25678438_c2_583 | 2432 | 6204 | 474 | 157 | 334 | 3.0e−30 |

Description
pir:[LN:E70344] [AC:E70344] [PN:conserved hypothetical protein aq_495]
[GN:aq_495] [CL:bacterioferritin comigratory protein:alkyl hydroperoxidase
c22 protein homology] [OR:*Aquifex aeolicus*] [DB:pir2] >gp:[GI:g2983147]
[LN:AE000692] [AC:AE000692:AE000657] [PN:hypothetical protein] [GN:aq_495]
[OR:*Aquifex aeolicus*] [DB:genpept-bct2] [DE:*Aquifex aeolicus* section 24 of
109 of the complete genome.] [LE:11182] [RE:11667] [DI:direct]

| ORF Name | NT ID | AA ID | NT LN | AA LN | Score | P-Value |
| --- | --- | --- | --- | --- | --- | --- |
| AI7503000994_25781392_f1_54 | 2433 | 6205 | 1029 | 342 | 225 | 5.7e−17 |

Description
pir:[LN:H69815] [AC:H69815] [PN:hypothetical protein ygaE] [GN:ygaE]
[OR:*Bacillus subtilis*] [DB:pir2] >gp:[GI:e1182859:g2633193] [LN:BSUB0005]
[AC:Z99108:AL009126] [GN:ygaE] [FN:unknown] [OR:*Bacillus subtilis*]
[DB:genpept-bct1] [DE:*Bacillus subtilis* complete genome (section 5 of 21):
from 802821 to 1011250.] [LE:137853] [RE:138914] [DI:complement]
>gp:[GI:e281580:g1673393] [LN:BSZ82044] [AC:Z82044] [PN:hypothetical 40.7 kd -continued protein] [GN:ygaE] [OR:*Bacillus subtilis*] [DB:genpept-bct1] [DE:*B. subtilis*
25 kb genomic DNA segment (from sspE to katA).] [LE:4703] [RE:5764]
[DI:complement]

| ORF Name | NT ID | AA ID | NT LN | AA LN | Score | P-Value |
|---|---|---|---|---|---|---|
| AI7503000994_25790718_c2_541 | 2434 | 6206 | 315 | 104 | 349 | 7.7e−32 |

Description
pir:[LN:B69794] [AC:B69794] [PN:hypothetical protein yerC] [GN:yerC]
[OR:*Bacillus subtilis*] [DB:pir2] >gp:[GI:g2465565] [LN:AF011544]
[AC:AF011544] [PN:YecD] [GN:yecD] [FN:unknown] [OR:*Bacillus subtilis*]
[DB:genpept-bct1] [DE:*Bacillus subtilis*
phosphoribosylaminoimidazole-carboxamideformyltransferase (purH-J) gene,
partial cds, phosphoribosylglycinamide synthetase (purD), YecA (yecA),
putative adenine deaminase (yecB), YecC (yecC), and YecD (yecD)
genes, complete cds, and putative glutamate synthase (yecE) gene,
partial cds.] [NT:no apparent homology has been identified] [LE:6547]
[RE:6861] [DI:direct] >gp:[GI:e1182638:g2632972] [LN:BSUB0004]
[AC:Z99107:AL009126] [GN:yerC] [FN:unknown] [OR:*Bacillus subtilis*]
[DB:genpept-bct1] [DE:*Bacillus subtilis* complete genome (section 4 of 21):
from 600701 to 813890.] [LE:115237] [RE:115551] [DI:direct]
>gp:[GI:e1167973:g2577962] [LN:BSYERABCD] [AC:Y15254] [PN:YerC protein]
[GN:yerC] [OR:*Bacillus subtilis*] [DB:genpept-bct1] [DE:*Bacillus subtilis*
13 kB DNA fragment, from yerA to sapB gene.] [LE:2882] [RE:3196] [DI:direct]

| ORF Name | NT ID | AA ID | NT LN | AA LN | Score | P-Value |
|---|---|---|---|---|---|---|
| AI7503000994_26177163_c1_466 | 2435 | 6207 | 1272 | 423 | 971 | 9.5e−98 |

Description
sp:[LN:AMPS_BACSU] [AC:P39762] [GN:AMPS] [OR:*BACILLUS SUBTILIS*]
[EC:3.4.11.—] [DE:AMINOPEPTIDASE AMPS,] [SP:P39762] [DB:swissprot]
>pir:[LN:C69585] [AC:C69585] [PN:aminopeptidase ampS] [GN:ampS]
[CL:*Bacillus* aminopeptidase] [OR:*Bacillus subtilis*] [DB:pir2]
>gp:[GI:e1185035:g2633816] [LN:BSUB0008] [AC:Z99111:AL009126]
[PN:aminopeptidase] [GN:ampS] [OR:*Bacillus subtilis*] [DB:genpept-bct1]
[EC:3.4.11.—] [DE:*Bacillus subtilis* complete genome (section 8 of 21): from
1394791 to 1603020.] [SP:P39762] [LE:119612] [RE:120844] [DI:complement]
>gp:[GI:g3282130] [LN:AF012285] [AC:AF012285:AF012284:U51911]
[PN:aminopeptidase] [GN:ampS] [OR:*Bacillus subtilis*] [DB:genpept-bct2]
[DE:*Bacillus subtilis* mobA-nprE gene region.] [NT:similar to ampS gene with
GenBan Accession Number] [LE:20100] [RE:21332] [DI:complement]

| ORF Name | NT ID | AA ID | NT LN | AA LN | Score | P-Value |
|---|---|---|---|---|---|---|
| AI7503000994_26205151_f2_147 | 2436 | 6208 | 156 | 51 | 117 | 3.0e−07 |

Description
pir:[LN:B71245] [AC:B71245] [PN:hypothetical protein PH0220] [GN:PH0220]
[OR:*Pyrococcus horikoshii*] [DB:pir2] >gp:[GI:d1030232:g3256606]
[LN:AP000001]
[AC:AP000001:AB009465:AB009464:AB009466:AB009467:AB009468:AB009469]
[PN:171aa long hypothetical protein] [GN:PH0220] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1–287000 nt. position (1/7).] [LE:192864]
[RE:193379] [DI:complement]

| ORF Name | NT ID | AA ID | NT LN | AA LN | Score | P-Value |
|---|---|---|---|---|---|---|
| AI7503000994_26209510_c1_478 | 2437 | 6209 | 165 | 54 | | |

Description
NO-HIT

| ORF Name | NT ID | AA ID | NT LN | AA LN | Score | P-Value |
|---|---|---|---|---|---|---|
| AI7503000994_26209577_f3_358 | 2438 | 6210 | 1068 | 355 | 892 | 2.2e−89 |

Description
pir:[LN:C69811] [AC:C69811] [PN:nitric-oxide synthase homolog yflM]
[GN:yflM] [OR:*Bacillus subtilis*] [DB:pir2] >gp:[GI:e1182753:g2633087]
[LN:BSUB0005] [AC:Z99108:AL009126] [GN:yflM] [FN:unknown] [OR:*Bacillus
subtilis*] [DB:genpept-bct1] [DE:*Bacillus subtilis* complete genome (section 5
of 21): from 802821 to 1011250.] [NT:similar to nitric-oxide synthase]
[LE:33422] [RE:34432] [DI:direct] >gp:[GI:d1023169:g2443235] [LN:D86417]
[AC:D86417] [PN:YflM] [OR:*Bacillus subtilis*] [SR:*Bacillus subtilis*
(strain:AC327) DNA] [DB:genpept-bct1] [DE:*Bacillus subtilis* 35.7 kb genomic
DNA, 70–73 degree region, complete cds.] [LE:14090] [RE:15100]

-continued

[DI:complement]

| ORF Name | NT ID | AA ID | NT LN | AA LN | Score | P-Value |
|---|---|---|---|---|---|---|
| AI7503000994_26212875_c3_616 | 2439 | 6211 | 318 | 105 | | |

Description
NO-HIT

| ORF Name | NT ID | AA ID | NT LN | AA LN | Score | P-Value |
|---|---|---|---|---|---|---|
| AI7503000994_26354787_c2_499 | 2440 | 6212 | 744 | 247 | 121 | 0.00043 |

Description
gp:[GI:g3549261] [LN:AF057019] [AC:AF057019] [PN:interaptin] [GN:abpD]
[OR:*Dictyostelium discoideum*] [DB:genpept-inv2] [DE:*Dictyostelium discoideum*
interaptin (abpD) gene, complete cds.] [LE:1861:2796:7392]
[RE:2378:7315:7570] [DI:directJoin]

| ORF Name | NT ID | AA ID | NT LN | AA LN | Score | P-Value |
|---|---|---|---|---|---|---|
| AI7503000994_26369052_f1_91 | 2441 | 6213 | 141 | 46 | 101 | 1.5e−05 |

Description
gp:[GI:g3676415] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf149] [LE:2068] [RE:2484]
[DI:complement]

| ORF Name | NT ID | AA ID | NT LN | AA LN | Score | P-Value |
|---|---|---|---|---|---|---|
| AI7503000994_26593808_f2_159 | 2442 | 6214 | 981 | 326 | 753 | 1.2e−74 |

Description
pir:[LN:H69801] [AC:H69801] [PN:hypothetical protein yfhP] [GN:yfhP]
[OR:*Bacillus subtilis*] [DB:pir2] >gp:[GI:e1182851:g2633185] [LN:BSUB0005]
[AC:Z99108:AL009126] [GN:yfhP] [FN:unknown] [OR:*Bacillus subtilis*]
[DB:genpept-bct1] [DE:*Bacillus subtilis* complete genome (section 5 of 21):
from 802821 to 1011250.] [LE:131143] [RE:132126] [DI:complement]
>gp:[GI:d1025398:g2804546] [LN:D85082] [AC:D85082] [PN:YfhP] [OR:*Bacillus
subtilis*] [SR:*Bacillus subtilis* DNA] [DB:genpept-bct1] [DE:*Bacillus subtilis*
DNA, genome sequence, 79 to 81 degree region.] [LE:24034] [RE:25017]
[DI:complement]

| ORF Name | NT ID | AA ID | NT LN | AA LN | Score | P-Value |
|---|---|---|---|---|---|---|
| AI7503000994_26689703_c3_679 | 2443 | 6215 | 453 | 150 | 562 | 2.1e−54 |

Description
sp:[LN:FUR3_BACSU] [AC:P71086] [GN:YGAG] [OR:*BACILLUS SUBTILIS*] [DE:FERRIC
UPTAKE REGULATION PROTEIN HOMOLOG 3] [SP:P71086] [DB:swissprot]
>pir:[LN:B69816] [AC:B69816] [PN:transcription regulator Fur family homolog
ygaG] [GN:ygaG] [CL:ferric uptake regulator] [OR:*Bacillus subtilis*]
[DB:pir2] >gp:[GI:e1182862:g2633196] [LN:BSUB0005] [AC:Z99108:AL009126]
[GN:ygaG] [FN:unknown] [OR:*Bacillus subtilis*] [DB:genpept-bct1] [DE:*Bacillus
subtilis* complete genome (section 5 of 21): from 802821 to 1011250.]
[NT:similar to transcriptional regulator (Fur family)] [SP:P71086]
[LE:141173] [RE:141610] [DI:direct] >gp:[GI:e281583:g1673396] [LN:BSZ82044]
[AC:Z82044] [PN:hypothetical 16.4 kd protein] [GN:ygaG] [OR:*Bacillus
subtilis*] [DB:genpept-bct1] [DE:*B. subtilis* 25 kb genomic DNA segment (from
sspE to katA).] [NT:homology to ferric uptake regulation protein]
[SP:P71086] [LE:8023] [RE:8460] [DI:direct]

| ORF Name | NT ID | AA ID | NT LN | AA LN | Score | P-Value |
|---|---|---|---|---|---|---|
| AI7503000994_26756500_c3_654 | 2444 | 6216 | 777 | 258 | 721 | 2.9e−71 |

Description
pir:[LN:E69810] [AC:E69810] [PN:methionine aminopeptidase homolog yflG]
[GN:yflG] [CL:*Escherichia coli* methionyl aminopeptidase] [OR:*Bacillus
subtilis*] [DB:pir2] >gp:[GI:e1182759:g2633093] [LN:BSUB0005]
[AC:Z99108:AL009126] [GN:yflG] [FN:unknown] [OR:*Bacillus subtilis*]
[DB:genpept-bct1] [DE:*Bacillus subtilis* complete genome (section 5 of 21):
from 802821 to 1011250.] [NT:similar to methionine aminopeptidase] [LE:36423]
[RE:37172] [DI:complement] >gp:[GI:d1023163:g2443229] [LN:D86417]
[AC:D86417] [PN:YflG] [OR:*Bacillus subtilis*] [SR:*Bacillus subtilis*
(strain:AC327) DNA] [DB:genpept-bct1] [DE:*Bacillus subtilis* 35.7 kb genomic
DNA, 70–73 degree region, complete cds.] [LE:11350] [RE:12099] [DI:direct]

-continued

| ORF Name | NT ID | AA ID | NT LN | AA LN | Score | P-Value |
|---|---|---|---|---|---|---|
| AI7503000994_26757312_f3_321 | 2445 | 6217 | 1197 | 398 | 577 | 5.3e−56 |

Description
gp:[GI:e1423916:g4584097] [LN:BAJ10131] [AC:AJ010131] [GN:yfkH] [OR:*Bacillus cereus*] [DB:genpept-bct1] [DE:*Bacillus cereus* yfkH gene and partial ykvW, bc333c genes.] [LE:863] [RE:1732] [DI:complement]

| ORF Name | NT ID | AA ID | NT LN | AA LN | Score | P-Value |
|---|---|---|---|---|---|---|
| AI7503000994_285808_f2_146 | 2446 | 6218 | 225 | 74 | | |

Description
NO-HIT

| ORF Name | NT ID | AA ID | NT LN | AA LN | Score | P-Value |
|---|---|---|---|---|---|---|
| AI7503000994_29307187_c3_687 | 2447 | 6219 | 165 | 54 | | |

Description
NO-HIT

| ORF Name | NT ID | AA ID | NT LN | AA LN | Score | P-Value |
|---|---|---|---|---|---|---|
| AI7503000994_29500277_f3_392 | 2448 | 6220 | 171 | 56 | 169 | 9.2e−13 |

Description
gp:[GI:g1196510] [LN:MSGTCWPA] [AC:M15467] [PN:unknown protein]
[OR:*Mycobacterium tuberculosis*] [SR:*Mycobacterium tuberculosis* (strain
Erdman) DNA] [DB:genpept-bct1] [DE:*M. tuberculosis* 65 kDa antigen (cell wall
protein a) gene.] [NT:ORF F175; putative] [LE:242] [RE:769] [DI:complement]

| ORF Name | NT ID | AA ID | NT LN | AA LN | Score | P-Value |
|---|---|---|---|---|---|---|
| AI7503000994_2992943_c1_425 | 2449 | 6221 | 624 | 207 | 382 | 2.5e−35 |

Description
gp:[GI:g4981569] [LN:AE001764] [AC:AE001764:AE000512] [PN:ABC transporter,
ATP-binding protein] [GN:TM1028] [OR:*Thermotoga maritima*] [DB:genpept-bct2]
[DE:*Thermotoga maritima* section 76 of 136 of the complete genome.]
[NT:similar to GB:AE000782 percent identity: 60.48;] [LE:5922] [RE:6803]
[DI:direct]

| ORF Name | NT ID | AA ID | NT LN | AA LN | Score | P-Value |
|---|---|---|---|---|---|---|
| AI7503000994_30265640_c3_693 | 2450 | 6222 | 1080 | 359 | 684 | 2.4e−67 |

Description
pir:[LN:E71373] [AC:E71373] [PN:probable regulatory protein (pfoS/R)]
[GN:TP0038] [OR:*Treponema pallidum* subsp. *pallidum*] [SR:, syphilis
spirochete] [DB:pir2] >gp:[GI:g3322295] [LN:AE001189] [AC:AE001189:AE000520]
[PN:regulatory protein (pfoS/R)] [GN:TP0038] [OR:*Treponema pallidum*]
[DB:genpept-bct2] [DE:*Treponema pallidum* section 5 of 87 of the complete
genome.] [NT:similar to GP:1354775 percent identity: 100.00;] [LE:1177]
[RE:2229] [DI:complement]

| ORF Name | NT ID | AA ID | NT LN | AA LN | Score | P-Value |
|---|---|---|---|---|---|---|
| AI7503000994_30506437_c2_517 | 2451 | 6223 | 177 | 58 | | |

Description
NO-HIT

| ORF Name | NT ID | AA ID | NT LN | AA LN | Score | P-Value |
|---|---|---|---|---|---|---|
| AI7503000994_30677268_c1_419 | 2452 | 6224 | 171 | 56 | | |

Description
NO-HIT

| ORF Name | NT ID | AA ID | NT LN | AA LN | Score | P-Value |
|---|---|---|---|---|---|---|
| AI7503000994_31273377_f1_113 | 2453 | 6225 | 171 | 56 | | |

Description
NO-HIT

-continued

| ORF Name | NT ID | AA ID | NT LN | AA LN | Score | P-Value |
|---|---|---|---|---|---|---|
| AI7503000994_3128452_c1_438 | 2454 | 6226 | 132 | 43 | | |

Description
NO-HIT

| ORF Name | NT ID | AA ID | NT LN | AA LN | Score | P-Value |
|---|---|---|---|---|---|---|
| AI7503000994_31289637_c2_545 | 2455 | 6227 | 123 | 40 | | |

Description
NO-HIT

| ORF Name | NT ID | AA ID | NT LN | AA LN | Score | P-Value |
|---|---|---|---|---|---|---|
| AI7503000994_31534456_c3_689 | 2456 | 6228 | 156 | 51 | | |

Description
NO-HIT

| ORF Name | NT ID | AA ID | NT LN | AA LN | Score | P-Value |
|---|---|---|---|---|---|---|
| AI7503000994_32037826_c1_451 | 2457 | 6229 | 1476 | 491 | 1119 | 2.0e−113 |

Description
pir:[LN:E69793] [AC:E69793] [PN:RNA methyltransferase homolog yefA]
[GN:yefA] [OR:*Bacillus subtilis*] [DB:pir2] >gp:[GI:e1182653:g2632987]
[LN:BSUB0004] [AC:Z99107:AL009126] [GN:yefA] [FN:unknown] [OR:*Bacillus subtilis*] [DB:genpept-bct1] [DE:*Bacillus subtilis* complete genome (section 4 of 21): from 600701 to 813890.] [NT:alternate gene name: yerS; similar to RNA] [LE:136409] [RE:137788] [DI:direct]

| ORF Name | NT ID | AA ID | NT LN | AA LN | Score | P-Value |
|---|---|---|---|---|---|---|
| AI7503000994_3251577_c3_642 | 2458 | 6230 | 2190 | 729 | 3095 | 0.0 |

Description
sp:[LN:PCRA_STAAU] [AC:Q53727] [GN:PCRA] [OR:*STAPHYLOCOCCUS AUREUS*]
[EC:3.6.1.—] [DE:ATP-DEPENDENT HELICASE PCRA,] [SP:Q53727] [DB:swissprot]
>pir:[LN:S39923] [AC:S39923:S27667] [PN:DNA helicase pcrA] [GN:pcrA]
[CL:helicase II] [OR:*Staphylococcus aureus*] [DB:pir2] >gp:[GI:g153062]
[LN:STAPCRA] [AC:M63176] [PN:helicase] [GN:pcrA] [OR:*Staphylococcus aureus*]
[SR:*Staphylococcus aureus* (strain SA20) DNA] [DB:genpept-bct1]
[DE:*Staphylococcus aureus* helicase required for T181 replication (pcrA)gene, complete cds.] [LE:943] [RE:2970] [DI:direct]

| ORF Name | NT ID | AA ID | NT LN | AA LN | Score | P-Value |
|---|---|---|---|---|---|---|
| AI7503000994_32634387_f2_133 | 2459 | 6231 | 198 | 65 | | |

Description
NO-HIT

| ORF Name | NT ID | AA ID | NT LN | AA LN | Score | P-Value |
|---|---|---|---|---|---|---|
| AI7503000994_32680_c3_692 | 2460 | 6232 | 936 | 311 | 776 | 4.4e−77 |

Description
sp:[LN:STSP_STAAU] [AC:P04188] [OR:*STAPHYLOCOCCUS AUREUS*] [EC:3.4.21.19]
[DE:PROTEINASE) (V8 PROTEINASE) (ENDOPROTEINASE GLU-C)] [SP:P04188]
[DB:swissprot] >pir:[LN:PRSASK] [AC:A26812:A00966] [PN:glutamyl endopeptidase, precursor:staphylococcal serine proteinase]
[CL:staphylococcal serine proteinase] [OR:*Staphylococcus aureus*]
[EC:3.4.21.19] [DB:pir1] >gp:[GI:g46687] [LN:SASP] [AC:Y00356]
[OR:*Staphylococcus aureus*] [DB:genpept-bct1] [DE:*Staphylococcus aureus* V8 serine protease gene.] [NT:preproenzyme (AA −68 to 268)] [SP:P04188]
[LE:354] [RE:1364] [DI:direct]

| ORF Name | NT ID | AA ID | NT LN | AA LN | Score | P-Value |
|---|---|---|---|---|---|---|
| AI7503000994_32689162_f3_397 | 2461 | 6233 | 807 | 268 | 1384 | 1.6e−141 |

Description
gp:[GI:g2981299] [LN:AF012132] [AC:AF012132] [PN:unknown] [GN:orf5]
[OR:*Staphylococcus epidermidis*] [DB:genpept-bct2] [DE:*Staphylococcus epidermidis* agr system including response regulator(agrA), histidine kinase (agrC), AgrD (agrD), AgrB (agrB) and deltatoxin (hld) genes, complete cds.]
[NT:similar to *S. aureus* and *S. lugdunensis* orf5] [LE:3778] [RE:4572]

-continued

[DI:complement]

| ORF Name | NT ID | AA ID | NT LN | AA LN | Score | P-Value |
|---|---|---|---|---|---|---|
| AI7503000994_32696088_c2_580 | 2462 | 6234 | 1749 | 582 | 1899 | 4.3e−196 |

Description
pir:[LN:G69815] [AC:G69815] [PN:ABC transporter (ATP-binding protein) homolog ygaD] [GN:ygaD] [CL:ATP-binding cassette homology] [OR:*Bacillus subtilis*] [DB:pir2] >gp:[GI:e1182858:g2633192] [LN:BSUB0005] [AC:Z99108:AL009126] [GN:ygaD] [FN:unknown] [OR:*Bacillus subtilis*] [DB:genpept-bct1] [DE:*Bacillus subtilis* complete genome (section 5 of 21): from 802821 to 1011250.] [NT:similar to ABC transporter (ATP-binding protein)] [LE:136007] [RE:137776] [DI:direct] >gp:[GI:e281579:g1673392] [LN:BSZ82044] [AC:Z82044] [PN:unidentified transporter-ATP binding] [GN:ygaD] [OR:*Bacillus subtilis*] [DB:genpept-bct1] [DE:*B. subtilis* 25 kb genomic DNA segment (from sspE to katA).] [LE:2857] [RE:4626] [DI:direct]

| ORF Name | NT ID | AA ID | NT LN | AA LN | Score | P-Value |
|---|---|---|---|---|---|---|
| AI7503000994_33237786_f3_316 | 2463 | 6235 | 132 | 43 | | |

Description
NO-HIT

| ORF Name | NT ID | AA ID | NT LN | AA LN | Score | P-Value |
|---|---|---|---|---|---|---|
| AI7503000994_3330167_f3_398 | 2464 | 6236 | 132 | 43 | | |

Description
NO-HIT

| ORF Name | NT ID | AA ID | NT LN | AA LN | Score | P-Value |
|---|---|---|---|---|---|---|
| AI7503000994_33456965_c2_592 | 2465 | 6237 | 138 | 45 | | |

Description
NO-HIT

| ORF Name | NT ID | AA ID | NT LN | AA LN | Score | P-Value |
|---|---|---|---|---|---|---|
| AI7503000994_33463542_c1_487 | 2466 | 6238 | 180 | 59 | | |

Description
NO-HIT

| ORF Name | NT ID | AA ID | NT LN | AA LN | Score | P-Value |
|---|---|---|---|---|---|---|
| AI7503000994_3361326_c2_588 | 2467 | 6239 | 207 | 68 | | |

Description
NO-HIT

| ORF Name | NT ID | AA ID | NT LN | AA LN | Score | P-Value |
|---|---|---|---|---|---|---|
| AI7503000994_33631292_c1_461 | 2468 | 6240 | 414 | 137 | 84 | 0.048 |

Description
gp:[GI:g2182758] [LN:BBU42599] [AC:U42599] [OR:*Borrelia burgdorferi*] [SR:Lyme disease spirochete] [DB:genpept-bct1] [DE:*Borrelia burgdorferi* plasmid cp18, OspE (ospE) gene, partial cds.] [NT:OrfE] [LE:1395] [RE:1967] [DI:direct]

| ORF Name | NT ID | AA ID | NT LN | AA LN | Score | P-Value |
|---|---|---|---|---|---|---|
| AI7503000994_33631626_c1_489 | 2469 | 6241 | 132 | 43 | | |

Description
NO-HIT

| ORF Name | NT ID | AA ID | NT LN | AA LN | Score | P-Value |
|---|---|---|---|---|---|---|
| AI7503000994_3392952_c1_410 | 2470 | 6242 | 591 | 196 | 195 | 1.6e−15 |

Description
gp:[GI:e247149:g1926347] [LN:LBPHIG1E] [AC:X98106] [GN:Rorf172] [OR:*Bacteriophage phigle*] [DB:genpept-phg] [DE:*Lactobacillus bacteriophage phigle* complete genomic DNA.] [LE:29618] [RE:30136] [DI:complement]

-continued

| ORF Name | NT ID | AA ID | NT LN | AA LN | Score | P-Value |
|---|---|---|---|---|---|---|
| AI7503000994_34023427_c3_651 | 2471 | 6243 | 123 | 40 | | |

Description
NO-HIT

| ORF Name | NT ID | AA ID | NT LN | AA LN | Score | P-Value |
|---|---|---|---|---|---|---|
| AI7503000994_34164192_c3_640 | 2472 | 6244 | 138 | 45 | | |

Description
NO-HIT

| ORF Name | NT ID | AA ID | NT LN | AA LN | Score | P-Value |
|---|---|---|---|---|---|---|
| AI7503000994_34275325_c2_576 | 2473 | 6245 | 1521 | 506 | 238 | 5.0e−17 |

Description
sp:[LN:TAGH_BACSU] [AC:P42954] [GN:TAGH] [OR:*BACILLUS SUBTILIS*] [DE:TEICHOIC
ACID TRANSLOCATION ATP-BINDING PROTEIN TAGH] [SP:P42954] [DB:swissprot]
>pir:[LN:S69203] [AC:S69203:A69721] [PN:teichoic acid translocation
ATP-binding protein tagH] [GN:tagH] [CL:ATP-binding cassette homology]
[OR:*Bacillus subtilis*] [DB:pir2] >gp:[GI:g755153] [LN:BSU13832] [AC:U13832]
[PN:ATP-binding protein] [GN:tagH] [FN:teichoic acid translocation]
[OR:*Bacillus subtilis*] [DB:genpept-bct1] [DE:*Bacillus subtilis* 168 highly
hydrophobic integral membrane protein(tagG) gene and ATP-binding protein
(tagH) gene, complete cds.] [LE:1134] [RE:2717] [DI:direct]
>gp:[GI:e1184476:g2636096] [LN:BSUB0019] [AC:Z99122:AL009126]
[PN:ATP-binding protein] [GN:tagH] [FN:teichoic acid translocation]
[OR:*Bacillus subtilis*] [DB:genpept-bct1] [DE:*Bacillus subtilis* complete
genome (section 19 of 21): from 3597091 to 3809700.] [SP:P42954] [LE:75534]
[RE:77117] [DI:complement] >gp:[GI:e1184476:g2636096] [LN:BSUB0019]
[AC:Z99122:AL009126] [PN:ATP-binding protein] [GN:tagH] [FN:teichoic acid
translocation] [OR:*Bacillus subtilis*] [DB:genpept] [DE:*Bacillus subtilis*
complete genome (section 19 of 21): from 3597091 to 3809700.] [SP:P42954]
[LE:75534] [RE:77117] [DI:complement]

| ORF Name | NT ID | AA ID | NT LN | AA LN | Score | P-Value |
|---|---|---|---|---|---|---|
| AI7503000994_34383400_c3_618 | 2474 | 6246 | 582 | 193 | 78 | 0.010 |

Description
gp:[GI:g4726117] [LN:ATAC006436] [AC:AC006436] [GN:F13J11.13]
[OR:*Arabidopsis thaliana*] [SR:*thale cress*] [DB:genpept-pln2] [DE:*Arabidopsis
thaliana* chromosome II BAC F13J11 genomic sequence, complete sequence.]
[NT:unknown protein] [LE:50474] [RE:50725] [DI:direct]

| ORF Name | NT ID | AA ID | NT LN | AA LN | Score | P-Value |
|---|---|---|---|---|---|---|
| AI7503000994_34557262_c2_585 | 2475 | 6247 | 135 | 44 | | |

Description
NO-HIT

| ORF Name | NT ID | AA ID | NT LN | AA LN | Score | P-Value |
|---|---|---|---|---|---|---|
| AI7503000994_34572177_c2_513 | 2476 | 6248 | 735 | 244 | 147 | 1.5e−08 |

Description
pir:[LN:S42928] [AC:S42928] [PN:probable membrane-spanning protein]
[OR:*Staphylococcus epidermidis*] [DB:pir2] >gp:[GI:g459263] [LN:SESTPSMP]
[AC:Z30586] [PN:membrane spanning protein (putative)] [OR:*Staphylococcus
epidermidis*] [DB:genpept-bct1] [DE:*S. epidermidis* (968) genes for potential
ABC transporter and potential membrane spanning protein.] [LE:896] [RE:1666]
[DI:direct]

| ORF Name | NT ID | AA ID | NT LN | AA LN | Score | P-Value |
|---|---|---|---|---|---|---|
| AI7503000994_34652177_c3_656 | 2477 | 6249 | 648 | 215 | 546 | 1.0e−52 |

Description
pir:[LN:E70045] [AC:E70045] [PN:two-component response regulator [YvqE]
homolog yvqC] [GN:yvqC] [CL:regulatory protein comA:response regulator
homology] [OR:*Bacillus subtilis*] [DB:pir2] >gp:[GI:e1249817:g2832821]
[LN:BS43KBDNA] [AC:AJ223978] [PN:YvqC protein] [GN:yvqC] [OR:*Bacillus
subtilis*] [DB:genpept-bct1] [DE:*Bacillus subtilis* 42.7 kB DNA fragment from
yvsA to yvqA.] [LE:33171] [RE:33806] [DI:direct] >gp:[GI:e1184387:g2635805]
[LN:BSUB0017] [AC:Z99120:AL009126] [GN:yvqC] [FN:unknown] [OR:*Bacillus -continued

*subtilis*] [DB:genpept-bct1] [DE:*Bacillus subtilis* complete genome (section 17 of 21): from 3197001 to 3414420.] [NT:similar to two-component response regulator [YvqE]] [LE:196481] [RE:197116] [DI:complement]

| ORF Name | NT ID | AA ID | NT LN | AA LN | Score | P-Value |
|---|---|---|---|---|---|---|
| AI7503000994_35428128_c3_635 | 2478 | 6250 | 141 | 46 | | |

Description
NO-HIT

| ORF Name | NT ID | AA ID | NT LN | AA LN | Score | P-Value |
|---|---|---|---|---|---|---|
| AI7503000994_35443785_c2_562 | 2479 | 6251 | 207 | 68 | | |

Description
NO-HIT

| ORF Name | NT ID | AA ID | NT LN | AA LN | Score | P-Value |
|---|---|---|---|---|---|---|
| AI7503000994_35885_f3_383 | 2480 | 6252 | 504 | 167 | | |

Description
NO-HIT

| ORF Name | NT ID | AA ID | NT LN | AA LN | Score | P-Value |
|---|---|---|---|---|---|---|
| AI7503000994_36119093_c3_643 | 2481 | 6253 | 2001 | 666 | 2102 | 1.3e−217 |

Description
pir:[LN:F69794] [AC:F69794] [PN:DNA ligase (NAD+),] [GN:yerG]
[CL:polydeoxyribonucleotide synthase (NAD+)] [OR:*Bacillus subtilis*]
[EC:6.5.1.2] [DB:pir1] >gp:[GI:e1182642:g2632976] [LN:BSUB0004]
[AC:Z99107:AL009126] [GN:yerG] [FN:unknown] [OR:*Bacillus subtilis*]
[DB:genpept-bct1] [DE:*Bacillus subtilis* complete genome (section 4 of 21):
from 600701 to 813890.] [NT:similar to DNA ligase] [LE:120419] [RE:122425]
[DI:direct]

| ORF Name | NT ID | AA ID | NT LN | AA LN | Score | P-Value |
|---|---|---|---|---|---|---|
| AI7503000994_36195250_f3_359 | 2482 | 6254 | 822 | 273 | 375 | 1.4e−34 |

Description
sp:[LN:PHEA_METJA] [AC:Q58054] [GN:PHEA:MJ0637] [OR:*METHANOCOCCUS JANNASCHII*] [EC:4.2.1.51] [DE:PROBABLE PREPHENATE DEHYDRATASE, (PDT)]
[SP:Q58054] [DB:swissprot] >pir:[LN:E64379] [AC:E64379] [PN:prephenate
dehydratase,] [CL:prephenate dehydratase:prephenate dehydratase homology]
[OR:*Methanococcus jannaschii*] [EC:4.2.1.51] [DB:pir2] [MP:REV567914–567096]
>gp:[GI:g1591349] [LN:U67511] [AC:U67511:L77117] [PN:chorismate
mutase/prephenate dehydratase (pheA)] [GN:MJ0637] [OR:*Methanococcus
jannaschii*] [DB:genpept-bct2] [DE:*Methanococcus jannaschii* section 53 of 150
of the complete genome.] [NT:similar to SP:P43909 PID:683585 percent
identity:] [LE:7667] [RE:8485] [DI:complement]

| ORF Name | NT ID | AA ID | NT LN | AA LN | Score | P-Value |
|---|---|---|---|---|---|---|
| AI7503000994_36219692_c3_648 | 2483 | 6255 | 561 | 186 | 133 | 2.0e−08 |

Description
pir:[LN:A36886] [AC:A36886] [PN:surface protein PAg negative regulator par]
[GN:par] [OR:*Streptococcus sobrinus*] [DB:pir2] >gp:[GI:d1003084:g425488]
[LN:STRREPRESP] [AC:D13323] [PN:repressor protein] [GN:par]
[OR:*Streptococcus sobrinus*] [SR:*Streptococcus sobrinus* (strain MT3791) DNA,
clone pPG11] [DB:genpept-bct1] [DE:*Streptococcus sobrinus* gene for repressor
protein of surface protein antigen gene (pag), complete cds.] [NT:This ORF2
starts at the GTG codon (position 1162)] [LE:1162] [RE:1773] [DI:direct]

| ORF Name | NT ID | AA ID | NT LN | AA LN | Score | P-Value |
|---|---|---|---|---|---|---|
| AI7503000994_36220000_c2_525 | 2484 | 6256 | 1047 | 348 | 557 | 7.0e−54 |

Description
pir:[LN:D69856] [AC:D69856] [PN:conserved hypothetical protein ykgB]
[GN:ykgB] [OR:*Bacillus subtilis*] [DB:pir2] >gp:[GI:e1181502:g2632022]
[LN:BSAJ2571] [AC:AJ002571] [PN:YkgB] [GN:ykgB] [FN:unknown] [OR:*Bacillus
subtilis*] [DB:genpept-bct1] [DE:*Bacillus subtilis* 168 56 kb DNA fragment
between xlyA and ykoR.] [LE:22000] [RE:23049] [DI:complement]
>gp:[GI:e1183321:g2633655] [LN:BSUB0007] [AC:Z99110:AL009126] [GN:ykgB]
[FN:unknown] [OR:*Bacillus subtilis*] [DB:genpept-bct1] [DE:*Bacillus subtilis*

-continued complete genome (section 7 of 21): from 1194391 to 1411140.] [NT:similar to hypothetical proteins] [LE:174949] [RE:175998] [DI:complement]

| ORF Name | NT ID | AA ID | NT LN | AA LN | Score | P-Value |
|---|---|---|---|---|---|---|
| AI7503000994_36221013_f2_135 | 2485 | 6257 | 171 | 56 | | |

Description
NO-HIT

| ORF Name | NT ID | AA ID | NT LN | AA LN | Score | P-Value |
|---|---|---|---|---|---|---|
| AI7503000994_36336012_c3_664 | 2486 | 6258 | 165 | 54 | | |

Description
NO-HIT

| ORF Name | NT ID | AA ID | NT LN | AA LN | Score | P-Value |
|---|---|---|---|---|---|---|
| AI7503000994_36367302_c3_600 | 2487 | 6259 | 564 | 187 | 122 | 2.7e−06 |

Description
sp:[LN:Y359_METJA] [AC:Q57805] [GN:MJ0359] [OR:*METHANOCOCCUS JANNASCHII*]
[DE:HYPOTHETICAL PROTEIN MJ0359] [SP:Q57805] [DB:swissprot] >pir:[LN:G64344]
[AC:G64344] [PN:hypothetical protein MJ0359] [OR:*Methanococcus jannaschii*]
[DB:pir2] [MP:REV327449–326805] >gp:[GI:g1591068] [LN:U67489]
[AC:U67489:L77117] [PN:*M. jannaschii* predicted coding region MJ0359]
[GN:MJ0359] [OR:*Methanococcus jannaschii*] [DB:genpept-bct2]
[DE:*Methanococcus jannaschii* section 31 of 150 of the complete genome.]
[NT:hypothetical protein; identified by GeneMark;] [LE:2497] [RE:3141]
[DI:complement]

| ORF Name | NT ID | AA ID | NT LN | AA LN | Score | P-Value |
|---|---|---|---|---|---|---|
| AI7503000994_36457341_c2_593 | 2488 | 6260 | 135 | 44 | 81 | 0.019 |

Description
pir:[LN:S75730] [AC:S75730:S50064] [PN:8-amino-7-oxononanoate
synthase,:7-keto-8-aminopelargonic acid synthetase:protein
slr0917:7-keto-8-aminopelargonic acid synthetase:protein slr0917] [GN:bioF]
[CL:5-aminolevulinate synthase] [OR:*Synechocystis* sp.] [SR:PCC 6803, , PCC
6803] [SR:PCC 6803,] [EC:2.3.1.47] [DB:pir2] >gp:[GI:d1011116:g1673311]
[LN:SYCSLLE] [AC:D64003:AB001339] [PN:7-keto-8-aminopelargonic acid
synthetase] [GN:bioF] [OR:*Synechocystis* sp.] [SR:*Synechocystis* sp.
(strain:PCC6803) DNA] [DB:genpept-bct1] [DE:*Synechocystis* sp. PCC6803
complete genome, 22/27, 2755703–2868766.] [NT:ORF_ID:slr0917] [LE:35986]
[RE:37299] [DI:direct]

| ORF Name | NT ID | AA ID | NT LN | AA LN | Score | P-Value |
|---|---|---|---|---|---|---|
| AI7503000994_36522175_f1_69 | 2489 | 6261 | 1557 | 518 | 2240 | 3.2e−232 |

Description
gp:[GI:g2565311] [LN:AF024571] [AC:AF024571] [PN:high affinity proline
permease] [GN:putP] [OR:*Staphylococcus aureus*] [DB:genpept-bct2]
[DE:*Staphylococcus aureus* high affinity proline permease (putP)
gene, complete cds.] [LE:339] [RE:1832] [DI:direct]

| ORF Name | NT ID | AA ID | NT LN | AA LN | Score | P-Value |
|---|---|---|---|---|---|---|
| AI7503000994_39077_f2_270 | 2490 | 6262 | 717 | 238 | 1223 | 1.9e−124 |

Description
gp:[GI:g2981294] [LN:AF012132] [AC:AF012132] [PN:response regulator]
[GN:agrA] [OR:*Staphylococcus epidermidis*] [DB:genpept-bct2]
[DE:*Staphylococcus epidermidis* agr system including response
regulator (agrA), histidine kinase (agrC), AgrD (agrD), AgrB (agrB) and
deltatoxin (hld) genes, complete cds.] [NT:AgrA; similar to *S. aureus* and *S.
lugdunensis* AgrA] [LE:242] [RE:958] [DI:complement]

| ORF Name | NT ID | AA ID | NT LN | AA LN | Score | P-Value |
|---|---|---|---|---|---|---|
| AI7503000994_3939013_c2_573 | 2491 | 6263 | 210 | 69 | 109 | 2.1e−06 |

Description
pir:[LN:C69807] [AC:C69807] [PN:hypothetical protein yfjT] [GN:yfjT]
[OR:*Bacillus subtilis*] [DB:pir2] >gp:[GI:e1182787:g2633121] [LN:BSUB0005]
[AC:Z99108:AL009126] [GN:yfjT] [FN:unknown] [OR:*Bacillus subtilis*]
[DB:genpept-bct1] [DE:*Bacillus subtilis* complete genome (section 5 of 21):

-continued from 802821 to 1011250.] [LE:65959] [RE:66144] [DI:direct]
>gp:[GI:d1024269:g2626812] [LN:D83967] [AC:D83967] [PN:YfjT] [OR:*Bacillus subtilis*] [SR:*Bacillus subtilis* (strain:AC327) DNA] [DB:genpept-bct1]
[DE:*Bacillus subtilis* genomic DNA, 74 degree region.] [LE:1777] [RE:1962]
[DI:complement]

| ORF Name | NT ID | AA ID | NT LN | AA LN | Score | P-Value |
|---|---|---|---|---|---|---|
| AI7503000994_3942015_c1_471 | 2492 | 6264 | 528 | 175 | 790 | 1.4e−78 |

Description
sp:[LN:YLY1_STAAU] [AC:Q53719] [OR:*STAPHYLOCOCCUS AUREUS*] [DE:HYPOTHETICAL
18.6 KD PROTEIN IN LYTA 3'REGION (ORF1)] [SP:Q53719] [DB:swissprot]
>gp:[GI:g310602] [LN:STAORFPHI] [AC:L19300] [OR:*Staphylococcus aureus*]
[SR:*Staphylococcus aureus* (library: NCTC 8325) DNA] [DB:genpept-bct1]
[DE:*Staphylococcus aureus* DNA sequence encoding three ORFs, complete cds;
prophage phi-11 sequence homology, 5' flank.] [LE:1798] [RE:2313]
[DI:direct]

| ORF Name | NT ID | AA ID | NT LN | AA LN | Score | P-Value |
|---|---|---|---|---|---|---|
| AI7503000994_4021888_c3_615 | 2493 | 6265 | 669 | 222 | 83 | 0.0039 |

Description
pir:[LN:D71114] [AC:D71114] [PN:hypothetical protein PH0683] [GN:PH0683]
[OR:*Pyrococcus horikoshii*] [DB:pir2] >gp:[GI:d1030717:g3257091]
[LN:AP000003]
[AC:AP000003:AB009484:AB009485:AB009486:AB009487:AB009488:AB009489]
[PN:107aa long hypothetical protein] [GN:PH0683] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 544001–777000 nt. position(3/7).] [LE:63024]
[RE:63347] [DI:complement]

| ORF Name | NT ID | AA ID | NT LN | AA LN | Score | P-Value |
|---|---|---|---|---|---|---|
| AI7503000994_4062500_c2_507 | 2494 | 6266 | 1401 | 466 | 502 | 3.3e−47 |

Description
gp:[GI:e1314011:g3393011] [LN:SAA224764] [AC:AJ224764] [PN:Clumping factor
B] [GN:clfB] [FN:binds fibrinogen] [OR:*Staphylococcus aureus*]
[DB:genpept-bct1] [DE:*Staphylococcus aureus* strain Newman clumping factor B
(clfB) gene.] [LE:28] [RE:2769] [DI:direct]

| ORF Name | NT ID | AA ID | NT LN | AA LN | Score | P-Value |
|---|---|---|---|---|---|---|
| AI7503000994_4072936_c1_453 | 2495 | 6267 | 153 | 50 | | |

Description
NO-HIT

| ORF Name | NT ID | AA ID | NT LN | AA LN | Score | P-Value |
|---|---|---|---|---|---|---|
| AI7503000994_4093753_f3_387 | 2496 | 6268 | 126 | 41 | | |

Description
NO-HIT

| ORF Name | NT ID | AA ID | NT LN | AA LN | Score | P-Value |
|---|---|---|---|---|---|---|
| AI7503000994_4095277_c3_627 | 2497 | 6269 | 1827 | 608 | 2760 | 2.5e−287 |

Description
pir:[LN:S11783] [AC:S11783:S27371:S34445] [PN:bla regulator protein
blaR1:probable beta-lactam receptor signal transducer protein] [GN:blaR1]
[CL:mecR1 protein:beta-lactamase OXA2 homology] [OR:*Staphylococcus aureus*]
[DB:pir2] >gp:[GI:g152966] [LN:STABLA] [AC:M62650] [GN:blaR1] [FN:putative
beta-lactam receptor-signal] [OR:*Staphylococcus aureus*] [SR:*Staphylococcus
aureus* DNA] [DB:genpept-bct1] [DE:*Staphylococcus aureus* blaZ gene, 5' end;
blaR1 gene, complete cds; blaI gene, complete cds; and binR gene, 5' end.]
[LE:156] [RE:1913] [DI:direct]

| ORF Name | NT ID | AA ID | NT LN | AA LN | Score | P-Value |
|---|---|---|---|---|---|---|
| AI7503000994_409556_f1_10 | 2498 | 6270 | 135 | 44 | 112 | 2.5e−06 |

-continued

Description
pir:[LN:D71245] [AC:D71245] [PN:hypothetical protein PH0221] [GN:PH0221]
[OR:*Pyrococcus horikoshii*] [DB:pir2] >gp:[GI:d1030234:g3256608]
[LN:AP000001]
[AC:AP000001:AB009465:AB009464:AB009466:AB009467:AB009468:AB009469]
[PN:235aa long hypothetical protein] [GN:PH0221] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:194212]
[RE:194919] [DI:complement]

| ORF Name | NT ID | AA ID | NT LN | AA LN | Score | P-Value |
|---|---|---|---|---|---|---|
| AI7503000994__4101517__f1__100 | 2499 | 6271 | 1068 | 355 | | |

Description
NO-HIT

| ORF Name | NT ID | AA ID | NT LN | AA LN | Score | P-Value |
|---|---|---|---|---|---|---|
| AI7503000994__4179637__c3__622 | 2500 | 6272 | 387 | 128 | 207 | 8.6e−17 |

Description
sp:[LN:TRAC_STAAU] [AC:P06698] [GN:TNPC] [OR:*STAPHYLOCOCCUS AUREUS*]
[DE:TRANSPOSASE FOR TRANSPOSON TN554] [SP:P06698] [DB:swissprot]
>pir:[LN:C24584] [AC:C24584] [PN:transposition regulatory protein tnpC]
[GN:tnpC] [CL:transposition regulatory protein tnpC] [OR:*Staphylococcus aureus*] [DB:pir2] >gp:[GI:g43729] [LN:ISTN554] [AC:X03216:K02987] [PN:pot. tnpC protein] [OR:*Staphylococcus aureus*] [DB:genpept-bct1]
[DE:*Staphylococcus aureus* transposon Tn554.] [NT:(aa 1–125)] [SP:P06698]
[LE:3115] [RE:3492] [DI:direct] >gp:[GI:d1046009:g5360833] [LN:D86934]
[AC:D86934] [PN:transposaseC] [GN:tnpC] [OR:*Staphylococcus aureus*]
[SR:*Staphylococcus aureus* (strain:N315) DNA, clone_lib:library of N31]
[DB:genpept] [DE:*Staphylococcus aureus* genes, mec region, partial and
complete cds.] [NT:ORF N047] [LE:32364] [RE:32741] [DI:direct]

| ORF Name | NT ID | AA ID | NT LN | AA LN | Score | P-Value |
|---|---|---|---|---|---|---|
| AI7503000994__430325__c1__456 | 2501 | 6273 | 1383 | 460 | 649 | 1.3e−63 |

Description
gp:[GI:g3820539] [LN:AF080002] [AC:AF080002] [PN:UDP-N-acetylmuramyl
tripeptide synthetase MurC] [GN:murC] [OR:*Heliobacillus mobilis*]
[DB:genpept-bct2] [DE:*Heliobacillus mobilis* exopolyphosphatase Ppx (ppx)
gene, partial cds; cobyric acid synthase CobQ (cobQ),
UDP-N-acetylmuramyltripeptide synthetase MurC (murC), glutamyl tRNA
reductase HemA (hemA), photosynthesis gene cluster, complete sequence, stage
IIsporulation protein E Sp2E (sp2E), cell cycle protein MesJ (mesJ), and
ATP-dependent zinc metallopeptidase FtsH (ftsH) genes, complete cds; and
nucleoside diphosphate kinase B NdkB (ndkB) gene, partial cds.] [LE:2000]
[RE:3367] [DI:complement]

| ORF Name | NT ID | AA ID | NT LN | AA LN | Score | P-Value |
|---|---|---|---|---|---|---|
| AI7503000994__4329635__f2__164 | 2502 | 6274 | 126 | 41 | | |

Description
NO-HIT

| ORF Name | NT ID | AA ID | NT LN | AA LN | Score | P-Value |
|---|---|---|---|---|---|---|
| AI7503000994__4689130__f2__272 | 2503 | 6275 | 306 | 101 | 81 | 0.029 |

Description
pir:[LN:A58932] [AC:A58932] [PN:cytochrome C-type biogenesis protein CCMF]
[GN:yejR:ccmF] [OR:mitochondrion *Cyanidioschyzon merolae*] [DB:pir2]
>gp:[GI:d1037513:g4115789] [LN:D89861] [AC:D89861] [PN:cytochrome C-type
biogenesis protein CCMF] [GN:yejR or ccmF] [OR:Mitochondrion *Cyanidioschyzon merolae*] [SR:*Cyanidioschyzon merolae* (strain:10D) mitochondrion DNA]
[DB:genpept-pln1] [DE:*Cyanidioschyzon merolae* mitochondrial DNA, complete
sequence.] [LE:16296] [RE:18158] [DI:complement]

| ORF Name | NT ID | AA ID | NT LN | AA LN | Score | P-Value |
|---|---|---|---|---|---|---|
| AI7503000994__4722265__c1__472 | 2504 | 6276 | 858 | 285 | 416 | 6.1e−39 |

Description
pir:[LN:H69800] [AC:H69800] [PN:hypothetical protein yfhG] [GN:yfhG]
[OR:*Bacillus subtilis*] [DB:pir2] >gp:[GI:e1182842:g2633176] [LN:BSUB0005]
[AC:Z99108:AL009126] [GN:yfhG] [FN:unknown] [OR:*Bacillus subtilis*]

-continued

[DB:genpept-bct1] [DE:*Bacillus subtilis* complete genome (section 5 of 21): from 802821 to 1011250.] [LE:122320] [RE:123114] [DI:direct] >gp:[GI:d1025389:g2804537] [LN:D85082] [AC:D85082] [PN:YfhG] [OR:*Bacillus subtilis*] [SR:*Bacillus subtilis* DNA] [DB:genpept-bct1] [DE:*Bacillus subtilis* DNA, genome sequence, 79 to 81 degree region.] [LE:15211] [RE:16005] [DI:direct]

| ORF Name | NT ID | AA ID | NT LN | AA LN | Score | P-Value |
|---|---|---|---|---|---|---|
| AI7503000994__4726566__f2__189 | 2505 | 6277 | 582 | 193 | 187 | 3.8e−13 |

Description
gp:[GI:g4981093] [LN:AE001732] [AC:AE001732:AE000512] [PN:DNA polymerase III, alpha subunit] [GN:TM0576] [OR:*Thermotoga maritima*] [DB:genpept-bct2] [DE:*Thermotoga maritima* section 44 of 136 of the complete genome.] [NT:similar to GB:M22996 SP:P13267 GB:M33543 GB:S55653] [LE:5720] [RE:9823] [DI:direct] >gp:[GI:g3930535] [LN:AF065313] [AC:AF065313] [PN:DNA polymerase III] [GN:polC] [OR:*Thermotoga maritima*] [DB:genpept-bct2] [DE:*Thermotoga maritima* DNA polymerase III (polC) gene, complete cds.] [NT:family C DNA polymerase] [LE:235] [RE:4338] [DI:direct]

| ORF Name | NT ID | AA ID | NT LN | AA LN | Score | P-Value |
|---|---|---|---|---|---|---|
| AI7503000994__4728377__f2__171 | 2506 | 6278 | 1146 | 381 | 544 | 1.7e−52 |

Description
pir:[LN:F69807] [AC:F69807] [PN:hypothetical protein yfkB] [GN:yfkB] [OR:*Bacillus subtilis*] [DB:pir2] >gp:[GI:e1182785:g2633119] [LN:BSUB0005] [AC:Z99108:AL009126] [GN:yfkB] [FN:unknown] [OR:*Bacillus subtilis*] [DB:genpept-bct1] [DE:*Bacillus subtilis* complete genome (section 5 of 21): from 802821 to 1011250.] [LE:64694] [RE:65155] [DI:complement] >gp:[GI:d1024271:g2626814] [LN:D83967] [AC:D83967] [PN:YfkB] [OR:*Bacillus subtilis*] [SR:*Bacillus subtilis* (strain:AC327) DNA] [DB:genpept-bct1] [DE:*Bacillus subtilis* genomic DNA, 74 degree region.] [LE:2766] [RE:3227] [DI:direct]

| ORF Name | NT ID | AA ID | NT LN | AA LN | Score | P-Value |
|---|---|---|---|---|---|---|
| AI7503000994__4876387__f3__376 | 2507 | 6279 | 180 | 59 | | |

Description
NO-HIT

| ORF Name | NT ID | AA ID | NT LN | AA LN | Score | P-Value |
|---|---|---|---|---|---|---|
| AI7503000994__4881313__c1__475 | 2508 | 6280 | 159 | 52 | | |

Description
NO-HIT

| ORF Name | NT ID | AA ID | NT LN | AA LN | Score | P-Value |
|---|---|---|---|---|---|---|
| AI7503000994__4900443__c1__449 | 2509 | 6281 | 1440 | 479 | 2460 | 1.5e−255 |

Description
sp:[LN:YZDD_BACSU] [AC:Q45486] [GN:YZDD] [OR:*BACILLUS SUBTILIS*] [DE:PET112-LIKE PROTEIN] [SP:Q45486] [DB:swissprot] >gp:[GI:g1354211] [LN:BSU49790] [AC:U49790] [PN:PET112-like protein] [OR:*Bacillus subtilis*] [DB:genpept-bct1] [DE:*Bacillus subtilis* PET112-like protein gene, complete cds.] [LE:433] [RE:1860] [DI:direct]

| ORF Name | NT ID | AA ID | NT LN | AA LN | Score | P-Value |
|---|---|---|---|---|---|---|
| AI7503000994__5133500__f1__48 | 2510 | 6282 | 480 | 159 | 358 | 8.6e−33 |

Description
pir:[LN:E69808] [AC:E69808] [PN:protein-tyrosine phosphatase homolog yfkJ] [GN:yfkJ] [CL:protein-tyrosine-phosphatase, low molecular weight] [OR:*Bacillus subtilis*] [DB:pir2] >gp:[GI:e1182778:g2633112] [LN:BSUB0005] [AC:Z99108:AL009126] [GN:yfkJ] [FN:unknown] [OR:*Bacillus subtilis*] [DB:genpept-bct1] [DE:*Bacillus subtilis* complete genome (section 5 of 21): from 802821 to 1011250.] [NT:similar to protein-tyrosine phosphatase] [LE:58691] [RE:59161] [DI:direct] >gp:[GI:d1024279:g2626822] [LN:D83967] [AC:D83967] [PN:YfkJ] [OR:*Bacillus subtilis*] [SR:*Bacillus subtilis* (strain:AC327) DNA] [DB:genpept-bct1] [DE:*Bacillus subtilis* genomic DNA, 74 degree region.] [LE:8760] [RE:9230] [DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503000994_5167268_c3_649 | 2511 | 6283 | 1080 | 359 | 613 | 8.2e−60 |

Description
sp:[LN:DINP_*ECOLI*] [AC:Q47155;Q47683] [GN:DINP] [OR:*ESCHERICHIA COLI*]
[DE:DNA-DAMAGE-INDUCIBLE PROTEIN P] [SP:Q47155;Q47683] [DB:swissprot]
>pir:[LN:H64747] [AC:H64747] [PN:DNA-damage-inducible protein dinP]
[GN:dinP] [CL:umuC protein] [OR:*Escherichia coli*] [DB:pir2]
>gp:[GI:d1008174:g984587] [LN:ECODINJ] [AC:D38582] [PN:DinP] [OR:*Escherichia coli*] [SR:*Escherichia coli* (sub_strain W3110, strain K-12) (library:
Kohara'] [DB:genpept-bct1] [DE:*Escherichia coli* genes for 'YafH, YafI, YafJ,
YafK, YafQ, DinJ, YafL, YafM, FhiA, MbhA, DinP, YafN, YafO and YafP.]
[NT:hypothetical; similarity to YLW6_CAEEL (P34409),] [LE:8540] [RE:9595]
[DI:direct] >gp:[GI:d1041669:g4902967] [LN:ECOTSF] [AC:D83536]
[PN:DNA-damage-inducible protein p.] [GN:dinP] [OR:*Escherichia coli*]
[SR:*Escherichia coli* (strain:K12) DNA] [DB:genpept-bct1] [DE:*Escherichia coli* genomic DNA. (4.1–6.1 min).] [NT:ORF_ID:o127#9; similar to PIR
Accession Number] [LE:60446] [RE:61501] [DI:direct] >gp:[GI:g1552799]
[LN:ECU70214] [AC:U70214] [PN:DinP] [GN:dinP] [OR:*Escherichia coli*]
[DB:genpept-bct1] [DE:*Escherichia coli* chromosome minutes 4–6.] [LE:81973]
[RE:83028] [DI:direct] >gp:[GI:g1786425] [LN:AE000131] [AC:AE000131:U00096]
[PN:damage-inducible protein P; putative tRNA] [GN:dinP] [FN:putative
enzyme; Not classified] [OR:*Escherichia coli*] [DB:genpept-bct2]
[DE:*Escherichia coli* K-12 MG1655 section 21 of 400 of the complete genome.]
[NT:o351; 100 pct identical to GB: ECODINJ_11] [LE:7487] [RE:8542]
[DI:direct]

| ORF Name | NT ID | AA ID | NT LN | AA LN | Score | P-Value |
|---|---|---|---|---|---|---|
| AI7503000994_5269400_f3_291 | 2512 | 6284 | 138 | 45 | | |

Description
NO-HIT

| ORF Name | NT ID | AA ID | NT LN | AA LN | Score | P-Value |
|---|---|---|---|---|---|---|
| AI7503000994_570327_c1_424 | 2513 | 6285 | 171 | 56 | 52 | 0.026 |

Description
pir:[LN:S68156] [AC:S68156] [PN:NADH dehydrogenase (ubiquinone), chain 3]
[GN:ND3] [CL:NADH dehydrogenase (ubiquinone) chain 3] [OR:mitochondrion
*Dictyostelium discoideum*] [EC:1.6.5.3] [DB:pir2] >gp:[GI:d1041830:g4958885]
[LN:AB000109] [AC:AB000109] [PN:NADH dehydrogenase subunit 3] [GN:nad3]
[OR:Mitochondrion *Dictyostelium discoideum*] [SR:*Dictyostelium discoideum*
(strain:AX3, partially X22 (48172–5151] [DB:genpept-inv1] [EC:1.6.5.3]
[DE:*Dictyostelium discoideum* mitochondrial DNA, complete sequence.]
[LE:24783] [RE:25145] [DI:direct] >gp:[GI:d1004450:g699592] [LN:DDID16466]
[AC:D16466] [PN:NADH dehydrogenase subunit 3] [GN:nad3] [OR:Mitochondrion
*Dictyostelium discoideum*] [SR:*Dictyostelium discoideum* (strain:AX3)
mitochondrion DNA] [DB:genpept-inv1] [EC:1.6.5.3] [DE:*Dictyostelium
discoideum* mitochondrial DNA.] [LE:7866] [RE:8228] [DI:direct]
>gp:[GI:d1004450:g699592] [LN:DDID16466] [AC:D16466] [PN:NADH dehydrogenase
subunit 3] [GN:nad3] [OR:Mitochondrion *Dictyostelium discoideum*]
[SR:*Dictyostelium discoideum* (strain:AX3) mitochondrion DNA] [DB:genpept]
[EC:1.6.5.3] [DE:*Dictyostelium discoideum* mitochondrial DNA.] [LE:7866]
[RE:8228] [DI:direct]

| ORF Name | NT ID | AA ID | NT LN | AA LN | Score | P-Value |
|---|---|---|---|---|---|---|
| AI7503000994_5860052_f3_388 | 2514 | 6286 | 435 | 144 | 107 | 3.4e−06 |

Description
pir:[LN:H71190] [AC:H71190] [PN:hypothetical protein PH1800] [GN:PH1800]
[OR:*Pyrococcus horikoshii*] [DB:pir2] >gp:[GI:d1031862:g3258236]
[LN:AP000007]
[AC:AP000007:AB009464:AB009465:AB009521:AB009522:AB009523:AB009524]
[PN:133aa long hypothetical protein] [GN:PH1800] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1485001–1738505 nt. position(7/7).] [LE:80658]
[RE:81059] [DI:direct]

| ORF Name | NT ID | AA ID | NT LN | AA LN | Score | P-Value |
|---|---|---|---|---|---|---|
| AI7503000994_5913882_f2_167 | 2515 | 6287 | 123 | 40 | | |

Description
NO-HIT

| ORF Name | NT ID | AA ID | NT LN | AA LN | Score | P-Value |
|---|---|---|---|---|---|---|

-continued

| | | | | | | |
|---|---|---|---|---|---|---|
| AI7503000994_6053308_c2_538 | 2516 | 6288 | 903 | 300 | 815 | 3.2e−81 |

Description
sp:[LN:NADE_*ECOLI*] [AC:P18843:P78235] [GN:NADE:EFG:NTRL] [OR:*ESCHERICHIA COLI*] [EC:6.3.5.1] [DE:PROTEIN)] [SP:P18843:P78235] [DB:swissprot]
>pir:[LN:D64933] [AC:D64933:A26928] [PN:NAD+ synthase (glutamine-hydrolyzing),:nitrogen-regulatory protein] [GN:nadE] [CL:spore outgrowth factor B] [OR:*Escherichia coli*] [EC:6.3.5.1] [DB:pir2] [MP:34–39 min] >gp:[GI:d1016252:g1742846] [LN:D90817] [AC:D90817:AB001340] [PN:NH(3)-dependent NAD(+) synthetase (EC 6.3.5.1)] [GN:nadE, efg, ntrL_] [OR:*Escherichia coli*] [SR:*Escherichia coli* (strain:K12) DNA, clone_lib:Kohara lambda minise] [DB:genpept-bct1] [DE:*E. coli* genomic DNA, Kohara clone #326(39.1–39.4 min.).] [NT:ORF_ID:o326#9; similar to [SwissProt Accession] [LE:7818] [RE:8645] DI:direct] >gp:[GI:d1016258:g1742853] [LN:D90818] [AC:D90818:AB001340] [PN:NH(3)-dependent NAD(+) synthetase (EC 6.3.5.1)] [GN:nadE, efg, ntrL_] [OR:*Escherichia coli*] [SR:*Escherichia coli* (strain:K12) DNA, clone_lib:Kohara lambda minise] [DB:genpept-bct1] [DE:*E. coli* genomic DNA, Kohara clone #327(39.2–39.5 min.).] [NT:ORF_ID:o326#9; similar to [SwissProt Accession] [LE:2186] [RE:3013] [DI:direct] >gp:[GI:g1788036] [LN:AE000269] [AC:AE000269:U00096] [PN:NAD synthetase, prefers NH3 over glutamine] [GN:nadE] [FN:enzyme; Biosynthesis of cofactors, carriers:] [OR:*Escherichia coli*] [DB:genpept-bct2] [EC:6.3.5.1] [DE:*Escherichia coli* K-12 MG1655 section 159 of 400 of the complete genome.] [NT:o275; residues 32–274 are 100 pct identical to] [LE:1232] [RE:2059] [DI:direct]

| ORF Name | NT ID | AA ID | NT LN | AA LN | Score | P-Value |
|---|---|---|---|---|---|---|
| AI7503000994_6147252_c1_473 | 2517 | 6289 | 846 | 281 | 150 | 1.6e−08 |

Description
sp:[LN:TAGG_BACSU] [AC:P42953] [GN:TAGG] [OR:*BACILLUS SUBTILIS*] [DE:TEICHOIC ACID TRANSLOCATION PERMEASE PROTEIN TAGG] [SP:P42953] [DB:swissprot]
>pir:[LN:S69202] [AC:S69202:H69720] [PN:teichoic acid permease tagG:integral membrane protein tagG] [GN:tagG] [OR:*Bacillus subtilis*] [DB:pir2] >gp:[GI:g755152] [LN:BSU13832] [AC:U13832] [PN:highly hydrophobic integral membrane protein] [GN:tagG] [FN:teichoic acid translocation] [OR:*Bacillus subtilis*] [DB:genpept-bct1] [DE:*Bacillus subtilis* 168 highly hydrophobic integral membrane protein(tagG) gene and ATP-binding protein (tagH) gene, complete cds.] [LE:287] [RE:1114] [DI:direct] >gp:[GI:e1184477:g2636097] [LN:BSUB0019] [AC:Z99122:AL009126] [PN:permease] [GN:tagG] [FN:teichoic acid translocation] [OR:*Bacillus subtilis*] [DB:genpept-bct1] [DE:*Bacillus subtilis* complete genome (section 19 of 21): from 3597091 to 3809700.] [SP:P42953] [LE:77137] [RE:77964] [DI:complement] >gp:[GI:e1184477:g2636097] [LN:BSUB0019] [AC:Z99122:AL009126] [PN:permease] [GN:tagG] [FN:teichoic acid translocation] [OR:*Bacillus subtilis*] [DB:genpept] [DE:*Bacillus subtilis* complete genome (section 19 of 21): from 3597091 to 3809700.] [SP:P42953] [LE:77137] [RE:77964] [DI:complement]

| ORF Name | NT ID | AA ID | NT LN | AA LN | Score | P-Value |
|---|---|---|---|---|---|---|
| AI7503000994_632661_c2_560 | 2518 | 6290 | 777 | 258 | 490 | 8.8e−47 |

Description
gp:[GI:g3820538] [LN:AF080002] [AC:AF080002] [PN:cobyric acid synthase CobQ] [GN:cobQ] [OR:*Heliobacillus mobilis*] [DB:genpept-bct2] [DE:*Heliobacillus mobilis* exopolyphosphatase Ppx (ppx) gene, partial cds; cobyric acid synthase CobQ (cobQ), UDP-N-acetylmuramyltripeptide synthetase MurC (murC), glutamyl tRNA reductase HemA (hemA), photosynthesis gene cluster, complete sequence, stage IIsporulation protein E Sp2E (sp2E), cell cycle protein MesJ (mesJ), and ATP-dependent zinc metallopeptidase FtsH (ftsH) genes, complete cds; and nucleoside diphosphate kinase B NdkB (ndkB) gene, partial cds.] [LE:1238] [RE:1996] [DI:complement]

| ORF Name | NT ID | AA ID | NT LN | AA LN | Score | P-Value |
|---|---|---|---|---|---|---|
| AI7503000994_6682627_c3_604 | 2519 | 6291 | 357 | 118 | 123 | 6.9e−08 |

Description
gp:[GI:g624123] [LN:PBU42580] [AC:U42580:U17055:U32570] [GN:a58L] [OR:*Paramecium bursaria* Chlorella virus 1] [DB:genpept-vrl] [DE:*Paramecium bursaria* Chlorella virus 1, complete genome.] [NT:contains Glu-, Gln-rich regions: QVQVV (11X), KEVWE] [LE:31140] [RE:31628] [DI:complement]

| ORF Name | NT ID | AA ID | NT LN | AA LN | Score | P-Value |
|---|---|---|---|---|---|---|
| AI7503000994_6829687_c2_512 | 2520 | 6292 | 618 | 205 | 355 | 1.8e−32 |

-continued

Description
pir:[LN:S42925] [AC:S42925] [PN:probable transport protein] [CL:ATP-binding
cassette homology] [OR:*Staphylococcus aureus*] [DB:pir2] >gp:[GI:g459256]
[LN:SASTPSMP] [AC:Z30588] [PN:Potential ABC transporter] [GN:stpC]
[OR:*Staphylococcus aureus*] [DB:genpept-bct1] [DE:*S. aureus* (RN4220) genes for
potential ABC transporter and potential membrane spanning protein.] [LE:199]
[RE:894] [DI:direct]

| ORF Name | NT ID | AA ID | NT LN | AA LN | Score | P-Value |
|---|---|---|---|---|---|---|
| AI7503000994__6931261__c1__409 | 2521 | 6293 | 537 | 178 | 128 | 2.0e−08 |

Description
gp:[GI:g2689551] [LN:U93688] [AC:U93688] [OR:*Staphylococcus aureus*]
[DB:genpept-bct2] [DE:*Staphylococcus aureus* toxic shock syndrome toxin-1
(tst), enterotoxin (ent), and integrase (int) genes, complete cds.] [NT:orf4]
[LE:3868] [RE:4395] [DI:complement]

| ORF Name | NT ID | AA ID | NT LN | AA LN | Score | P-Value |
|---|---|---|---|---|---|---|
| AI7503000994__7164087__c2__575 | 2522 | 6294 | 333 | 110 | 217 | 7.5e−18 |

Description
pir:[LN:A69801] [AC:A69801] [PN:hypothetical protein yfhH] [GN:yfhH]
[OR:*Bacillus subtilis*] [DB:pir2] >gp:[GI:e1182843:g2633177] [LN:BSUB0005]
[AC:Z99108:AL009126] [GN:yfhH] [FN:unknown] [OR:*Bacillus subtilis*]
[DB:genpept-bct1] [DE:*Bacillus subtilis* complete genome (section 5 of 21):
from 802821 to 1011250.] [LE:123116] [RE:123430] [DI:direct]
>gp:[GI:d1025390:g2804538] [LN:D85082] [AC:D85082] [PN:YfhH] [OR:*Bacillus
subtilis*] [SR:*Bacillus subtilis* DNA] [DB:genpept-bct1] [DE:*Bacillus subtilis*
DNA, genome sequence, 79 to 81 degree region.] [LE:16007] [RE:16321]
[DI:direct]

| ORF Name | NT ID | AA ID | NT LN | AA LN | Score | P-Value |
|---|---|---|---|---|---|---|
| AI7503000994__7207518__f2__267 | 2523 | 6295 | 375 | 124 | 151 | 7.4e−11 |

Description
pir:[LN:B27059] [AC:B27059] [PN:hypothetical protein 2] [OR:*Glycine max*]
[SR:, soybean] [DB:pir2]

| ORF Name | NT ID | AA ID | NT LN | AA LN | Score | P-Value |
|---|---|---|---|---|---|---|
| AI7503000994__789010__c3__620 | 2524 | 6296 | 132 | 43 | | |

Description
NO-HIT

| ORF Name | NT ID | AA ID | NT LN | AA LN | Score | P-Value |
|---|---|---|---|---|---|---|
| AI7503000994__799188__f1__118 | 2525 | 6297 | 468 | 155 | 252 | 9.8e−20 |

Description
gp:[GI:g3929312] [LN:AF100426] [AC:AF100426] [PN:fimbriae-associated protein
Fap1] [GN:fap1] [OR:*Streptococcus parasanguinis*] [DB:genpept-bct2]
[DE:*Streptococcus parasanguis* fimbriae-associated protein Fap1 (fap1) gene,
complete cds.] [NT:involved in fimbriae assembly and fimbriae-mediated]
[LE:284] [RE:7996] [DI:direct]

| ORF Name | NT ID | AA ID | NT LN | AA LN | Score | P-Value |
|---|---|---|---|---|---|---|
| AI7503000994__815903__c1__423 | 2526 | 6298 | 141 | 46 | | |

Description
NO-HIT

| ORF Name | NT ID | AA ID | NT LN | AA LN | Score | P-Value |
|---|---|---|---|---|---|---|
| AI7503000994__820325__f2__156 | 2527 | 6299 | 948 | 315 | 1131 | 1.1e−114 |

Description
sp:[LN:GSAB_BACSU] [AC:P71084] [GN:GSAB] [OR:*BACILLUS SUBTILIS*] [EC:5.4.3.8]
[DE:(GLUTAMATE-1-SEMIALDEHYDE AMINOTRANSFERASE) (GSA-AT)] [SP:P71084]
[DB:swissprot] >gp:[GI:e281581:g1673394] [LN:BSZ82044] [AC:Z82044]
[PN:glutamate-1-semialdehyde aminotransferase] [GN:gsaB] [OR:*Bacillus
subtilis*] [DB:genpept-bct1] [DE:*B. subtilis* 25 kb genomic DNA segment (from
sspE to katA).] [SP:P71084] [LE:5984] [RE:7273] [DI:complement]

-continued

| ORF Name | NT ID | AA ID | NT LN | AA LN | Score | P-Value |
|---|---|---|---|---|---|---|
| AI7503000994_860677_f1_3 | 2528 | 6300 | 177 | 58 | 72 | 0.017 |

Description
gp:[GI:g3845668] [LN:AF021254] [AC:AF021254] [PN:unknown] [GN:RTL5]
[OR:*avian adenovirus* type 8] [DB:genpept-vrl] [DE:*Avian adenovirus* type 8
strain ATCC A-2A 100 K protein homolog gene, partial cds; RTL10, RTR1, late
33 K protein homolog, pVIII homolog, RTL9, RTR2, fibre homolog, RTL8, RTL7,
RTL6, RTL5, and RTR3 genes, complete cds; and RTL4 gene, partial cds.]
[LE:8905] [RE:9216] [DI:complement]

| ORF Name | NT ID | AA ID | NT LN | AA LN | Score | P-Value |
|---|---|---|---|---|---|---|
| AI7503000994_885756_c3_662 | 2529 | 6301 | 180 | 59 | | |

Description
NO-HIT

| ORF Name | NT ID | AA ID | NT LN | AA LN | Score | P-Value |
|---|---|---|---|---|---|---|
| AI7503000994_979712_c1_430 | 2530 | 6302 | 1422 | 473 | 111 | 0.023 |

Description
pir:[LN:C71610] [AC:C71610] [PN:probable membrane associated protein
PFB0615c] [GN:PFB0615c] [OR:*Plasmodium falciparum*] [DB:pir2]
>gp:[GI:g3845231] [LN:AE001406] [AC:AE001406:AE001362] [PN:predicted
membrane associated protein] [GN:PFB0615c] [OR:*Plasmodium falciparum*]
[SR:malaria parasite *P. falciparum*] [DB:genpept-inv2] [DE:*Plasmodium
falciparum* chromosome 2, section 43 of 73 of the complete sequence.]
[NT:predicted by GlimmerM] [LE:1921:2496:6961] [RE:2310:6749:8358]
[DI:complementJoin]

| ORF Name | NT ID | AA ID | NT LN | AA LN | Score | P-Value |
|---|---|---|---|---|---|---|
| AI7503000994_985678_c3_646 | 2531 | 6303 | 975 | 324 | 889 | 4.6e−89 |

Description
pir:[LN:F69795] [AC:F69795] [PN:conserved hypothetical protein yerQ]
[GN:yerQ] [OR:*Bacillus subtilis*] [DB:pir2] >gp:[GI:e1182652:g2632986]
[LN:BSUB0004] [AC:Z99107:AL009126] [GN:yerQ] [FN:unknown] [OR:*Bacillus
subtilis*] [DB:genpept-bct1] [DE:*Bacillus subtilis* complete genome (section 4
of 21): from 600701 to 813890.] [NT:similar to hypothetical proteins]
[LE:135242] [RE:136153] [DI:direct]

| ORF Name | NT ID | AA ID | NT LN | AA LN | Score | P-Value |
|---|---|---|---|---|---|---|
| AI7503000994_9859433_c2_561 | 2532 | 6304 | 126 | 41 | | |

Description
NO-HIT

| ORF Name | NT ID | AA ID | NT LN | AA LN | Score | P-Value |
|---|---|---|---|---|---|---|
| AI7503000995_10580443_c1_140 | 2533 | 6305 | 237 | 78 | 246 | 6.4e−21 |

Description
sp:[LN:YEED_*ECOLI*] [AC:P33014] [GN:YEED] [OR:*ESCHERICHIA COLI*]
[DE:HYPOTHETICAL 8.1 KD PROTEIN IN SBCB-HISL INTERGENIC REGION] [SP:P33014]
[DB:swissprot] >pir:[LN:C64966] [AC:C64966] [PN:yeeD protein] [GN:yeeD]
[CL:conserved hypothetical protein HI0721] [OR:*Escherichia coli*] [DB:pir2]
>gp:[GI:d1016564:g1736686] [LN:D90839] [AC:D90839:AB001340] [GN:yeeD]
[OR:*Escherichia coli*] [SR:*Escherichia coli* (strain:K12) DNA,
clone_lib:Kohara lambda minise] [DB:genpept-bct1] [DE:*E. coli* genomic DNA,
Kohara clone #349(44.6–45.0 min.).] [NT:ORF_ID:o349#3; similar to [SwissProt
Accession] [LE:12878] [RE:13105] [DI:complement] >gp:[GI:d1016569:g1736692]
[LN:D90840] [AC:D90840:AB001340] [GN:yeeD] [OR:*Escherichia coli*]
[SR:*Escherichia coli* (strain:K12) DNA, clone_lib:Kohara lambda minise]
[DB:genpept-bct1] [DE:*E. coli* genomic DNA, Kohara clone #350(44.9–45.2
min.).] [NT:ORF_ID:o349#3; similar to [SwissProt Accession] [LE:1569]
[RE:1796] [DI:complement] >gp:[GI:g405955] [LN:ECOHU43] [AC:U00009]
[PN:yeeD] [OR:*Escherichia coli*] [SR:*Escherichia coli* K12 BHB2600]
[DB:genpept-bct1] [DE:sbcB region of *E. coli* K12 BHB2600.] [NT:similar to ORF
in fliE-amyA intergenic region] [LE:4083] [RE:4310] [DI:complement]
>gp:[GI:g1788322] [LN:AE000292] [AC:AE000292:U00096] [PN:orf, hypothetical
protein] [GN:yeeD] [FN:orf; Unknown] [OR:*Escherichia coli*] [DB:genpept-bct2]
[DE:*Escherichia coli* K-12 MG1655 section 182 of 400 of the complete genome.]

-continued

[NT:f75; 100 pct identical to YEED_ECOLI SW: P33014] [LE:9541] [RE:9768] [DI:complement]

| ORF Name | NT ID | AA ID | NT LN | AA LN | Score | P-Value |
|---|---|---|---|---|---|---|
| AI7503000995_12142768_f1_32 | 2534 | 6306 | 300 | 99 | 110 | 4.2e−06 |

Description
pir:[LN:D71245] [AC:D71245] [PN:hypothetical protein PH0221] [GN:PH0221]
[OR:*Pyrococcus horikoshii*] [DB:pir2] >gp:[GI:d1030234:g3256608]
[LN:AP000001]
[AC:AP000001:AB009465:AB009464:AB009466:AB009467:AB009468:AB009469]
[PN:235aa long hypothetical protein] [GN:PH0221] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:194212]
[RE:194919] [DI:complement]

| ORF Name | NT ID | AA ID | NT LN | AA LN | Score | P-Value |
|---|---|---|---|---|---|---|
| AI7503000995_13907566_c1_148 | 2535 | 6307 | 144 | 47 | | |

Description
NO-HIT

| ORF Name | NT ID | AA ID | NT LN | AA LN | Score | P-Value |
|---|---|---|---|---|---|---|
| AI7503000995_14493812_c1_131 | 2536 | 6308 | 465 | 154 | 289 | 1.8e−25 |

Description
pir:[LN:C69786] [AC:C69786] [PN:conserved hypothetical protein ydiB]
[GN:ydiB] [CL:hypothetical protein HI0065] [OR:*Bacillus subtilis*] [DB:pir2]
>gp:[GI:e1182570:g2632904] [LN:BSUB0004] [AC:Z99107:AL009126] [GN:ydiB]
[FN:unknown] [OR:*Bacillus subtilis*] [DB:genpept-bct1] [DE:*Bacillus subtilis* complete genome (section 4 of 21): from 600701 to 813890.] [NT:similar to
hypothetical proteins] [LE:40670] [RE:41146] [DI:direct]
>gp:[GI:d1020494:g1945107] [LN:D88802] [AC:D88802] [GN:ydiB] [OR:*Bacillus subtilis*] [SR:*Bacillus subtilis* (sub_species:Marburg, strain:168,
isolate:JH642] [DB:genpept-bct1] [DE:*Bacillus subtilis* DNA for
phoB-rrnE-groESL region, complete cds.] [NT:*E. coli* hypothetical protein;
P31805 (267)] [LE:27672] [RE:28148] [DI:direct]

| ORF Name | NT ID | AA ID | NT LN | AA LN | Score | P-Value |
|---|---|---|---|---|---|---|
| AI7503000995_1461637_f2_60 | 2537 | 6309 | 249 | 82 | 123 | 6.9e−08 |

Description
sp:[LN:ILVN_BACSU] [AC:P37252] [GN:ILVN] [OR:*BACILLUS SUBTILIS*]
[EC:4.1.3.18] [DE:(ACETOHYDROXY-ACID SYNTHASE SMALL SUBUNIT) (ALS)]
[SP:P37252] [DB:swissprot] >pir:[LN:E69644] [AC:E69644] [PN:acetolactate
synthase (small subunit) ilvN] [GN:ilvN] [CL:acetolactate synthase small
chain] [OR:*Bacillus subtilis*] [DB:pir2] >gp:[GI:g143092] [LN:BACILNB]
[AC:L03181] [PN:acetolactate synthase small subunit] [GN:ilvN] [OR:*Bacillus subtilis*] [SR:*Bacillus subtilis* DNA] [DB:genpept-bct1] [DE:*Bacillus subtilis*
ilvB, ilvN and ilvC genes, complete ilv-leuoperon.] [LE:2438] [RE:2962]
[DI:direct] >gp:[GI:e1184079:g2635295] [LN:BSUB0015] [AC:Z99118:AL009126]
[PN:acetolactate synthase (acetohydroxy-acid)] [GN:ilvN]
[FN:valine/isoleucine biosynthesis] [OR:*Bacillus subtilis*] [DB:genpept-bct1]
[EC:4.1.3.18] [DE:*Bacillus subtilis* complete genome (section 15 of 21): from
2795131 to 3013540.] [SP:P37252] [LE:98696] [RE:99220] [DI:complement]
>gp:[GI:e1165365:g1770067] [LN:BSZ75208] [AC:Z75208] [PN:acetolactate
synthase small subunit] [GN:ilvN] [OR:*Bacillus subtilis*] [DB:genpept-bct1]
[EC:4.1.3.18] [DE:*B. subtilis* genomic sequence 89009 bp.] [NT:acetolactate
synthase (acetohydroxy-acid synthase)] [SP:P37252] [LE:70687] [RE:71211]
[DI:direct]

| ORF Name | NT ID | AA ID | NT LN | AA LN | Score | P-Value |
|---|---|---|---|---|---|---|
| AI7503000995_14849093_c3_180 | 2538 | 6310 | 294 | 97 | 133 | 6.0e−09 |

Description
pir:[LN:F71245] [AC:F71245] [PN:hypothetical protein PHS004] [GN:PHS004]
[OR:*Pyrococcus horikoshii*] [DB:pir2] >gp:[GI:d1030236:g3256610]
[LN:AP000001]
[AC:AP000001:AB009465:AB009464:AB009466:AB009467:AB009468:AB009469] [PN:58aa
long hypothetical protein] [GN:PHS004] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [NT:similar to
GENPEPT:Z47547 percent identity:50.000] [LE:195255] [RE:195431] [DI:direct]

-continued

| ORF Name | NT ID | AA ID | NT LN | AA LN | Score | P-Value |
|---|---|---|---|---|---|---|
| AI7503000995__14897837__f1__29 | 2539 | 6311 | 1275 | 424 | 1161 | 4.3e−128 |

Description
sp:[LN:THD1_LACLA] [AC:Q02145] [GN:ILVA] [OR:*LACTOCOCCUS LACTIS*]
[SR:,SUBSPLACTIS:*STREPTOCOCCUS LACTIS*] [EC:4.2.1.16] [DE:DEAMINASE)]
[SP:Q02145] [DB:swissprot] >pir:[LN:S35141] [AC:S35141] [PN:probable
threonine dehydratase,] [GN:ilvA] [CL:threonine dehydratase]
[OR:*Lactococcus lactis* subsp. *lactis*] [EC:4.2.1.16] [DB:pir2]

| ORF Name | NT ID | AA ID | NT LN | AA LN | Score | P-Value |
|---|---|---|---|---|---|---|
| AI7503000995__157802__c1__135 | 2540 | 6312 | 141 | 46 | | |

Description
NO-HIT

| ORF Name | NT ID | AA ID | NT LN | AA LN | Score | P-Value |
|---|---|---|---|---|---|---|
| AI7503000995__1702__f2__36 | 2541 | 6313 | 522 | 173 | 88 | 0.0089 |

Description
pir:[LN:T00168] [AC:T00168] [PN:hypothetical protein 33] [OR:*Staphylococcus
aureus* phage phi PVL] [DB:pir3] >gp:[GI:d1032869:g3341942] [LN:AB009866]
[AC:AB009866] [OR:bacteriophage phi PVL] [SR:bacteriophage phi PVL
(specific_host:*Staphylococcus aureus* ATC] [DB:genpept-phg] [DE:Bacteriophage
phi PVL proviral DNA, complete sequence.] [NT:orf 33] [LE:28172] [RE:28582]
[DI:complement]

| ORF Name | NT ID | AA ID | NT LN | AA LN | Score | P-Value |
|---|---|---|---|---|---|---|
| AI7503000995__19564128__c2__172 | 2542 | 6314 | 315 | 104 | | |

Description
NO-HIT

| ORF Name | NT ID | AA ID | NT LN | AA LN | Score | P-Value |
|---|---|---|---|---|---|---|
| AI7503000995__20422318__f3__73 | 2543 | 6315 | 417 | 138 | 105 | 2.2e−05 |

Description
pir:[LN:D69633] [AC:D69633] [PN:glutamine ABC transporter
(glutamine-binding protein) glnH] [GN:glnH]
[CL:lysine-arginine-ornithine-binding protein] [OR:*Bacillus subtilis*]
[DB:pir2] >gp:[GI:e1183973:g2635189] [LN:BSUB0014] [AC:Z99117:AL009126]
[PN:glutamine ABC transporter (glutamine-binding] [GN:glnH] [OR:*Bacillus
subtilis*] [DB:genpept-bct1] [DE:*Bacillus subtilis* complete genome (section
14 of 21): from 2599451 to 2812870.] [LE:202928] [RE:203749] [DI:direct]
>gp:[GI:e1183991:g2635207] [LN:BSUB0015] [AC:Z99118:AL009126] [PN:glutamine
ABC transporter (glutamine-binding] [GN:glnH] [OR:*Bacillus subtilis*]
[DB:genpept-bct1] [DE:*Bacillus subtilis* complete genome (section 15 of 21):
from 2795131 to 3013540.] [LE:7248] [RE:8069] [DI:direct]

| ORF Name | NT ID | AA ID | NT LN | AA LN | Score | P-Value |
|---|---|---|---|---|---|---|
| AI7503000995__2114077__c2__166 | 2544 | 6316 | 156 | 51 | 115 | 1.1e−06 |

Description
pir:[LN:D69786] [AC:D69786] [PN:glycoprotein endopeptidase homolog ydiC]
[GN:ydiC] [OR:*Bacillus subtilis*] [DB:pir2] >gp:[GI:e1182571:g2632905]
[LN:BSUB0004] [AC:Z99107:AL009126] [GN:ydiC] [FN:unknown] [OR:*Bacillus
subtilis*] [DB:genpept-bct1] [DE:*Bacillus subtilis* complete genome (section 4
of 21): from 600701 to 813890.] [NT:similar to glycoprotein endopeptidase]
[LE:41127] [RE:41816] [DI:direct] >gp:[GI:d1020495:g1945108] [LN:D88802]
[AC:D88802] [GN:ydiC] [OR:*Bacillus subtilis*] [SR:*Bacillus subtilis*
(sub_species:Marburg, strain:168, isolate:JH642] [DB:genpept-bct1]
[DE:*Bacillus subtilis* DNA for phoB-rrnE-groESL region, complete cds.] [NT:*H.
influenzae* hypothetical protein; P43990 (182)] [LE:28129] [RE:28818]
[DI:direct]

| ORF Name | NT ID | AA ID | NT LN | AA LN | Score | P-Value |
|---|---|---|---|---|---|---|
| AI7503000995__2125637__f3__111 | 2545 | 6317 | 150 | 49 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000995__22441907__f2__58 | 2546 | 6318 | 1869 | 622 | 1924 | 9.7e−199 |

Description
sp:[LN:ILVD_BACSU] [AC:P51785] [GN:ILVD] [OR:*BACILLUS SUBTILIS*] [EC:4.2.1.9]
[DE:110) (VEG110)] [SP:P51785] [DB:swissprot]

| ORF Name | NT ID | AA ID | NT LN | AA LN | Score | P-Value |
|---|---|---|---|---|---|---|
| AI7503000995__22766502__f1__18 | 2547 | 6319 | 135 | 44 | | |

Description
NO-HIT

| ORF Name | NT ID | AA ID | NT LN | AA LN | Score | P-Value |
|---|---|---|---|---|---|---|
| AI7503000995__23478463__f3__99 | 2548 | 6320 | 1755 | 584 | 1667 | 1.7e−171 |

Description
pir:[LN:B69644] [AC:B69644:I39865] [PN:acetolactate synthase, large chain]
[GN:ilvB] [CL:acetolactate synthase large chain:thiamine
pyrophosphate-binding domain homology] [OR:*Bacillus subtilis*] [EC:4.1.3.18]
[DB:pir2] >gp:[GI:e1184080:g2635296] [LN:BSUB0015] [AC:Z99118:AL009126]
[PN:acetolactate synthase (acetohydroxy-acid)] [GN:ilvB]
[FN:valine/isoleucine biosynthesis] [OR:*Bacillus subtilis*] [DB:genpept-bct1]
[EC:4.1.3.18] [DE:*Bacillus subtilis* complete genome (section 15 of 21): from
2795131 to 3013540.] [LE:99217] [RE:100941] [DI:complement]
>gp:[GI:e1165364:g1770066] [LN:BSZ75208] [AC:Z75208] [PN:acetolactate
synthase large subunit] [GN:ilvB] [OR:*Bacillus subtilis*] [DB:genpept-bct1]
[EC:4.1.3.18] [DE:*B. subtilis* genomic sequence 89009 bp.] [NT:acetolactate
synthase (acetohydroxy-acid synthase)] [LE:68966] [RE:70690] [DI:direct]

| ORF Name | NT ID | AA ID | NT LN | AA LN | Score | P-Value |
|---|---|---|---|---|---|---|
| AI7503000995__23867325__f2__64 | 2549 | 6321 | 570 | 189 | 561 | 2.6e−54 |

Description
sp:[LN:LEUD_LACLA] [AC:Q02144] [GN:LEUD] [OR:*LACTOCOCCUS LACTIS*]
[SR:,SUBSPLACTIS:*STREPTOCOCCUS LACTIS*] [EC:4.2.1.33] [DE:(ISOPROPYLMALATE
ISOMERASE) (ALPHA-IPM ISOMERASE)] [SP:Q02144] [DB:swissprot]
>pir:[LN:E36889] [AC:E36889:S35135] [PN:probable 3-isopropylmalate
dehydratase, chain leuD] [GN:leuD] [CL:3-isopropylmalate dehydratase small
chain] [OR:*Lactococcus lactis* subsp. *lactis*] [EC:4.2.1.33] [DB:pir2]
>gp:[GI:g2565154] [LN:LLU92974] [AC:U92974:M90760:M90761] [PN:LeuD]
[GN:leuD] [OR:*Lactococcus lactis*] [DB:genpept-bct1] [DE:*Lactococcus lactis*
unknown gene, partial cds, and HisC (hisC) , unknown, HisG (hisG), unknown,
HisB (hisB), unknown, HisH (hish), HisA (hisA), HisF (hisF), HisIE (hisIE),
unknown, unknown, LeuA (leuA), LeuB (leuB), LeuC (leuC), LeuD (leuD),
unknown, IlvD (ilvD), IlvB (ilvB), IlvN, IlvC (ilvC), IlvA (ilvA), AldB
(aldB) and aldR (aldR) genes, complete cds.] [NT:isopropylmalate dehydratase
subunit] [LE:16590] [RE:17165] [DI:direct]

| ORF Name | NT ID | AA ID | NT LN | AA LN | Score | P-Value |
|---|---|---|---|---|---|---|
| AI7503000995__24343813__c1__139 | 2550 | 6322 | 1119 | 372 | 1075 | 9.0e−109 |

Description
sp:[LN:YEEE_*ECOLI*] [AC:P33015] [GN:YEEE] [OR:*ESCHERICHIA COLI*]
[DE:HYPOTHETICAL 38.1 KD PROTEIN IN SBCB-HISL INTERGENIC REGION] [SP:P33015]
[DB:swissprot] >pir:[LN:D64966] [AC:D64966] [PN:membrane protein yeeE]
[GN:yeeE] [OR:*Escherichia coli*] [DB:pir2] >gp:[GI:d1016565:g1736687]
[LN:D90839] [AC:D90839:AB001340] [GN:yeeE] [OR:*Escherichia coli*]
[SR:*Escherichia coli* (strain:K12) DNA, clone_lib:Kohara lambda minise]
[DB:genpept-bct1] [DE:*E. coli* genomic DNA, Kohara clone #349(44.6–45.0
min.).] [NT:ORF_ID:o349#4; similar to [SwissProt Accession] [LE:13119]
[RE:14177] [DI:complement] >gp:[GI:d1016570:g1736693] [LN:D90840]
[AC:D90840:AB001340] [GN:yeeE] [OR:*Escherichia coli*] [SR:*Escherichia coli*
(strain:K12) DNA, clone_lib:Kohara lambda minise] [DB:genpept-bct1]
[DE:*E. coli* genomic DNA, Kohara clone #350(44.9–45.2 min.).]
[NT:ORF_ID:o349#4; similar to [SwissProt Accession] [LE:1810] [RE:2868]
[DI:complement] >gp:[GI:g405956] [LN:ECOHU43] [AC:U00009] [PN:yeeE]
[OR:*Escherichia coli*] [SR:*Escherichia coli* K12 BHB2600] [DB:genpept-bct1]
[DE:sbcB region of *E. coli* K12 BHB2600.] [NT:similar to ORF in fliE-amyA
intergenic region] [LE:4324] [RE:5382] [DI:complement] >gp:[GI:g1788323]
[LN:AE000292] [AC:AE000292:U00096] [PN:putative transport system permease -continued protein] [GN:yeeE] [FN:putative transport; Not classified] [OR:*Escherichia coli*] [DB:genpept-bct2] [DE:*Escherichia coli* K-12 MG1655 section 182 of 400 of the complete genome.] [NT:f352; 100 pct identical to YEEE__ECOLI SW: P33015] [LE:9782] [RE:10840] [DI:complement]

| ORF Name | NT ID | AA ID | NT LN | AA LN | Score | P-Value |
|---|---|---|---|---|---|---|
| AI7503000995__24640625__c2__175 | 2551 | 6323 | 960 | 319 | 954 | 6.0e−96 |

Description
sp:[LN:SCRR__STAXY] [AC:P74892] [GN:SCRR] [OR:*STAPHYLOCOCCUS XYLOSUS*] [DE:SUCROSE OPERON REPRESSOR (SCR OPERON REGULATORY PROTEIN)] [SP:P74892] [DB:swissprot] >gp:[GI:e264641:g949974] [LN:SXSCRBA] [AC:X67744] [PN:sucrose repressor] [GN:scrR] [OR:*Staphylococcus xylosus*] [DB:genpept-bct1] [DE:*S. xylosus* scrB and scrR genes.] [SP:P74892] [LE:495] [RE:1457] [DI:direct]

| ORF Name | NT ID | AA ID | NT LN | AA LN | Score | P-Value |
|---|---|---|---|---|---|---|
| AI7503000995__24646962__c1__150 | 2552 | 6324 | 210 | 69 | 79 | 0.0032 |

Description
gp:[GI:g2564351] [LN:VCU83795] [AC:U83795] [PN:RstR] [GN:rstR] [FN:repressor of rstA transcription] [OR:*Vibrio cholerae*] [DB:genpept-bct1] [DE:*Vibrio cholerae* RstR (rstR), RstA1 (rstA1), RstB1 (rstB1) and RstC (rstC) genes, complete cds.] [LE:496] [RE:834] [DI:complement] >gp:[GI:g2564356] [LN:VCU83796] [AC:U83796] [PN:RstR] [GN:rstR] [FN:repressor of rstA transcription] [OR:*Vibrio cholerae*] [DB:genpept-bct1] [DE:*Vibrio cholerae* RstR (rstR), RstA2 (rstA2), and RstB2 (rstB2) genes, complete cds.] [LE:496] [RE:834] [DI:complement]

| ORF Name | NT ID | AA ID | NT LN | AA LN | Score | P-Value |
|---|---|---|---|---|---|---|
| AI7503000995__24814812__f3__90 | 2553 | 6325 | 1950 | 649 | 1516 | 1.7e−155 |

Description
sp:[LN:YDIF__BACSU] [AC:O05519] [GN:YDIF] [OR:*BACILLUS SUBTILIS*] [DE:HYPOTHETICAL ABC TRANSPORTER ATP-BINDING PROTEIN YDIF] [SP:O05519] [DB:swissprot] >pir:[LN:G69786] [AC:G69786] [PN:ABC transporter (ATP-binding protein) homolog ydiF] [GN:ydiF] [CL:ATP-binding cassette homology] [OR:*Bacillus subtilis*] [DB:pir2] >gp:[GI:e1182574:g2632908] [LN:BSUB0004] [AC:Z99107:AL009126] [GN:ydiF] [FN:unknown] [OR:*Bacillus subtilis*] [DB:genpept-bct1] [DE:*Bacillus subtilis* complete genome (section 4 of 21): from 600701 to 813890.] [NT:similar to ABC transporter (ATP-binding protein)] [SP:O05519] [LE:43544] [RE:45472] [DI:complement] >gp:[GI:d1020498:g1945111] [LN:D88802] [AC:D88802] [GN:ydiF] [OR:*Bacillus subtilis*] [SR:*Bacillus subtilis* (sub__species:Marburg, strain:168, isolate:JH642] [DB:genpept-bct1] [DE:*Bacillus subtilis* DNA for phoB-rrnE-groESL region, complete cds.] [NT:*H. influenzae* hypothetical ABC transporter; P44808] [LE:30546] [RE:32474] [DI:complement]

| ORF Name | NT ID | AA ID | NT LN | AA LN | Score | P-Value |
|---|---|---|---|---|---|---|
| AI7503000995__24823588__f2__63 | 2554 | 6326 | 1386 | 461 | 1633 | 6.7e−168 |

Description
sp:[LN:LEU2__LACLA] [AC:Q02142] [GN:LEUC] [OR:*LACTOCOCCUS LACTIS*] [SR:,SUBSPLACTIS:*STREPTOCOCCUS LACTIS*] [EC:4.2.1.33] [DE:(ISOPROPYLMALATE ISOMERASE) (ALPHA-IPM ISOMERASE) (IPMI)] [SP:Q02142] [DB:swissprot] >pir:[LN:S35134] [AC:S35134] [PN:probable 3-isopropylmalate dehydratase, chain leuC] [GN:leuC] [OR:*Lactococcus lactis* subsp. *lactis*] [SR:strain NCDO2118, , strain NCDO2118] [SR:strain NCDO2118,] [EC:4.2.1.33] [DB:pir2] >gp:[GI:g2565153] [LN:LLU92974] [AC:U92974:M90760:M90761] [PN:LeuC] [GN:leuC] [OR:*Lactococcus lactis*] [DB:genpept-bct1] [DE:*Lactococcus lactis* unknown gene, partial cds, and HisC (hisC), unknown, HisG (hisG), unknown, HisB (hisB), unknown, HisH (hish), HisA (hisA), HisF (hisF), HisIE (hisIE), unknown, unknown, LeuA (leuA), LeuB (leuB), LeuC (leuC), LeuD (leuD), unknown, IlvD (ilvD), IlvB (ilvB), IlvN, IlvC (ilvC), IlvA (ilvA), AldB (aldB) and aldR (aldR) genes, complete cds.] [NT:isopropylmalate dehydratase subunit] [LE:15188] [RE:16570] [DI:direct]

| ORF Name | NT ID | AA ID | NT LN | AA LN | Score | P-Value |
|---|---|---|---|---|---|---|
| AI7503000995__25900300__c3__212 | 2555 | 6327 | 330 | 110 | 297 | 2.5e−26 |

-continued

Description
gp:[GI:g2689561] [LN:U93688] [AC:U93688] [OR:*Staphylococcus aureus*]
[DB:genpept-bct2] [DE:*Staphylococcus aureus* toxic shock syndrome toxin-1
(tst), enterotoxin (ent), and integrase (int) genes, complete cds.]
[NT:orf14] [LE:10769] [RE:11029] [DI:complement]

| ORF Name | NT ID | AA ID | NT LN | AA LN | Score | P-Value |
|---|---|---|---|---|---|---|
| AI7503000995__26615912__c3__206 | 2556 | 6328 | 1479 | 492 | 1943 | 9.5e−201 |

Description
sp:[LN:SCRB_STAXY] [AC:Q05936] [GN:SCRB] [OR:*STAPHYLOCOCCUS XYLOSUS*]
[EC:3.2.1.26] [DE:SUCROSE-6-PHOSPHATE HYDROLASE, (SUCRASE) (INVERTASE)]
[SP:Q05936] [DB:swissprot >pir:[LN:A47059] [AC:A47059] [PN:sucrase ScrB]
[OR:*Staphylococcus xylosus*] [DB:pir2] >gp:[GI:e264653:g288269] [LN:SXSCRBA]
[AC:X67744] [PN:beta-fructofuranosidase] [GN:scrB] [OR:*Staphylococcus
xylosus*] [DB:genpept-bct1] [EC:3.2.1.26] [DE:*S. xylosus* scrB and scrR genes.]
[SP:Q05936] [LE:1541] [RE:3025] [DI:direct]

| ORF Name | NT ID | AA ID | NT LN | AA LN | Score | P-Value |
|---|---|---|---|---|---|---|
| AI7503000995__2866090__f2__35 | 2557 | 6329 | 1254 | 417 | 1250 | 2.6e−127 |

Description
gp:[GI:g2689564] [LN:U93688] [AC:U93688] [PN:integrase] [GN:int]
[OR:*Staphylococcus aureus*] [DB:genpept-bct2] [DE:*Staphylococcus aureus* toxic
shock syndrome toxin-1 (tst), enterotoxin (ent), and integrase (int) genes,
complete cds.] [NT:similar to staphylococcal phage integrase] [LE:13871]
[RE:15091] [DI:direct]

| ORF Name | NT ID | AA ID | NT LN | AA LN | Score | P-Value |
|---|---|---|---|---|---|---|
| AI7503000995__29307312__c3__181 | 2558 | 6330 | 165 | 54 | | |

Description
NO-HIT

| ORF Name | NT ID | AA ID | NT LN | AA LN | Score | P-Value |
|---|---|---|---|---|---|---|
| AI7503000995__31436__f1__15 | 2559 | 6331 | 177 | 58 | | |

Description
NO-HIT

| ORF Name | NT ID | AA ID | NT LN | AA LN | Score | P-Value |
|---|---|---|---|---|---|---|
| AI7503000995__31680342__f3__74 | 2560 | 6332 | 546 | 181 | 176 | 4.6e−12 |

Description
gp:[GI:g1633572] [LN:KSU52064] [AC:U52064] [OR:Kaposi's sarcoma-associated
herpesvirus] [SR:Kaposi's sarcoma-associated herpesvirus - Human herpesvirus
8] [DB:genpept-vrl] [DE:Kaposi's sarcoma-associated herpes-like virus ORF73
homolog gene, complete cds.] [NT:Herpesvirus saimiri ORF73 homolog] [LE:1]
[RE:3489] [DI:direct] >gp:[GI:g1718329] [LN:KSU75698] [AC:U75698]
[OR:Kaposi's sarcoma-associated herpesvirus] [SR:Kaposi's sarcoma-associated
herpesvirus - Human herpesvirus 8] [DB:genpept-vrl] [DE:Kaposi's
sarcoma-associated herpesvirus long unique region, 80 putative ORF's and
kaposin gene, complete cds.] [NT:ORF 73; extensive acidic domains, potential
leucine] [LE:123809] [RE:127297] [DI:complement]

| ORF Name | NT ID | AA ID | NT LN | AA LN | Score | P-Value |
|---|---|---|---|---|---|---|
| AI7503000995__33203138__c1__133 | 2561 | 6333 | 159 | 52 | | |

Description
NO-HIT

| ORF Name | NT ID | AA ID | NT LN | AA LN | Score | P-Value |
|---|---|---|---|---|---|---|
| AI7503000995__3361326__c2__151 | 2562 | 6334 | 207 | 68 | | |

Description
NO-HIT

| ORF Name | NT ID | AA ID | NT LN | AA LN | Score | P-Value |
|---|---|---|---|---|---|---|
| AI7503000995__34257878__f2__62 | 2563 | 6335 | 1065 | 354 | 894 | 1.4e−89 |

-continued

Description
sp:[LN:LEU3_LACLA] [AC:Q02143] [GN:LEUB] [OR:*LACTOCOCCUS LACTIS*]
[SR:,SUBSPLACTIS:*STREPTOCOCCUS LACTIS*] [EC:1.1.1.85] [DE:(IMDH) (3-IPM-DH)]
[SP:Q02143] [DB:swissprot] >pir:[LN:S35133] [AC:S35133:C36889]
[PN:3-isopropylmalate dehydrogenase,] [GN:leuB] [CL:3-isopropylmalate
dehydrogenase] [OR:*Lactococcus lactis* subsp. *lactis*] [SR:strain NCDO2118, ,
strain NCDO2118] [SR:strain NCDO2118,] [EC:1.1.1.85] [DB:pir2]
>gp:[GI:g2565152] [LN:LLU92974] [AC:U92974:M90760:M90761] [PN:LeuB]
[GN:leuB] [OR:*Lactococcus lactis*] [DB:genpept-bct1] [DE:*Lactococcus lactis*
unknown gene, partial cds, and HisC (hisC), unknown, HisG (hisG), unknown,
HisB (hisB), unknown, HisH (hish), HisA (hisA), HisF (hisF), HisIE (hisIE),
unknown, unknown, LeuA (leuA), LeuB (leuB), LeuC (leuC), LeuD (leuD),
unknown, IlvD (ilvD), IlvB (ilvB), IlvN, IlvC (ilvC), IlvA (ilvA), AldB
(aldB) and aldR (aldR) genes, complete cds.] [NT:isopropylmalate
dehydrogenase] [LE:13788] [RE:14825] [DI:direct]

| ORF Name | NT ID | AA ID | NT LN | AA LN | Score | P-Value |
| --- | --- | --- | --- | --- | --- | --- |
| AI7503000995_34412750_c3_207 | 2564 | 6336 | 966 | 321 | 1031 | 4.2e−104 |

Description
pir:[LN:S20799] [AC:S58482:S20799] [PN:hypothetical protein 7]
[CL:ribokinase] [OR:*Staphylococcus aureus*] [DB:pir2] >gp:[GI:g46512]
[LN:SAAGRAB] [AC:X52543:M32737] [OR:*Staphylococcus aureus*] [DB:genpept-bct1]
[DE:*S. aureus* agrA, agrB and hld genes.] [NT:orf 7] [LE:4896] [RE:5855]
[DI:complement]

| ORF Name | NT ID | AA ID | NT LN | AA LN | Score | P-Value |
| --- | --- | --- | --- | --- | --- | --- |
| AI7503000995_35598750_f3_72 | 2565 | 6337 | 849 | 282 | 112 | 3.9e−06 |

Description
gp:[GI:g2897106] [LN:AF020798] [AC:AF020798] [PN:repressor]
[OR:*Streptococcus thermophilus* bacteriophage TP-J34] [DB:genpept-phg]
[DE:*Streptococcus thermophilus* bacteriophage lysogeny module,
integrase homolog (int), putative host cell surface-exposed
lipoprotein, putative metallo-proteinase, repressor, Cro-like
regulatory protein, and P1-antirepressor homolog genes, complete cds.]
[NT:CI-like regulatory protein; orf121] [LE:4825] [RE:5190] [DI:complement]

| ORF Name | NT ID | AA ID | NT LN | AA LN | Score | P-Value |
| --- | --- | --- | --- | --- | --- | --- |
| AI7503000995_36132937_f2_53 | 2566 | 6338 | 1641 | 546 | 273 | 9.6e−20 |

Description
sp:[LN:HEXA_STRPN] [AC:P10564] [GN:HEXA] [OR:*STREPTOCOCCUS PNEUMONIAE*]
[DE:DNA MISMATCH REPAIR PROTEIN HEXA] [SP:P10564] [DB:swissprot]
>pir:[LN:C28667] [AC:C28667] [PN:DNA mismatch repair protein hexA] [GN:hexA]
[CL:DNA mismatch repair protein mutS] [OR:*Streptococcus pneumoniae*]
[DB:pir2] >gp:[GI:g153655] [LN:STRHEXA] [AC:M18729] [PN:mismatch repair
protein] [GN:hexA] [OR:*Streptococcus pneumoniae*] [SR:*Streptococcus
pneumoniae* (strain 175) (clone: pLS141.) DNA] [DB:genpept-bct1]
[DE:*S. pneumoniae* mismatch repair protein (hexA) gene, complete cds.]
[LE:971] [RE:3505] [DI:direct]

| ORF Name | NT ID | AA ID | NT LN | AA LN | Score | P-Value |
| --- | --- | --- | --- | --- | --- | --- |
| AI7503000995_36206502_c3_197 | 2567 | 6339 | 483 | 160 | 340 | 7.0e−31 |

Description
pir:[LN:E69786] [AC:E69786] [PN:ribosomal-protein-alanine N-acetyltransfer
homolog ydiD] [GN:ydiD] [CL:*Escherichia coli* peptide N-acetyltransferase
rimI] [OR:*Bacillus subtilis*] [DB:pir2] >gp:[GI:e1182572:g2632906]
[LN:BSUB0004] [AC:Z99107:AL009126] [GN:ydiD] [FN:unknown] [OR:*Bacillus
subtilis*] [DB:genpept-bct1] [DE:*Bacillus subtilis* complete genome (section 4
of 21): from 600701 to 813890.] [NT:similar to ribosomal-protein-alanine]
[LE:41826] [RE:42281] [DI:direct] >gp:[GI:d1020496:g1945109] [LN:D88802]
[AC:D88802] [GN:ydiD] [OR:*Bacillus subtilis*] [SR:*Bacillus subtilis*
(sub_species:Marburg, strain:168, isolate:JH642] [DB:genpept-bct1]
[DE:*Bacillus subtilis* DNA for phoB-rrnE-groESL region, complete cds.] [NT:*H.
influenzae*, ribosomal protein alanine] [LE:28828] [RE:29283] [DI:direct]

| ORF Name | NT ID | AA ID | NT LN | AA LN | Score | P-Value |
| --- | --- | --- | --- | --- | --- | --- |
| AI7503000995_409556_f1_33 | 2568 | 6340 | 135 | 44 | 112 | 2.5e−06 |

Description
pir:[LN:D71245] [AC:D71245] [PN:hypothetical protein PH0221] [GN:PH0221]
[OR:*Pyrococcus horikoshii*] [DB:pir2] >gp:[GI:d1030234:g3256608]

-continued

[LN:AP000001]
[AC:AP000001:AB009465:AB009464:AB009466:AB009467:AB009468:AB009469]
[PN:235aa long hypothetical protein] [GN:PH0221] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:194212]
[RE:194919] [DI:complement]

| ORF Name | NT ID | AA ID | NT LN | AA LN | Score | P-Value |
|---|---|---|---|---|---|---|
| AI7503000995__4707506__c2__174 | 2569 | 6341 | 1314 | 437 | 1156 | 2.4e−117 |

Description
sp:[LN:NRGA__BACSU] [AC:Q07429] [GN:NRGA] [OR:*BACILLUS SUBTILIS*] [DE:PROBABLE
AMMONIUM TRANSPORTER (MEMBRANE PROTEIN NRGA)] [SP:Q07429] [DB:swissprot]
>pir:[LN:A36865] [AC:A36865:D69667] [PN:ammonium transporter nrgA] [GN:nrgA]
[CL:ammonium transporter nrgA] [OR:*Bacillus subtilis*] [DB:pir2]
>gp:[GI:g143264] [LN:BACNRGABO] [AC:L03216] [PN:membrane-associated protein]
[GN:nrgA] [OR:*Bacillus subtilis*] [SR:*Bacillus subtilis* (strain 168) DNA]
[DB:genpept-bct1] [DE:*Bacillus subtilis* operon membrane-associated protein
(nrgA), and PII-like protein (nrgB) genes, complete cds.] [NT:putative]
[LE:126] [RE:1340] [DI:direct] >gp:[GI:e1184557:g2636176] [LN:BSUB0019]
[AC:Z99122:AL009126] [PN:ammonium transporter] [GN:nrgA] [OR:*Bacillus subtilis*] [DB:genpept-bct1] [DE:*Bacillus subtilis* complete genome (section
19 of 21): from 3597091 to 3809700.] [SP:Q07429] [LE:158754] [RE:159968]
[DI:direct] >gp:[GI:e283112:g1684645] [LN:BSZ82987] [AC:Z82987] [PN:unknown]
[GN:nrgA] [OR:*Bacillus subtilis*] [DB:genpept-bct1] [DE:*B. subtilis*
ywo[A,B,C,D,E,F,G,H], nrg[A,B], spoIIID and mb1 genes.] [SP:Q07429]
[LE:1335] [RE:2549] [DI:complement] >gp:[GI:e1184557:g2636176] [LN:BSUB0019]
[AC:Z99122:AL009126] [PN:ammonium transporter] [GN:nrgA] [OR:*Bacillus subtilis*] [DB:genpept] [DE:*Bacillus subtilis* complete genome (section 19 of
21): from 3597091 to 3809700.] [SP:Q07429] [LE:158754] [RE:159968]
[DI:direct]

| ORF Name | NT ID | AA ID | NT LN | AA LN | Score | P-Value |
|---|---|---|---|---|---|---|
| AI7503000995__4958387__c1__132 | 2570 | 6342 | 537 | 178 | 305 | 3.6e−27 |

Description
pir:[LN:D69786] [AC:D69786] [PN:glycoprotein endopeptidase homolog ydiC]
[GN:ydiC] [OR:*Bacillus subtilis*] [DB:pir2] >gp:[GI:e1182571:g2632905]
[LN:BSUB0004] [AC:Z99107:AL009126] [GN:ydiC] [FN:unknown] [OR:*Bacillus subtilis*] [DB:genpept-bct1] [DE:*Bacillus subtilis* complete genome (section 4
of 21): from 600701 to 813890.] [NT:similar to glycoprotein endopeptidase]
[LE:41127] [RE:41816] [DI:direct] >gp:[GI:d1020495:g1945108] [LN:D88802]
[AC:D88802] [GN:ydiC] [OR:*Bacillus subtilis*] [SR:*Bacillus subtilis*
(sub_species:Marburg, strain:168, isolate:JH642)] [DB:genpept-bct1]
[DE:*Bacillus subtilis* DNA for phoB-rrnE-groESL region, complete cds.] [NT:*H. influenzae* hypothetical protein; P43990 (182)] [LE:28129] [RE:28818]
[DI:direct]

| ORF Name | NT ID | AA ID | NT LN | AA LN | Score | P-Value |
|---|---|---|---|---|---|---|
| AI7503000995__5359438__c2__167 | 2571 | 6343 | 1107 | 368 | 1096 | 5.4e−111 |

Description
sp:[LN:YDIE__BACSU] [AC:O05518] [GN:YDIE] [OR:*BACILLUS SUBTILIS*]
[DE:HYPOTHETICAL 36.8 KD PROTEIN IN PHOB-GROES INTERGENIC REGION]
[SP:O05518] [DB:swissprot] >pir:[LN:F69786] [AC:F69786] [PN:glycoprotein
endopeptidase homolog ydiE] [GN:ydiE] [CL:O-sialoglycoprotein
endopeptidase] [OR:*Bacillus subtilis*] [DB:pir2] >gp:[GI:e1182573:g2632907]
[LN:BSUB0004] [AC:Z99107:AL009126] [GN:ydiE] [FN:unknown] [OR:*Bacillus subtilis*] [DB:genpept-bct1] [DE:*Bacillus subtilis* complete genome (section 4
of 21): from 600701 to 813890.] [NT:similar to glycoprotein endopeptidase]
[SP:O05518] [LE:42274] [RE:43314] [DI:direct] >gp:[GI:d1020497:g1945110]
[LN:D88802] [AC:D88802] [GN:ydiE] [OR:*Bacillus subtilis*] [SR:*Bacillus
subtilis* (sub_species:Marburg, strain:168, isolate:JH642)] [DB:genpept-bct1]
[DE:*Bacillus subtilis* DNA for phoB-rrnE-groESL region, complete cds.] [NT:*P. haemolytica* o-sialoglycoprotein endopeptidase;] [LE:29276] [RE:30316]
[DI:direct]

| ORF Name | NT ID | AA ID | NT LN | AA LN | Score | P-Value |
|---|---|---|---|---|---|---|
| AI7503000995__5909428__c3__203 | 2572 | 6344 | 750 | 249 | 582 | 1.6e−56 |

-continued

Description
gp:[GI:d1039124:g4514349] [LN:AB013375] [AC:AB013375] [PN:YdiH] [GN:ydiH]
[OR:*Bacillus halodurans*] [SR:*Bacillus halodurans* (strain:C-125) DNA]
[DB:genpept-bct1] [DE:*Bacillus halodurans* C-125 ydiH, ydiI, ydij, yhcA and
yxaA genes, complete and partial cds.] [LE:235] [RE:870] [DI:direct]

| ORF Name | NT ID | AA ID | NT LN | AA LN | Score | P-Value |
|---|---|---|---|---|---|---|
| AI7503000995_6836010_c2_153 | 2573 | 6345 | 171 | 56 | | |

Description
NO-HIT

| ORF Name | NT ID | AA ID | NT LN | AA LN | Score | P-Value |
|---|---|---|---|---|---|---|
| AI7503000995_860790_f3_101 | 2574 | 6346 | 1593 | 530 | 1391 | 3.0e−142 |

Description
sp:[LN:LEU1_LACLA] [AC:Q02141] [GN:LEUA] [OR:*LACTOCOCCUS LACTIS*]
[SR:,SUBSPLACTIS:*STREPTOCOCCUS LACTIS*] [EC:4.1.3.12] [DE:SYNTHASE)
(ALPHA-IPM SYNTHETASE)] [SP:Q02141] [DB:swissprot] >pir:[LN:S35132]
[AC:S35132:B36889] [PN:2-isopropylmalate synthase,:alpha-isopropylmalate
synthase] [GN:leuA] [CL:2-isopropylmalate synthase leuA] [OR:*Lactococcus
lactis* subsp. *lactis*] [EC:4.1.3.12] [DB:pir2]

| ORF Name | NT ID | AA ID | NT LN | AA LN | Score | P-Value |
|---|---|---|---|---|---|---|
| AI7503000995_9843800_f1_8 | 2575 | 6347 | 192 | 63 | 47 | 0.020 |

Description
gp:[GI:e236301:g1263146] [LN:MTMCECYTB] [AC:Z70776] [PN:cytochrome b]
[OR:Mitochondrion *Mugil cephalus*] [SR:*Mugil cephalus*] [DB:genpept-vrt]
[DE:*M. cephalus* mitochondrial cytochrome b gene.] [LE:<1] [RE:>292]
[DI:direct]

| ORF Name | NT ID | AA ID | NT LN | AA LN | Score | P-Value |
|---|---|---|---|---|---|---|
| AI7503000995_995451_f2_61 | 2576 | 6348 | 1020 | 339 | 1139 | 1.5e−115 |

Description
sp:[LN:ILVC_BACSU] [AC:P37253] [GN:ILVC] [OR:*BACILLUS SUBTILIS*]
[EC:1.1.1.86] [DE:ISOMEROREDUCTASE) (ALPHA-KETO-BETA-HYDROXYLACIL
REDUCTOISOMERASE)] [SP:P37253] [DB:swissprot] >pir:[LN:C69644] [AC:C69644]
[PN:ketol-acid reductoisomerase ilvC] [GN:ilvC] [CL:*Methanococcus*
ketol-acid reductoisomerase: ketol-acid reductoisomerase homology]
[OR:*Bacillus subtilis*] [DB:pir2] >gp:[GI:g143093] [LN:BACILNB] [AC:L03181]
[PN:ketol-acid reductoisomerase] [GN:ilvC] [OR:*Bacillus subtilis*]
[SR:*Bacillus subtilis* DNA] [DB:genpept-bct1] [DE:*Bacillus subtilis* ilvB,
ilvN and ilvC genes, complete ilv-leuoperon.] [LE:2979] [RE:4007]
[DI:direct] >gp:[GI:e1184078:g2635294] [LN:BSUB0015] [AC:Z99118:AL009126]
[PN:ketol-acid reductoisomerase (acetohydroxy-acid)] [GN:ilvC]
[FN:valine/isoleucine biosynthesis] [OR:*Bacillus subtilis*] [DB:genpept-bct1]
[EC:1.1.1.86] [DE:*Bacillus subtilis* complete genome (section 15 of 21): from
2795131 to 3013540.] [SP:P37253] [LE:97651] [RE:98679] [DI:complement]
>gp:[GI:e1165366:g1770068] [LN:BSZ75208] [AC:Z75208] [PN:ketol-acid
reductoisomerase] [GN:ilvC] [OR:*Bacillus subtilis*] [DB:genpept-bct1]
[EC:1.1.1.86] [DE:*B. subtilis* genomic sequence 89009 bp.] [NT:ketol-acid
reductoisomerase (acetohydroxy-acid] [SP:P37253] [LE:71228] [RE:72256]
[DI:direct]

| ORF Name | NT ID | AA ID | NT LN | AA LN | Score | P-Value |
|---|---|---|---|---|---|---|
| AI7503000996_10719452_c3_376 | 2577 | 6349 | 684 | 227 | 371 | 3.6e−34 |

Description
sp:[LN:HLY3_BACSU] [AC:P54175] [GN:YPLQ] [OR:*BACILLUS SUBTILIS*]
[DE:HEMOLYSIN III HOMOLOG] [SP:P54175] [DB:swissprot] >pir:[LN:D69938]
[AC:D69938] [PN:hemolysin III homolog homolog yplQ] [GN:yplQ]
[CL:hemolysin III yplQ] [OR:*Bacillus subtilis*] [DB:pir2] >gp:[GI:g1256643]
[LN:BACYACA] [AC:L77246] [GN:yplQ] [OR:*Bacillus subtilis*] [DB:genpept-bct1]
[DE:*Bacillus subtilis* (YAC10-9 clone) DNA region between the serA and kdg
loci.] [NT:20.2% identity with NADH dehydrogenase of the] [LE:25508]
[RE:26149] [DI:complement] >gp:[GI:e1183626:g2634599] [LN:BSUB0012]
[AC:Z99115:AL009126] [GN:yplQ] [FN:unknown] [OR:*Bacillus subtilis*]
[DB:genpept-bct1] [DE:*Bacillus subtilis* complete genome (section 12 of 21):
from 2195541 to 2409220.] [NT:similar to hemolysin III homolog] [SP:P54175]
[LE:99003] [RE:99644] [DI:direct]

-continued

| ORF Name | NT ID | AA ID | NT LN | AA LN | Score | P-Value |
| --- | --- | --- | --- | --- | --- | --- |
| AI7503000996__10734567__f3__197 | 2578 | 6350 | 249 | 82 | | |

Description
NO-HIT

| ORF Name | NT ID | AA ID | NT LN | AA LN | Score | P-Value |
| --- | --- | --- | --- | --- | --- | --- |
| AI7503000996__10752342__c2__327 | 2579 | 6351 | 981 | 326 | 773 | 9.1e−77 |

Description
pir:[LN:D69812] [AC:D69812] [PN:ferrichrome ABC transporter (permease) homolog yfmE] [GN:yfmE] [CL:vitamin B12 transport protein btuC] [OR:*Bacillus subtilis*] [DB:pir2] >gp:[GI:e1182740:g2633074] [LN:BSUB0005] [AC:Z99108:AL009126] [GN:yfmE] [FN:unknown] [OR:*Bacillus subtilis*] [DB:genpept-bct1] [DE:*Bacillus subtilis* complete genome (section 5 of 21): from 802821 to 1011250.] [NT:similar to ferrichrome ABC transporter (permease)] [LE:20404] [RE:21405] [DI:complement] >gp:[GI:d1023182:g2443248] [LN:D86417] [AC:D86417] [PN:YfmE] [OR:*Bacillus subtilis*] [SR:*Bacillus subtilis* (strain:AC327) DNA] [DB:genpept-bct1] [DE:*Bacillus subtilis* 35.7 kb genomic DNA, 70–73 degree region, complete cds.] [LE:27116] [RE:28117] [DI:direct]

| ORF Name | NT ID | AA ID | NT LN | AA LN | Score | P-Value |
| --- | --- | --- | --- | --- | --- | --- |
| AI7503000996__10759818__c1__271 | 2580 | 6352 | 1008 | 335 | 669 | 9.5e−66 |

Description
pir:[LN:B69812] [AC:B69812] [PN:ferrichrome ABC transporter (binding prote) homolog yfmC] [GN:yfmC] [CL:iron(III) dicitrate transport protein] [OR:*Bacillus subtilis*] [DB:pir2] >gp:[GI:e1182742:g2633076] [LN:BSUB0005] [AC:Z99108:AL009126] [GN:yfmC] [FN:unknown] [OR:*Bacillus subtilis*] [DB:genpept-bct1] [DE:*Bacillus subtilis* complete genome (section 5 of 21): from 802821 to 1011250.] [NT:similar to ferrichrome ABC transporter (binding)] [LE:22475] [RE:23422] [DI:complement] >gp:[GI:d1023180:g2443246] [LN:D86417] [AC:D86417] [PN:YfmC] [OR:*Bacillus subtilis*] [SR:*Bacillus subtilis* (strain:AC327) DNA] [DB:genpept-bct1] [DE:*Bacillus subtilis* 35.7 kb genomic DNA, 70–73 degree region, complete cds.] [LE:25099] [RE:26046] [DI:direct]

| ORF Name | NT ID | AA ID | NT LN | AA LN | Score | P-Value |
| --- | --- | --- | --- | --- | --- | --- |
| AI7503000996__11913877__f1__49 | 2581 | 6353 | 123 | 40 | | |

Description
NO-HIT

| ORF Name | NT ID | AA ID | NT LN | AA LN | Score | P-Value |
| --- | --- | --- | --- | --- | --- | --- |
| AI7503000996__11961568__c2__311 | 2582 | 6354 | 945 | 314 | 1007 | 1.5e−101 |

Description
sp:[LN:LACC__STAAU] [AC:P11099] [GN:LACC] [OR:*STAPHYLOCOCCUS AUREUS*] [EC:2.7.1.144] [DE:TAGATOSE-6-PHOSPHATE KINASE, (PHOSPHOTAGATOKINASE)] [SP:P11099] [DB:swissprot] >pir:[LN:S04358] [AC:S04358] [PN:lacC protein] [GN:lacC] [CL:6-phosphofructokinase 2] [OR:*Staphylococcus aureus*] [DB:pir2] >gp:[GI:g46605] [LN:SALACCD] [AC:X14827] [OR:*Staphylococcus aureus*] [DB:genpept-bct1] [DE:*Staphylococcus aureus* lacC and lacD genes.] [NT:lacC polypeptide (AA 1–310)] [SP:P11099] [LE:55] [RE:987] [DI:direct]

| ORF Name | NT ID | AA ID | NT LN | AA LN | Score | P-Value |
| --- | --- | --- | --- | --- | --- | --- |
| AI7503000996__12578885__f2__109 | 2583 | 6355 | 366 | 121 | | |

Description
NO-HIT

| ORF Name | NT ID | AA ID | NT LN | AA LN | Score | P-Value |
| --- | --- | --- | --- | --- | --- | --- |
| AI7503000996__12603166__f2__89 | 2584 | 6356 | 303 | 100 | 110 | 1.6e−06 |

Description
pir:[LN:G71244] [AC:G71244] [PN:hypothetical protein PH0217] [GN:PH0217] [OR:*Pyrococcus horikoshii*] [DB:pir2] >gp:[GI:d1030229:g3256603] [LN:AP000001] [AC:AP000001:AB009465:AB009464:AB009466:AB009467:AB009468:AB009469] [PN:106aa long hypothetical protein] [GN:PH0217] [OR:*Pyrococcus horikoshii*] [SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:191072]

-continued

[RE:191392] [DI:complement]

| ORF Name | NT ID | AA ID | NT LN | AA LN | Score | P-Value |
|---|---|---|---|---|---|---|
| AI7503000996_1287875_f3_173 | 2585 | 6357 | 123 | 40 | | |

Description
NO-HIT

| ORF Name | NT ID | AA ID | NT LN | AA LN | Score | P-Value |
|---|---|---|---|---|---|---|
| AI7503000996_13680468_c2_336 | 2586 | 6358 | 1080 | 359 | 1133 | 6.4e−115 |

Description
sp:[LN:YBAL_BACSU] [AC:P50863] [GN:YBAL:REC233] [OR:*BACILLUS SUBTILIS*]
[DE:HYPOTHETICAL 38.6 KD PROTEIN IN CWLD-GERD INTERGENIC REGION] [SP:P50863]
[DB:swissprot] >pir:[LN:A69743] [AC:A69743] [PN:ATP-binding Mrp-like
protein homolog ybaL] [GN:ybaL] [CL:conserved probable membrane protein
YIL003w] [OR:*Bacillus subtilis*] [DB:pir2] >gp:[GI:e95614:g1177249]
[LN:BSCWLD] [AC:X74737] [GN:rec233] [OR:*Bacillus subtilis*] [DB:genpept-bct1]
[DE:*B. subtilis* cwlD, rec223 and gerD genes.] [SP:P50863] [LE:1376] [RE:2434]
[DI:direct] >gp:[GI:e1182087:g2632421] [LN:BSUB0001] [AC:Z99104:AL009126]
[GN:ybaL] [FN:unknown] [OR:*Bacillus subtilis*] [DB:genpept-bct1] [DE:*Bacillus
subtilis* complete genome (section 1 of 21): from 1 to 213080.] [NT:alternate
gene name: ybxI; similar to ATP-binding] [LE:157420] [RE:158478] [DI:direct]
>gp:[GI:d1011652:g1644213] [LN:D64126] [AC:D64126] [PN:unknown] [GN:orf14]
[OR:*Bacillus subtilis*] [SR:*Bacillus subtilis* (strain:168) DNA]
[DB:genpept-bct1] [DE:*Bacillus subtilis* genes for ribosomal proteins L13 and
S9, putative cell wall hydrolase CwlD, gerD protein, 16S ribosomal RNA and
23S ribosomal RNA.] [LE:6981] [RE:8039] [DI:direct]

| ORF Name | NT ID | AA ID | NT LN | AA LN | Score | P-Value |
|---|---|---|---|---|---|---|
| AI7503000996_13871068_c1_247 | 2587 | 6359 | 666 | 221 | 893 | 1.7e−89 |

Description
gp:[GI:d1039013:g4512410] [LN:AB017508] [AC:AB017508] [GN:rpsC] [OR:*Bacillus
halodurans*] [SR:*Bacillus halodurans* (strain:C-125) DNA] [DB:genpept-bct1]
[DE:*Bacillus halodurans* C-125 genomic DNA, 32 kb fragment, complete cds.]
[NT:rpsC homologue (identity of 87% to *B. subtilis*)] [LE:16781] [RE:17440]
[DI:direct]

| ORF Name | NT ID | AA ID | NT LN | AA LN | Score | P-Value |
|---|---|---|---|---|---|---|
| AI7503000996_13886593_c2_318 | 2588 | 6360 | 252 | 83 | 96 | 5.0e−05 |

Description
gp:[GI:g727435] [LN:LLU23376] [AC:U23376] [OR:*Lactococcus lactis*]
[DB:genpept-bct1] [DE:*Lactococcus lactis* N5-(1-carboxyethyl)-L-ornithine
synthase (ceo)gene, complete cds.] [NT:putative 6-kDa protein] [LE:165]
[RE:353] [DI:direct]

| ORF Name | NT ID | AA ID | NT LN | AA LN | Score | P-Value |
|---|---|---|---|---|---|---|
| AI7503000996_1408450_f2_158 | 2589 | 6361 | 564 | 187 | 104 | 9.8e−06 |

Description
pir:[LN:E71186] [AC:E71186] [PN:hypothetical protein PH1769] [GN:PH1769]
[OR:*Pyrococcus horikoshii*] [DB:pir2] >gp:[GI:d1031827:g3258201]
[LN:AP000007]
[AC:AP000007:AB009464:AB009465:AB009521:AB009522:AB009523:AB009524]
[PN:100aa long hypothetical protein] [GN:PH1769] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1485001–1738505 nt. position(7/7).] [LE:59186]
[RE:59488] [DI:direct]

| ORF Name | NT ID | AA ID | NT LN | AA LN | Score | P-Value |
|---|---|---|---|---|---|---|
| AI7503000996_1410277_f1_4 | 2590 | 6362 | 153 | 50 | | |

Description
NO-HIT

| ORF Name | NT ID | AA ID | NT LN | AA LN | Score | P-Value |
|---|---|---|---|---|---|---|
| AI7503000996_14277217_c2_297 | 2591 | 6363 | 516 | 171 | 626 | 3.4e−61 |

Description
sp:[LN:RS5_BACSU] [AC:P21467] [GN:RPSE:SPCA] [OR:*BACILLUS SUBTILIS*] [DE:30S -continued RIBOSOMAL PROTEIN S5 (BS5)] [SP:P21467] [DB:swissprot] >pir:[LN:R3BS5S]
[AC:D69699:S12680:S11355] [PN:ribosomal protein S5] [GN:rpsE]
[CL:*Escherichia coli* ribosomal protein S5] [OR:*Bacillus subtilis*] [DB:pir1]
>gp:[GI:g1044981] [LN:BACRPLP] [AC:L47971] [PN:ribosomal protein S5]
[GN:rpsE] [OR:*Bacillus subtilis*] [DB:genpept-bct1] [DE:*Bacillus subtilis*
ribosomal protein (rplPNXEFROQ, rpmCDJ, rpsQNHEMK) genes, integral membrane
protein (secY) gene, adenylatekinase (adk) gene, methionine aminopeptidase
(map) gene, initiation factor 1 (infA) gene, RNA polymerase alpha (rpoA)
gene.] [LE:3585] [RE:4085] [DI:direct] >gp:[GI:e1182066:g2632400]
[LN:BSUB0001] [AC:Z99104:AL009126] [PN:ribosomal protein S5] [GN:rpsE]
[OR:*Bacillus subtilis*] [DB:genpept-bct1] [DE:*Bacillus subtilis* complete
genome (section 1 of 21): from 1 to 213080.] [SP:P21467] [LE:143359]
[RE:143859] [DI:direct]

| ORF Name | NT ID | AA ID | NT LN | AA LN | Score | P-Value |
|---|---|---|---|---|---|---|
| AI7503000996__14312750__c3__354 | 2592 | 6364 | 492 | 163 | 665 | 2.5e−65 |

Description
sp:[LN:RL13_STACA] [AC:Q00990] [GN:RPLM] [OR:*STAPHYLOCOCCUS CARNOSUS*]
[DE:50S RIBOSOMAL PROTEIN L13] [SP:Q00990] [DB:swissprot] >pir:[LN:S23063]
[AC:S23063] [PN:ribosomal protein L13] [GN:rplM] [CL:*Escherichia coli*
ribosomal protein L13] [OR:*Staphylococcus carnosus*] [DB:pir2]
>gp:[GI:g46912] [LN:SCRPLM] [AC:X63912:S79454] [PN:ribosomal protein L13]
[GN:rplM] [OR:*Staphylococcus carnosus*] [DB:genpept-bct1] [DE:*S. carnosus* rplM
gene for ribosomal protein L13.] [SP:Q00990] [LE:309] [RE:746] [DI:direct]

| ORF Name | NT ID | AA ID | NT LN | AA LN | Score | P-Value |
|---|---|---|---|---|---|---|
| AI7503000996__14346067__c2__316 | 2593 | 6365 | 1023 | 340 | 561 | 2.6e−54 |

Description
gp:[GI:g4321580] [LN:AF050114] [AC:AF050114] [PN:alginate lyase]
[OR:*Pseudomonas* sp. W7] [DB:genpept-bct2] [DE:*Pseudomonas* sp. W7 alginate
lyase gene, complete cds.] [LE:1] [RE:1038] [DI:direct]

| ORF Name | NT ID | AA ID | NT LN | AA LN | Score | P-Value |
|---|---|---|---|---|---|---|
| AI7503000996__14531558__f1__53 | 2594 | 6366 | 126 | 41 | | |

Description
NO-HIT

| ORF Name | NT ID | AA ID | NT LN | AA LN | Score | P-Value |
|---|---|---|---|---|---|---|
| AI7503000996__14900826__c3__386 | 2595 | 6367 | 351 | 116 | 188 | 8.9e−15 |

Description
gp:[GI:g208931] [LN:SYNORFLAC] [AC:M15619] [OR:synthetic construct]
[SR:*E. coli* (strain SE5000) synthetic DNA, clone pKB1] [DB:genpept-syn]
[DE:Synthetic *E. coli* ORF16/lacZ fusion protein, partial cds.] [NT:ORF16-lacZ
fusion protein] [LE:29] [RE:>232] [DI:direct]

| ORF Name | NT ID | AA ID | NT LN | AA LN | Score | P-Value |
|---|---|---|---|---|---|---|
| AI7503000996__157750__c3__379 | 2596 | 6368 | 195 | 64 | | |

Description
NO-HIT

| ORF Name | NT ID | AA ID | NT LN | AA LN | Score | P-Value |
|---|---|---|---|---|---|---|
| AI7503000996__15879002__f2__96 | 2597 | 6369 | 123 | 40 | | |

Description
NO-HIT

| ORF Name | NT ID | AA ID | NT LN | AA LN | Score | P-Value |
|---|---|---|---|---|---|---|
| AI7503000996__16829627__c2__300 | 2598 | 6370 | 372 | 123 | 484 | 3.8e−46 |

Description
gp:[GI:g1044989] [LN:BACRPLP] [AC:L47971] [PN:ribosomal protein S13]
[GN:rpsM] [OR:*Bacillus subtilis*] [DB:genpept-bct1] [DE:*Bacillus subtilis*
ribosomal protein (rplPNXEFROQ, rpmCDJ, rpsQNHEMK) genes, integral membrane
protein (secY) gene, adenylatekinase (adk) gene, methionine aminopeptidase
(map) gene, initiation factor 1 (infA) gene, RNA polymerase alpha (rpoA)
gene.] [LE:8197] [RE:8562] [DI:direct]

-continued

| ORF Name | NT ID | AA ID | NT LN | AA LN | Score | P-Value |
|---|---|---|---|---|---|---|
| AI7503000996_16835333_c2_288 | 2599 | 6371 | 840 | 279 | 1198 | 8.3e−122 |

Description
gp:[GI:g1165306] [LN:BSU43929] [AC:U43929] [PN:L2] [GN:rplB] [OR:*Bacillus subtilis*] [DB:genpept-bct2] [DE:*Bacillus subtilis* ribosomal protein gene cluster, rpsJ, rplC, rplD, rplW, rplB, rpsS, rplV and rpsC genes, complete cds, and rplP gene, partial cds.] [NT:ribosomal protein] [LE:2266] [RE:3099] [DI:direct]

| ORF Name | NT ID | AA ID | NT LN | AA LN | Score | P-Value |
|---|---|---|---|---|---|---|
| AI7503000996_197127_f2_121 | 2600 | 6372 | 1965 | 654 | 285 | 9.0e−22 |

Description
sp:[LN:Y4XN_RHISN] [AC:P55706] [GN:Y4XN] [OR:*RHIZOBIUM* SP] [SR:NGR234,] [DE:HYPOTHETICAL 71.0 KD PROTEIN Y4XN] [SP:P55706] [DB:swissprot] >gp:[GI:g2182722] [LN:AE000106] [AC:AE000106:U00090] [PN:Y4xN] [GN:y4xN] [OR:*Rhizobium* sp. NGR234] [DB:genpept-bct2] [DE:*Rhizobium* sp. NGR234 plasmid pNGR234a, section 43 of 46 of the complete plasmid sequence.] [NT:hypothetical 71 kd protein; similar to *Escherichia*] [LE:6573] [RE:8459] [DI:complement]

| ORF Name | NT ID | AA ID | NT LN | AA LN | Score | P-Value |
|---|---|---|---|---|---|---|
| AI7503000996_19730052_c1_278 | 2601 | 6373 | 1479 | 492 | 990 | 9.2e−100 |

Description
pir:[LN:F69763] [AC:F69763] [PN:multidrug resistance protein homolog ycnB] [GN:ycnB] [CL:lincomycin-resistance protein lmrB] [OR:*Bacillus subtilis*] [DB:pir2] >gp:[GI:e1182351:g2632685] [LN:BSUB0003] [AC:Z99106:AL009126] [GN:ycnB] [FN:unknown] [OR:*Bacillus subtilis*] [DB:genpept-bct1] [DE:*Bacillus subtilis* complete genome (section 3 of 21): from 402751 to 611850.] [NT:similar to multidrug resistance protein] [LE:32866] [RE:34284] [DI:complement] >gp:[GI:d1009651:g1805454] [LN:D50453] [AC:D50453] [PN:homologue of multidrug resistance protein B,] [GN:ycnB] [OR:*Bacillus subtilis*] [SR:*Bacillus subtilis* (strain:168 trpC2) DNA] [DB:genpept-bct1] [DE:*Bacillus subtilis* DNA for 25–36 degree region containing the amyE-srfA region, complete cds.] [LE:115269] [RE:116687] [DI:complement]

| ORF Name | NT ID | AA ID | NT LN | AA LN | Score | P-Value |
|---|---|---|---|---|---|---|
| AI7503000996_19822151_c2_302 | 2602 | 6374 | 372 | 123 | 433 | 9.7e−41 |

Description
pir:[LN:F32307] [AC:F32307:C69696] [PN:ribosomal protein L17:ribosomal protein BL15 (rplQ)] [GN:rplQ] [CL:*Escherichia coli* ribosomal protein L17] [OR:*Bacillus subtilis*] [DB:pir2] >gp:[GI:g142464] [LN:BACALPHA] [AC:M26414] [PN:ribosomal protein L17] [GN:rplQ] [OR:*Bacillus subtilis*] [SR:*Bacillus subtilis* DNA] [DB:genpept-bct1] [DE:*B. subtilis* initiation factor 1, ribosomal proteins B, S13, S11, L17 and RNA polymerase alpha core protein genes, complete cds.] [LE:2603] [RE:2965] [DI:direct] >gp:[GI:g1044992] [LN:BACRPLP] [AC:L47971] [PN:ribosomal protein L17] [GN:rplQ] [OR:*Bacillus subtilis*] [DB:genpept-bct1] [DE:*Bacillus subtilis* ribosomal protein (rplPNXEFROQ, rpmCDJ, rpsQNHEMK) genes, integral membrane protein (secY) gene, adenylatekinase (adk) gene, methionine aminopeptidase (map) gene, initiation factor 1 (infA) gene, RNA polymerase alpha (rpoA) gene.] [LE:10177] [RE:10539] [DI:direct] >gp:[GI:e1182077:g2632411] [LN:BSUB0001] [AC:Z99104:AL009126] [PN:ribosomal protein L17 (BL15)] [GN:rplQ] [OR:*Bacillus subtilis*] [DB:genpept-bct1] [DE:*Bacillus subtilis* complete genome (section 1 of 21): from 1 to 213080.] [SP:P20277] [LE:149951] [RE:150313] [DI:direct]

| ORF Name | NT ID | AA ID | NT LN | AA LN | Score | P-Value |
|---|---|---|---|---|---|---|
| AI7503000996_20363762_c3_375 | 2603 | 6375 | 1215 | 404 | 587 | 4.7e−57 |

Description
gp:[GI:g5052662] [LN:AF145686] [AC:AF145686] [PN:BcDNA.LD24639] [GN:BcDNA.LD24639] [OR:*Drosophila melanogaster*] [SR:fruit fly] [DB:genpept-inv2] [DE:*Drosophila melanogaster* clone LD24639 BcDNA.LD24639 (BcDNA.LD24639)mRNA, complete cds.] [LE:199] [RE:1761] [DI:direct]

| ORF Name | NT ID | AA ID | NT LN | AA LN | Score | P-Value |
|---|---|---|---|---|---|---|
| AI7503000996_2125637_f3_165 | 2604 | 6376 | 150 | 49 | | |

-continued

| ORF Name | NT ID | AA ID | NT LN | AA LN | Score | P-Value |
|---|---|---|---|---|---|---|
| AI7503000996_21516287_f1_6 | 2605 | 6377 | 126 | 41 | | |

Description
NO-HIT

| ORF Name | NT ID | AA ID | NT LN | AA LN | Score | P-Value |
|---|---|---|---|---|---|---|
| AI7503000996_21751063_c1_245 | 2606 | 6378 | 579 | 192 | 621 | 1.2e−60 |

Description
sp:[LN:RL3_BACST] [AC:P28600] [GN:RPLC] [OR:*BACILLUS STEAROTHERMOPHILUS*]
[DE:50S RIBOSOMAL PROTEIN L3] [SP:P28600] [DB:swissprot] >pir:[LN:S24363]
[AC:S24363:S36085] [PN:ribosomal protein L3] [GN:rpl3] [CL:*Escherichia
coli* ribosomal protein L3] [OR:*Bacillus stearothermophilus*] [DB:pir2]
>gp:[GI:g40102] [LN:BSRPLCLD] [AC:X67014:S42397] [PN:ribosomal protein L3]
[GN:rp1C] [OR:*Bacillus stearothermophilus*] [DB:genpept-bct1]
[DE:*B. stearothermophilus* genes rplC and rplD for ribosomal proteins L3 and
L4, respectively.] [SP:P28600] [LE:52] [RE:693] [DI:direct]

| ORF Name | NT ID | AA ID | NT LN | AA LN | Score | P-Value |
|---|---|---|---|---|---|---|
| AI7503000996_21915941_c1_250 | 2607 | 6379 | 372 | 123 | 571 | 2.3e−55 |

Description
sp:[LN:RL14_BACSU] [AC:P12875] [GN:RPLN] [OR:*BACILLUS SUBTILIS*] [DE:50S
RIBOSOMAL PROTEIN L14] [SP:P12875] [DB:swissprot] >pir:[LN:R5BS4B]
[AC:S05992:H69695] [PN:ribosomal protein L14] [GN:rplN] [CL:*Escherichia
coli* ribosomal protein L14] [OR:*Bacillus subtilis*] [DB:pir1]
>gp:[GI:g1044974] [LN:BACRPLP] [AC:L47971] [PN:ribosomal protein L14]
[GN:rplN] [OR:*Bacillus subtilis*] [DB:genpept-bct1] [DE:*Bacillus subtilis*
ribosomal protein (rplPNXEFROQ, rpmCDJ, rpsQNHEMK) genes, integral membrane
protein (secY) gene, adenylatekinase (adk) gene, methionine aminopeptidase
(map) gene, initiation factor 1 (infA) gene, RNA polymerase alpha (rpoA)
gene.] [LE:675] [RE:1043] [DI:direct] >gp:[GI:g40150] [LN:BSSPC] [AC:X15664]
[OR:*Bacillus subtilis*] [DB:genpept-bct1] [DE:*B. subtilis* S10/spc operon rpmC,
rpsQ, rplN, rplX, rplE, rpsN genes.] [NT:L14 protein (AA 1–122)] [SP:P12875]
[LE:840] [RE:1208] [DI:direct] >gp:[GI:e1182059:g2632393] [LN:BSUB0001]
[AC:Z99104:AL009126] [PN:ribosomal protein L14] [GN:rplN] [OR:*Bacillus
subtilis*] [DB:genpept-bct1] [DE:*Bacillus subtilis* complete genome (section 1
of 21): from 1 to 213080.] [SP:P12875] [LE:140449] [RE:140817] [DI:direct]

| ORF Name | NT ID | AA ID | NT LN | AA LN | Score | P-Value |
|---|---|---|---|---|---|---|
| AI7503000996_22002318_c3_342 | 2608 | 6380 | 330 | 109 | 390 | 3.5e−36 |

Description
sp:[LN:RL24_BACST] [AC:P04455] [GN:RPLX] [OR:*BACILLUS STEAROTHERMOPHILUS*]
[DE:50S RIBOSOMAL PROTEIN L24] [SP:P04455] [DB:swissprot] >pir:[LN:R5BS24]
[AC:A02819] [PN:ribosomal protein L24] [CL:*Escherichia coli* ribosomal
protein L24] [OR:*Bacillus stearothermophilus*] [DB:pir1]

| ORF Name | NT ID | AA ID | NT LN | AA LN | Score | P-Value |
|---|---|---|---|---|---|---|
| AI7503000996_22455303_f3_190 | 2609 | 6381 | 165 | 54 | | |

Description
NO-HIT

| ORF Name | NT ID | AA ID | NT LN | AA LN | Score | P-Value |
|---|---|---|---|---|---|---|
| AI7503000996_22688428_c3_383 | 2610 | 6382 | 144 | 47 | | |

Description
NO-HIT

| ORF Name | NT ID | AA ID | NT LN | AA LN | Score | P-Value |
|---|---|---|---|---|---|---|
| AI7503000996_22900877_c1_252 | 2611 | 6383 | 132 | 43 | | |

Description
NO-HIT

| ORF Name | NT ID | AA ID | NT LN | AA LN | Score | P-Value |
|---|---|---|---|---|---|---|

-continued

| | | | | | |
|---|---|---|---|---|---|
| AI7503000996__23460931__f2__100 | 2612 | 6384 | 429 | 142 | |

Description
NO-HIT

| ORF Name | NT ID | AA ID | NT LN | AA LN | Score | P-Value |
|---|---|---|---|---|---|---|
| AI7503000996__23572128__c3__346 | 2613 | 6385 | 183 | 60 | 282 | 9.7e−25 |

Description
sp:[LN:RL30__STAAU] [AC:O06444] [GN:RPMD] [OR:*STAPHYLOCOCCUS AUREUS*] [DE:50S RIBOSOMAL PROTEIN L30] [SP:O06444] [DB:swissprot] >gp:[GI:g2078380] [LN:SAU96620] [AC:U96620] [PN:ribosomal protein L30] [GN:L30] [OR:*Staphylococcus aureus*] [DB:genpept-bct1] [DE:*Staphylococcus aureus* NCTC 8325 ribosomal protein L30 (L30),ribosomal protein L15 (L15) and SecY (secY) genes, complete cds.] [LE:65] [RE:244] [DI:direct]

| ORF Name | NT ID | AA ID | NT LN | AA LN | Score | P-Value |
|---|---|---|---|---|---|---|
| AI7503000996__23572180__c3__349 | 2614 | 6386 | 222 | 73 | 326 | 2.1e−29 |

Description
pir:[LN:F69644] [AC:F69644] [PN:translation initiation factor IF-1] [GN:infA] [CL:translation initiation factor IF-1] [OR:*Bacillus subtilis*] [DB:pir2] >gp:[GI:g142459] [LN:BACALPHA] [AC:M26414] [PN:initiation factor 1] [GN:infA] [OR:*Bacillus subtilis*] [SR:*Bacillus subtilis* DNA] [DB:genpept-bct1] [DE:*B. subtilis* initiation factor 1, ribosomal proteins B, S13, S11, L17 and RNA polymerase alpha core protein genes, complete cds.] [LE:235] [RE:453] [DI:direct] >gp:[GI:g1044987] [LN:BACRPLP] [AC:L47971] [PN:initiation factor IF-1] [GN:infA] [OR:*Bacillus subtilis*] [DB:genpept-bct1] [DE:*Bacillus subtilis* ribosomal protein (rplPNXEFROQ, rpmCDJ, rpsQNHEMK) genes, integral membrane protein (secY) gene, adenylatekinase (adk) gene, methionine aminopeptidase (map) gene, initiation factor 1 (infA) gene, RNA polymerase alpha (rpoA) gene.] [LE:7809] [RE:8027] [DI:direct] >gp:[GI:e1182072:g2632406] [LN:BSUB0001] [AC:Z99104:AL009126] [PN:initiation factor IF-I] [GN:infA] [FN:protein synthesis] [OR:*Bacillus subtilis*] [DB:genpept-bct1] [DE:*Bacillus subtilis* complete genome (section 1 of 21): from 1 to 213080.] [SP:P20458] [LE:147583] [RE:147801] [DI:direct]

| ORF Name | NT ID | AA ID | NT LN | AA LN | Score | P-Value |
|---|---|---|---|---|---|---|
| AI7503000996__23573587__c2__294 | 2615 | 6387 | 201 | 66 | 287 | 2.9e−25 |

Description
gp:[GI:d1039020:g4512417] [LN:AB017508] [AC:AB017508] [GN:rpsN] [OR:*Bacillus halodurans*] [SR:*Bacillus halodurans* (strain:C-125) DNA] [DB:genpept-bct1] [DE:*Bacillus halodurans* C-125 genomic DNA, 32 kb fragment, complete cds.] [NT:rpsN homologue (identity of 92% to *B. subtilis*)] [LE:19712] [RE:19897] [DI:direct]

| ORF Name | NT ID | AA ID | NT LN | AA LN | Score | P-Value |
|---|---|---|---|---|---|---|
| AI7503000996__23603450__c2__317 | 2616 | 6388 | 585 | 194 | 85 | 0.0017 |

Description
pir:[LN:S77761] [AC:S77761] [PN:probable phosphotransferase system enzyme II,:protein MC456:protein-Npi-phosphohistidine--sugar phosphotransferase] [OR:*Mycoplasma capricolum*] [EC:2.7.1.69] [DB:pir2]

| ORF Name | NT ID | AA ID | NT LN | AA LN | Score | P-Value |
|---|---|---|---|---|---|---|
| AI7503000996__23632750__c3__365 | 2617 | 6389 | 525 | 174 | 726 | 8.7e−72 |

Description
pir:[LN:JC2527] [AC:JC2527:PC2381] [PN:alkaline shock protein] [GN:asp23] [OR:*Staphylococcus aureus*] [DB:pir2] >gp:[GI:g894289] [LN:S76213] [AC:S76213] [PN:alkaline shock protein 23] [GN:asp23] [OR:*Staphylococcus aureus*] [SR:*Staphylococcus aureus* 912] [DB:genpept-bct1] [DE:asp23 = alkaline shock protein 23 {methicillin resistant} [*Staphylococcus aureus*, 912, Genomic, 1360 nt].] [NT:Method: conceptual translation with partial peptide] [LE:343] [RE:852] [DI:direct]

| ORF Name | NT ID | AA ID | NT LN | AA LN | Score | P-Value |
|---|---|---|---|---|---|---|
| AI7503000996__23634813__c3__355 | 2618 | 6390 | 771 | 256 | 970 | 1.2e−97 |

Description
sp:[LN:LACR__STAAU] [AC:P16644] [GN:LACR] [OR:*STAPHYLOCOCCUS AUREUS*] [DE:LACTOSE PHOSPHOTRANSFERASE SYSTEM REPRESSOR] [SP:P16644] [DB:swissprot]

-continued

>pir:[LN:A44506] [AC:A44506] [PN:lactose operon repressor lacR]
[OR:*Staphylococcus aureus*] [DB:pir2] >gp:[GI:g153035] [LN:STALACR]
[AC:M32103] [PN:lacR repressor] [OR:*Staphylococcus aureus*]
[SR:*Staphylococcus aureus* (strain 8325-4) DNA] [DB:genpept-bct1]
[DE:*Staphylococcus aureus* lac repressor (lacR) gene, complete cds and lacA
repressor (lacA), partial cds.] [LE:1058] [RE:1813] [DI:direct]

| ORF Name | NT ID | AA ID | NT LN | AA LN | Score | P-Value |
| --- | --- | --- | --- | --- | --- | --- |
| AI7503000996__23642761__f1__22 | 2619 | 6391 | 228 | 75 | 80 | 0.0064 |

Description
gp:[GI:d1000903:g220579] [LN:MUSPRIMP] [AC:D00570:J00614] [OR:*Mus musculus*]
[SR:*Mus musculus* male cDNA to mRNA] [DB:genpept-rod] [DE:*Mus musculus* mRNA
for ORFs (putative primordial protein), complete cds.] [NT:open reading frame
(196 AA)] [LE:584] [RE:1174] [DI:direct] >gp:[GI:d1000903:g220579]
[LN:MUSPRIMP] [AC:D00570:J00614] [OR:*Mus musculus*] [SR:*Mus musculus* male
cDNA to mRNA] [DB:genpept] [DE:*Mus musculus* mRNA for ORFs (putative
primordial protein), complete cds.] [NT:open reading frame (196 AA)] [LE:584]
[RE:1174] [DI:direct]

| ORF Name | NT ID | AA ID | NT LN | AA LN | Score | P-Value |
| --- | --- | --- | --- | --- | --- | --- |
| AI7503000996__23683375__c3__356 | 2620 | 6392 | 507 | 168 | 583 | 1.2e−56 |

Description
sp:[LN:LACA_STRMU] [AC:P26423] [GN:LACA] [OR:*STREPTOCOCCUS MUTANS*]
[EC:5.3.1.26] [DE:GALACTOSE-6-PHOSPHATE ISOMERASE LACA SUBUNIT,] [SP:P26423]
[DB:swissprot] >pir:[LN:C43258] [AC:C43258:S27701] [PN:galactoside
O-acetyltransferase,] [GN:lacA] [OR:*Streptococcus mutans*] [EC:2.3.1.18]
[DB:pir2] >gp:[GI:g153673] [LN:STRLACOP] [AC:M80797] [PN:galactosidase
acetyltransferase] [GN:lacA] [OR:*Streptococcus mutans*] [SR:*Streptococcus
mutans* (strain PS14) DNA] [DB:genpept-bct1] [EC:2.3.1.18] [DE:*Streptococcus
mutans* lac operon.] [LE:1534] [RE:1962] [DI:direct]

| ORF Name | NT ID | AA ID | NT LN | AA LN | Score | P-Value |
| --- | --- | --- | --- | --- | --- | --- |
| AI7503000996__2379658__f2__82 | 2621 | 6393 | 225 | 74 | | |

Description
NO-HIT

| ORF Name | NT ID | AA ID | NT LN | AA LN | Score | P-Value |
| --- | --- | --- | --- | --- | --- | --- |
| AI7503000996__23882135__c2__303 | 2622 | 6394 | 873 | 290 | 665 | 2.5e−65 |

Description
sp:[LN:YBXA_BACSU] [AC:P40735] [GN:YBXA] [OR:*BACILLUS SUBTILIS*]
[DE:HYPOTHETICAL ABC TRANSPORTER ATP-BINDING PROTEIN YBXA] [SP:P40735]
[DB:swissprot] >pir:[LN:E69751] [AC:E69751:G32307] [PN:ABC transporter
(ATP-binding protein) homolog ybxA] [GN:ybxA] [CL:ATP-binding cassette
homology] [OR:*Bacillus subtilis*] [DB:pir2] >gp:[GI:e1182078:g2632412]
[LN:BSUB0001] [AC:Z99104:AL009126] [GN:ybxA] [FN:unknown] [OR:*Bacillus
subtilis*] [DB:genpept-bct1] [DE:*Bacillus subtilis* complete genome (section 1
of 21): from 1 to 213080.] [NT:alternate gene name: ybaD; similar to ABC]
[SP:P40735] [LE:150441] [RE:151286] [DI:direct] >gp:[GI:d1011641:g1644202]
[LN:D64126] [AC:D64126] [PN:unknown] [GN:orf4] [OR:*Bacillus subtilis*]
[SR:*Bacillus subtilis* (strain:168) DNA] [DB:genpept-bct1] [DE:*Bacillus
subtilis* genes for ribosomal proteins L13 and S9, putative cell wall
hydrolase CwlD, gerD protein, 16S ribosomal RNA and 23S ribosomal RNA.]
[LE:1] [RE:846] [DI:direct]

| ORF Name | NT ID | AA ID | NT LN | AA LN | Score | P-Value |
| --- | --- | --- | --- | --- | --- | --- |
| AI7503000996__23944052__f1__36 | 2623 | 6395 | 150 | 49 | | |

Description
NO-HIT

| ORF Name | NT ID | AA ID | NT LN | AA LN | Score | P-Value |
| --- | --- | --- | --- | --- | --- | --- |
| AI7503000996__24223787__c1__258 | 2624 | 6396 | 156 | 51 | 221 | 2.8e−18 |

Description
sp:[LN:RPOA_BACSU] [AC:P20429] [GN:RPOA] [OR:*BACILLUS SUBTILIS*] [EC:2.7.7.6]
[DE:ALPHA CHAIN) (RNA POLYMERASE ALPHA SUBUNIT)] [SP:P20429] [DB:swissprot]
>pir:[LN:E32307] [AC:E32307:C24972:E69698] [PN:DNA-directed RNA polymerase,
alpha chain rpoA:transcriptase alpha chain] [GN:rpoA] [CL:DNA-directed RNA
polymerase alpha chain] [OR:*Bacillus subtilis*] [EC:2.7.7.6] [DB:pir2]

-continued

>gp:[GI:g142463] [LN:BACALPHA] [AC:M26414] [PN:RNA polymerase
alpha-core-subunit] [GN:rpoA] [OR:*Bacillus subtilis*] [SR:*Bacillus subtilis*
DNA] [DB:genpept-bct1] [DE:*B. subtilis* initiation factor 1, ribosomal
proteins B, S13, S11, L17 and RNA polymerase alpha core protein genes,
complete cds.] [LE:1581] [RE:2525] [DI:direct] >gp:[GI:g1044991]
[LN:BACRPLP] [AC:L47971] [PN:RNA polymerase alpha-core-subunit] [GN:rpoA]
[OR:*Bacillus subtilis*] [DB:genpept-bct1] [DE:*Bacillus subtilis* ribosomal
protein (rplPNXEFROQ, rpmCDJ, rpsQNHEMK) genes, integral membrane protein
(secY) gene, adenylatekinase (adk) gene, methionine aminopeptidase (map)
gene, initiation factor 1 (infA) gene, RNA polymerase alpha (rpoA) gene.]
[LE:9155] [RE:10099] [DI:direct] >gp:[GI:e1182076:g2632410] [LN:BSUB0001]
[AC:Z99104:AL009126] [PN:RNA polymerase (alpha subunit)] [GN:rpoA]
[OR:*Bacillus subtilis*] [DB:genpept-bct1] [EC:2.7.7.6] [DE:*Bacillus subtilis*
complete genome (section 1 of 21): from 1 to 213080.] [SP:P20429] [LE:148929]
[RE:149873] [DI:direct]

| ORF Name | NT ID | AA ID | NT LN | AA LN | Score | P-Value |
|---|---|---|---|---|---|---|
| AI7503000996_24244012_c3_374 | 2625 | 6397 | 546 | 181 | 280 | 1.6e−24 |

Description
pir:[LN:C70048] [AC:C70048] [PN:conserved hypothetical protein yvsG]
[GN:yvsG] [OR:*Bacillus subtilis*] [DB:pir2] >gp:[GI:e1249789:g2832793]
[LN:BS43KBDNA] [AC:AJ223978] [PN:YvsG protein] [GN:yvsG] [OR:*Bacillus
subtilis*] [DB:genpept-bct1] [DE:*Bacillus subtilis* 42.7 kB DNA fragment from
yvsA to yvqA.] [LE:5971] [RE:6453] [DI:complement]
>gp:[GI:e1186023:g2635848] [LN:BSUB0018] [AC:Z99121:AL009126] [GN:yvsG]
[FN:unknown] [OR:*Bacillus subtilis*] [DB:genpept-bct1] [DE:*Bacillus subtilis*
complete genome (section 18 of 21): from 3399551 to 3609060.] [NT:similar to
hypothetical proteins] [LE:21284] [RE:21766] [DI:direct]

| ORF Name | NT ID | AA ID | NT LN | AA LN | Score | P-Value |
|---|---|---|---|---|---|---|
| AI7503000996_24252318_c1_256 | 2626 | 6398 | 126 | 41 | 191 | 4.3e−15 |

Description
sp:[LN:RL36_BACST] [AC:P07841] [GN:RPMJ] [OR:*BACILLUS STEAROTHERMOPHILUS*]
[DE:(BL38)] [SP:P07841] [DB:swissprot] >pir:[LN:R5BS36] [AC:S08566:S59066]
[PN:ribosomal protein L36:ribosomal protein BL38:ribosomal protein II]
[CL:*Escherichia coli* ribosomal protein L36] [OR:*Bacillus stearothermophilus*]
[DB:pir1]

| ORF Name | NT ID | AA ID | NT LN | AA LN | Score | P-Value |
|---|---|---|---|---|---|---|
| AI7503000996_24328927_f1_39 | 2627 | 6399 | 201 | 66 | | |

Description
NO-HIT

| ORF Name | NT ID | AA ID | NT LN | AA LN | Score | P-Value |
|---|---|---|---|---|---|---|
| AI7503000996_24337750_c2_312 | 2628 | 6400 | 981 | 326 | 1524 | 2.4e−156 |

Description
sp:[LN:LACD_STAAU] [AC:P11100] [GN:LACD] [OR:*STAPHYLOCOCCUS AUREUS*]
[EC:4.1.2.40] [DE:ALDOLASE) (D-TAGATOSE-1,6-BISPHOSPHATE ALDOLASE)]
[SP:P11100] [DB:swissprot] >pir:[LN:S04359] [AC:S04359] [PN:lacD protein]
[GN:lacD] [OR:*Staphylococcus aureus*] [DB:pir2] >gp:[GI:g46606] [LN:SALACCD]
[AC:X14827] [OR:*Staphylococcus aureus*] [DB:genpept-bct1] [DE:*Staphylococcus
aureus* lacC and lacD genes.] [NT:lacD polypeptide (AA 1–326)] [SP:P11100]
[LE:991] [RE:1971] [DI:direct]

| ORF Name | NT ID | AA ID | NT LN | AA LN | Score | P-Value |
|---|---|---|---|---|---|---|
| AI7503000996_24339718_c2_335 | 2629 | 6401 | 483 | 160 | 93 | 0.033 |

Description
gp:[GI:e246715:g1617437] [LN:SGCOM7865] [AC:X98110] [PN:pheromone receptor]
[GN:comD2] [OR:*Streptococcus gordonii*] [DB:genpept-bct1] [DE:*S. gordonii*
tRNA-Arg, comC2, comD2 & comE2 genes.] [NT:histidine kinase] [LE:656]
[RE:2014] [DI:direct]

| ORF Name | NT ID | AA ID | NT LN | AA LN | Score | P-Value |
|---|---|---|---|---|---|---|
| AI7503000996_24350953_f1_10 | 2630 | 6402 | 132 | 43 | 72 | 0.017 |

Description
pir:[LN:G71244] [AC:G71244] [PN:hypothetical protein PH0217] [GN:PH0217]
[OR:*Pyrococcus horikoshii*] [DB:pir2] >gp:[GI:d1030229:g3256603]

-continued

[LN:AP000001]
[AC:AP000001:AB009465:AB009464:AB009466:AB009467:AB009468:AB009469]
[PN:106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1–287000 nt. position (1/7).] [LE:191072]
[RE:191392] [DI:complement]

| ORF Name | NT ID | AA ID | NT LN | AA LN | Score | P-Value |
|---|---|---|---|---|---|---|
| AI7503000996_24397127_c2_313 | 2631 | 6403 | 1776 | 591 | 2460 | 1.5e−255 |

Description
sp:[LN:PTLB_STAAU] [AC:P11162] [GN:LACE] [OR:*STAPHYLOCOCCUS AUREUS*]
[EC:2.7.1.69] [DE:(EC 2.7.1.69) (EII-LAC)] [SP:P11162] [DB:swissprot]
>pir:[LN:B28474] [AC:B28474] [PN:phosphotransferase system enzyme II,,
lactose-specific, factor II] [OR:*Staphylococcus aureus*] [EC:2.7.1.69]
[DB:pir2] >gp:[GI:g153038] [LN:STALACS] [AC:J03479:M17729]
[OR:*Staphylococcus aureus*] [SR:*S. aureus* (strain 8325-4) DNA, clone pFB34]
[DB:genpept-bct1] [DE:*S. aureus* enzyme III-lac (lacF), enzyme II-lac (lacE),
and phospho-beta-galactosidase (lacG) genes, complete cds.] [NT:enzyme II-lac
(lacE)] [LE:413] [RE:2131] [DI:direct]

| ORF Name | NT ID | AA ID | NT LN | AA LN | Score | P-Value |
|---|---|---|---|---|---|---|
| AI7503000996_24402217_c3_350 | 2632 | 6404 | 405 | 134 | 560 | 3.4e−54 |

Description
sp:[LN:RS11_BACSU] [AC:P04969] [GN:RPSK] [OR:*BACILLUS SUBTILIS*] [DE:30S
RIBOSOMAL PROTEIN S11 (BS11)] [SP:P04969] [DB:swissprot] >pir:[LN:R3BSS1]
[AC:D32307:B24972:S11361:B69700] [PN:ribosomal protein S11:ribosomal
protein BS11] [GN:rpsK] [CL:*Escherichia coli* ribosomal protein S11]
[OR:*Bacillus subtilis*] [DB:pir1] >gp:[GI:g142462] [LN:BACALPHA] [AC:M26414]
[PN:ribosomal protein S11] [GN:rpsK] [OR:*Bacillus subtilis*] [SR:*Bacillus subtilis* DNA] [DB:genpept-bct1] [DE:*B. subtilis* initiation factor 1,
ribosomal proteins B, S13, S11, L17 and RNA polymerase alpha core protein
genes, complete cds.] [LE:1009] [RE:1404] [DI:direct] >gp:[GI:g1044990]
[LN:BACRPLP] [AC:L47971] [PN:ribosomal protein S11] [GN:rpsK] [OR:*Bacillus subtilis*] [DB:genpept-bct1] [DE:*Bacillus subtilis* ribosomal protein
(rplPNXEFROQ, rpmCDJ, rpsQNHEMK) genes, integral membrane protein (secY)
gene, adenylatekinase (adk) gene, methionine aminopeptidase (map)
gene, initiation factor 1 (infA) gene, RNA polymerase alpha (rpoA) gene.]
[LE:8583] [RE:8978] [DI:direct] >gp:[GI:g143451] [LN:BACRPOA] [AC:M13957]
[OR:*Bacillus subtilis*] [SR:*B. subtilis* (strain 168 Marburg) DNA clone
lambda-gt11-11-1] [DB:genpept-bct1] [DE:*B. subtilis* DNA sequence of the
rpsM-rpoA interval.] [NT:ribosomal protein S11] [LE:133] [RE:528]
[DI:direct] >gp:[GI:e1182075:g2632409] [LN:BSUB0001] [AC:Z99104:AL009126]
[PN:ribosomal protein S11 (BS11)] [GN:rpsK] [OR:*Bacillus subtilis*]
[DB:genpept-bct1] [DE:*Bacillus subtilis* complete genome (section 1 of 21):
from 1 to 213080.] [SP:P04969] [LE:148357] [RE:148752] [DI:direct]

| ORF Name | NT ID | AA ID | NT LN | AA LN | Score | P-Value |
|---|---|---|---|---|---|---|
| AI7503000996_24641927_c1_273 | 2633 | 6405 | 1380 | 459 | 978 | 1.7e−98 |

Description
sp:[LN:YKAA_BACFI] [AC:P30267] [OR:*BACILLUS FIRMUS*] [DE:HYPOTHETICAL 50.9 KD
PROTEIN IN KATA 3'REGION (ORF A)] [SP:P30267] [DB:swissprot]
>pir:[LN:S27491] [AC:S27491] [PN:hypothetical protein A] [OR:*Bacillus firmus*] [DB:pir2] >gp:[GI:g143121] [LN:BACKATA2] [AC:L02548:M74194]
[OR:*Bacillus firmus*] [SR:*Bacillus firmus* DNA] [DB:genpept-bct1] [DE:*B. firmus*
ORF A and ORF B, complete cds.] [NT:ORF A; putative] [LE:225] [RE:1616]
[DI:direct]

| ORF Name | NT ID | AA ID | NT LN | AA LN | Score | P-Value |
|---|---|---|---|---|---|---|
| AI7503000996_24648312_f1_48 | 2634 | 6406 | 747 | 248 | 905 | 9.3e−91 |

Description
gp:[GI:g845686] [LN:STALACR] [AC:M32103] [OR:*Staphylococcus aureus*]
[SR:*Staphylococcus aureus* (strain 8325-4) DNA] [DB:genpept-bct1]
[DE:*Staphylococcus aureus* lac repressor (lacR) gene, complete cds and lacA
repressor (lacA), partial cds.] [NT:ORF-27] [LE:76] [RE:807] [DI:complement]

| ORF Name | NT ID | AA ID | NT LN | AA LN | Score | P-Value |
|---|---|---|---|---|---|---|
| AI7503000996_24744040_c1_270 | 2635 | 6407 | 1065 | 354 | 361 | 4.1e−33 |

Description
gp:[GI:g4982168] [LN:AE001804] [AC:AE001804:AE000512] [PN:hypothetical -continued protein] [GN:TM1597] [OR:*Thermotoga maritima*] [DB:genpept-bct2]
[DE:*Thermotoga maritima* section 116 of 136 of the complete genome.]
[NT:similar to percent identity: 0.00; identified by] [LE:7299] [RE:8363]
[DI:direct]

| ORF Name | NT ID | AA ID | NT LN | AA LN | Score | P-Value |
|---|---|---|---|---|---|---|
| AI7503000996__24806662__c1__248 | 2636 | 6408 | 237 | 78 | 252 | 1.5e−21 |

Description
sp:[LN:RL29_BACSU] [AC:P12873] [GN:RPMC] [OR:*BACILLUS SUBTILIS*] [DE:50S
RIBOSOMAL PROTEIN L29] [SP:P12873] [DB:swissprot] >pir:[LN:R5BS2L]
[AC:S05990:E69697] [PN:ribosomal protein L29] [GN:rpmC] [CL:*Escherichia
coli* ribosomal protein L29] [OR:*Bacillus subtilis*] [DB:pir1]
>gp:[GI:g1044972] [LN:BACRPLP] [AC:L47971] [PN:ribosomal protein L29]
[GN:rpmC] [OR:*Bacillus subtilis*] [DB:genpept-bct1] [DE:*Bacillus subtilis*
ribosomal protein (rplPNXEFROQ, rpmCDJ, rpsQNHEMK) genes, integral membrane
protein (secY) gene, adenylatekinase (adk) gene, methionine aminopeptidase
(map) gene, initiation factor 1 (infA) gene, RNA polymerase alpha (rpoA)
gene.] [LE:142] [RE:342] [DI:direct] >gp:[GI:g40148] [LN:BSSPC] [AC:X15664]
[OR:*Bacillus subtilis*] [DB:genpept-bct1] [DE:*B. subtilis* S10/spc operon rpmC,
rpsQ, rplN, rplX, rplE, rpsN genes.] [NT:L29 protein (AA 1–66)] [SP:P12873]
[LE:313] [RE:513] [DI:direct] >gp:[GI:e1182057:g2632391] [LN:BSUB0001]
[AC:Z99104:AL009126] [PN:ribosomal protein L29] [GN:rpmC] [OR:*Bacillus
subtilis*] [DB:genpept-bct1] [DE:*Bacillus subtilis* complete genome (section 1
of 21): from 1 to 213080.] [SP:P12873] [LE:139922] [RE:140122] [DI:direct]

| ORF Name | NT ID | AA ID | NT LN | AA LN | Score | P-Value |
|---|---|---|---|---|---|---|
| AI7503000996__24855303__c3__368 | 2637 | 6409 | 1047 | 348 | 784 | 6.2e−78 |

Description
pir:[LN:C69812] [AC:C69812] [PN:ferrichrome ABC transporter (permease)
homolog yfmD] [GN:yfmD] [CL:ferrichrome ABC transporter] [OR:*Bacillus
subtilis*] [DB:pir2] >gp:[GI:e1182741:g2633075] [LN:BSUB0005]
[AC:Z99108:AL009126] [GN:yfmD] [FN:unknown] [OR:*Bacillus subtilis*]
[DB:genpept-bct1] [DE:*Bacillus subtilis* complete genome (section 5 of 21):
from 802821 to 1011250.] [NT:similar to ferrichrome ABC transporter
(permease)] [LE:21402] [RE:22403] [DI:complement] >gp:[GI:d1023181:g2443247]
[LN:D86417] [AC:D86417] [PN:YfmD] [OR:*Bacillus subtilis*] [SR:*Bacillus
subtilis* (strain:AC327) DNA] [DB:genpept-bct1] [DE:*Bacillus subtilis* 35.7 kb
genomic DNA, 70–73 degree region, complete cds.] [LE:26118] [RE:27119]
[DI:direct]

| ORF Name | NT ID | AA ID | NT LN | AA LN | Score | P-Value |
|---|---|---|---|---|---|---|
| AI7503000996__25908568__c1__253 | 2638 | 6410 | 453 | 150 | 706 | 1.1e−69 |

Description
sp:[LN:RL15_STAAU] [AC:O06445] [GN:RPLO] [OR:*STAPHYLOCOCCUS AUREUS*] [DE:50S
RIBOSOMAL PROTEIN L15] [SP:O06445] [DB:swissprot] >gp:[GI:g2078381]
[LN:SAU96620] [AC:U96620] [PN:ribosomal protein L15] [GN:L15]
[OR:*Staphylococcus aureus*] [DB:genpept-bct1] [DE:*Staphylococcus aureus* NCTC
8325 ribosomal protein L30 (L30), ribosomal protein L15 (L15) and SecY (secY)
genes, complete cds.] [LE:261] [RE:701] [DI:direct]

| ORF Name | NT ID | AA ID | NT LN | AA LN | Score | P-Value |
|---|---|---|---|---|---|---|
| AI7503000996__26205151__f2__85 | 2639 | 6411 | 156 | 51 | 123 | 6.9e−08 |

Description
pir:[LN:B71245] [AC:B71245] [PN:hypothetical protein PH0220] [GN:PH0220]
[OR:*Pyrococcus horikoshii*] [DB:pir2] >gp:[GI:d1030232:g3256606]
[LN:AP000001]
[AC:AP000001:AB009465:AB009464:AB009466:AB009467:AB009468:AB009469]
[PN:171aa long hypothetical protein] [GN:PH0220] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1–287000 nt. position (1/7).] [LE:192864]
[RE:193379] [DI:complement]

| ORF Name | NT ID | AA ID | NT LN | AA LN | Score | P-Value |
|---|---|---|---|---|---|---|
| AI7503000996__26360036__c3__345 | 2640 | 6412 | 387 | 128 | 429 | 2.6e−40 |

Description
sp:[LN:RL18_BACSU] [AC:P46899:P70969] [GN:RPLR] [OR:*BACILLUS SUBTILIS*]
[DE:50S RIBOSOMAL PROTEIN L18] [SP:P46899:P70969] [DB:swissprot]
>gp:[GI:g1044980] [LN:BACRPLP] [AC:L47971] [PN:ribosomal protein L18]
[GN:rplR] [OR:*Bacillus subtilis*] [DB:genpept-bct1] [DE:*Bacillus subtilis*

-continued ribosomal protein (rplPNXEFROQ, rpmCDJ, rpsQNHEMK) genes, integral membrane
protein (secY) gene, adenylatekinase (adk) gene, methionine aminopeptidase
(map) gene, initiation factor 1 (infA) gene, RNA polymerase alpha (rpoA)
gene.] [LE:3198] [RE:3560] [DI:direct]

| ORF Name | NT ID | AA ID | NT LN | AA LN | Score | P-Value |
|---|---|---|---|---|---|---|
| AI7503000996__26773450__c1__249 | 2641 | 6413 | 285 | 94 | 380 | 4.0e−35 |

Description
sp:[LN:RS17_BACST] [AC:P23828] [GN:RPSQ] [OR:*BACILLUS STEAROTHERMOPHILUS*]
[DE:30S RIBOSOMAL PROTEIN S17] [SP:P23828] [DB:swissprot] >pir:[LN:S17865]
[AC:S17865:S59056] [PN:ribosomal protein S17] [GN:rps17] [CL:*Escherichia
coli* ribosomal protein S17] [OR:*Bacillus stearothermophilus*] [DB:pir2]

| ORF Name | NT ID | AA ID | NT LN | AA LN | Score | P-Value |
|---|---|---|---|---|---|---|
| AI7503000996__26776678__c2__290 | 2642 | 6414 | 372 | 123 | 431 | 1.6e−40 |

Description
sp:[LN:RL22_BACST] [AC:P23311] [GN:RPLV] [OR:*BACILLUS STEAROTHERMOPHILUS*]
[DE:50S RIBOSOMAL PROTEIN L22] [SP:P23311] [DB:swissprot] >pir:[LN:S10612]
[AC:S10612] [PN:ribosomal protein L22] [CL:*Escherichia coli* ribosomal
protein L22] [OR:*Bacillus stearothermophilus*] [DB:pir2] >gp:[GI:g40107]
[LN:BSRPLS] [AC:X54994] [PN:ribosomal protein L22] [OR:*Bacillus
stearothermophilus*] [DB:genpept-bct1] [DE:*B. stearothermophilus* gene for
ribosomal proteins L2, S19, L22, S3, and L16.] [SP:P23311] [LE:923] [RE:1264]
[DI:direct]

| ORF Name | NT ID | AA ID | NT LN | AA LN | Score | P-Value |
|---|---|---|---|---|---|---|
| AI7503000996__2735801__c1__269 | 2643 | 6415 | 1848 | 615 | 274 | 1.3e−20 |

Description
sp:[LN:Y4XN_RHISN] [AC:P55706] [GN:Y4XN] [OR:*RHIZOBIUM* SP] [SR:NGR234,]
[DE:HYPOTHETICAL 71.0 KD PROTEIN Y4XN] [SP:P55706] [DB:swissprot]
>gp:[GI:g2182722] [LN:AE000106] [AC:AE000106:U00090] [PN:Y4xN] [GN:y4xN]
[OR:*Rhizobium* sp. NGR234] [DB:genpept-bct2] [DE:*Rhizobium* sp. NGR234 plasmid
pNGR234a, section 43 of 46 of the complete plasmid sequence.]
[NT:hypothetical 71 kd protein; similar to *Escherichia*] [LE:6573] [RE:8459]
[DI:complement]

| ORF Name | NT ID | AA ID | NT LN | AA LN | Score | P-Value |
|---|---|---|---|---|---|---|
| AI7503000996__277312__c1__276 | 2644 | 6416 | 1353 | 450 | 452 | 9.4e−43 |

Description
gp:[GI:e1391039:g4467970] [LN:MXEGLBG] [AC:X76640] [PN:hypothetical protein]
[FN:transmembrane protein, putative] [OR:*Myxococcus xanthus*]
[DB:genpept-bct1] [DE:*Myxococcus xanthus* celA gene and ORFX.] [NT:ORFX]
[LE:669] [RE:2192] [DI:direct]

| ORF Name | NT ID | AA ID | NT LN | AA LN | Score | P-Value |
|---|---|---|---|---|---|---|
| AI7503000996__285808__f2__84 | 2645 | 6417 | 225 | 74 | | |

Description
NO-HIT

| ORF Name | NT ID | AA ID | NT LN | AA LN | Score | P-Value |
|---|---|---|---|---|---|---|
| AI7503000996__29314381__f2__151 | 2646 | 6418 | 138 | 45 | 79 | 0.0032 |

Description
pir:[LN:QQECR3] [AC:A04439] [PN:hypothetical protein E-116] [OR:*Escherichia
coli*] [DB:pir1] [MP:72 min]

| ORF Name | NT ID | AA ID | NT LN | AA LN | Score | P-Value |
|---|---|---|---|---|---|---|
| AI7503000996__29328312__c2__289 | 2647 | 6419 | 339 | 112 | 431 | 1.6e−40 |

Description
gp:[GI:g4927744] [LN:AF126059] [AC:AF126059] [PN:RpS19] [GN:rpsS]
[OR:*Streptococcus pneumoniae*] [DB:genpept-bct2] [DE:*Streptococcus pneumoniae*
isolate R6 ribosomal protein operon, partial sequence.] [NT:30S ribosomal
protein S19] [LE:934] [RE:1215] [DI:direct] >gp:[GI:g4927753] [LN:AF126060]
[AC:AF126060] [PN:RpS19] [GN:rpsS] [OR:*Streptococcus pneumoniae*]
[DB:genpept-bct2] [DE:*Streptococcus pneumoniae* isolate ZR1 ribosomal protein
operon, partial sequence.] [NT:30S ribosomal protein S19] [LE:934] [RE:1215]

-continued

[DI:direct] >gp:[GI:g4927762] [LN:AF126061] [AC:AF126061] [PN:RpS19]
[GN:rpsS] [OR:*Streptococcus pneumoniae*] [DB:genpept-bct2] [DE:*Streptococcus pneumoniae* isolate SP#5 ribosomal protein operon, partial sequence.] [NT:30S ribosomal protein S19] [LE:934] [RE:1215] [DI:direct]

| ORF Name | NT ID | AA ID | NT LN | AA LN | Score | P-Value |
|---|---|---|---|---|---|---|
| AI7503000996_29562550_f3_218 | 2648 | 6420 | 156 | 51 | | |

Description
NO-HIT

| ORF Name | NT ID | AA ID | NT LN | AA LN | Score | P-Value |
|---|---|---|---|---|---|---|
| AI7503000996_30742165_c3_347 | 2649 | 6421 | 1323 | 440 | 1919 | 3.3e−198 |

Description
sp:[LN:SECY_STACA] [AC:Q05217] [GN:SECY] [OR:*STAPHYLOCOCCUS CARNOSUS*]
[DE:PREPROTEIN TRANSLOCASE SECY SUBUNIT] [SP:Q05217] [DB:swissprot]
>pir:[LN:S30115] [AC:S30115] [PN:preprotein translocase secY] [GN:secY]
[CL:preprotein translocase secY] [OR:*Staphylococcus carnosus*] [DB:pir2]
>gp:[GI:g49189] [LN:SCSECY] [AC:X70086:S47913:X68981] [GN:secY]
[OR:*Staphylococcus carnosus*] [DB:genpept-bct1] [DE:*S. carnosus* secY gene.]
[SP:Q05217] [LE:223] [RE:1515] [DI:direct]

| ORF Name | NT ID | AA ID | NT LN | AA LN | Score | P-Value |
|---|---|---|---|---|---|---|
| AI7503000996_3131677_f2_99 | 2650 | 6422 | 123 | 40 | | |

Description
NO-HIT

| ORF Name | NT ID | AA ID | NT LN | AA LN | Score | P-Value |
|---|---|---|---|---|---|---|
| AI7503000996_31377318_c1_246 | 2651 | 6423 | 291 | 96 | 297 | 2.5e−26 |

Description
sp:[LN:RL23_BACSU] [AC:P42924] [GN:RPLW] [OR:*BACILLUS SUBTILIS*] [DE:50S
RIBOSOMAL PROTEIN L23] [SP:P42924] [DB:swissprot] >pir:[LN:A69697]
[AC:A69697] [PN:ribosomal protein L23] [GN:rplW] [CL:*Escherichia coli*
ribosomal protein L23] [OR:*Bacillus subtilis*] [DB:pir1]
>gp:[GI:d1009466:g786155] [LN:BACRPL1] [AC:D50302] [PN:Ribosomal Protein
L23] [GN:rplW] [OR:*Bacillus subtilis*] [SR:*Bacillus subtilis* (strain:168)
DNA] [DB:genpept-bct1] [DE:*Bacillus subtilis* genes for ribosomal proteins
L13, L4, L23, L2, S19, L22, S3 and L16, partial and complete cds.] [LE:1140]
[RE:1427] [DI:direct] >gp:[GI:e1182051:g2632385] [LN:BSUB0001]
[AC:Z99104:AL009126] [PN:ribosomal protein L23] [GN:rplW] [OR:*Bacillus subtilis*] [DB:genpept-bct1] [DE:*Bacillus subtilis* complete genome (section 1
of 21): from 1 to 213080.] [SP:P42924] [LE:136990] [RE:137277] [DI:direct]
>gp:[GI:g1165305] [LN:BSU43929] [AC:U43929] [PN:L23] [GN:rplW] [OR:*Bacillus subtilis*] [DB:genpept-bct2] [DE:*Bacillus subtilis* ribosomal protein gene
cluster, rpsJ, rplC, rplD, rplW, rplB, rpsS, rplV and rpsC genes, complete
cds, and rplP gene, partial cds.] [NT:ribosomal protein] [LE:1947] [RE:2234]
[DI:direct]

| ORF Name | NT ID | AA ID | NT LN | AA LN | Score | P-Value |
|---|---|---|---|---|---|---|
| AI7503000996_3304562_c3_359 | 2652 | 6424 | 366 | 121 | 411 | 2.1e−38 |

Description
sp:[LN:PTLA_STAAU] [AC:P02909] [GN:LACF] [OR:*STAPHYLOCOCCUS AUREUS*]
[EC:2.7.1.69] [DE:(EC 2.7.1.69) (EIII-LAC)] [SP:P02909] [DB:swissprot]
>gp:[GI:g153037] [LN:STALACS] [AC:J03479:M17729] [OR:*Staphylococcus aureus*]
[SR:*S. aureus* (strain 8325-4) DNA, clone pFB34] [DB:genpept-bct1]
[DE:*S. aureus* enzyme III-lac (lacF), enzyme II-lac (lacE),
and phospho-beta-galactosidase (lacG) genes, complete cds.] [NT:enzyme
III-lac (lacF)] [LE:102] [RE:413] [DI:direct]

| ORF Name | NT ID | AA ID | NT LN | AA LN | Score | P-Value |
|---|---|---|---|---|---|---|
| AI7503000996_33437802_c2_299 | 2653 | 6425 | 669 | 222 | 772 | 1.2e−76 |

Description
sp:[LN:KAD_BACSU] [AC:P16304] [GN:ADK] [OR:*BACILLUS SUBTILIS*] [EC:2.7.4.3]
[DE:(SUPEROXIDE-INDUCIBLE PROTEIN 16) (SOI16)] [SP:P16304] [DB:swissprot]
>pir:[LN:JS0492] [AC:JS0492:S12684:S08630:E69583] [PN:adenylate
kinase,:ATP-AMP transphosphorylase] [GN:adk] [CL:adenylate kinase]
[OR:*Bacillus subtilis*] [EC:2.7.4.3] [DB:pir2] >gp:[GI:g1044985] [LN:BACRPLP]
[AC:L47971] [PN:adenylate kinase] [GN:adk] [OR:*Bacillus subtilis*]

-continued

[DB:genpept-bct1] [DE:*Bacillus subtilis* ribosomal protein (rplPNXEFROQ, rpmCDJ, rpsQNHEMK) genes, integral membrane protein (secY) gene, adenylatekinase (adk) gene, methionine aminopeptidase (map) gene, initiation factor 1 (infA) gene, RNA polymerase alpha (rpoA) gene.] [LE:6101] [RE:6754] [DI:direct] >gp:[GI:d1000951:g216340] [LN:BACSECY] [AC:D00619] [PN:adenylate kinase] [OR:*Bacillus subtilis*] [SR:*Bacillus subtilis* (strain:207–21) DNA] [DB:genpept-bct1] [DE:*Bacillus subtilis* genes for ribosomal proteins, SecY, adenylatekinase and methionine amino peptidase, complete cds.] [LE:2055] [RE:2708] [DI:direct] >gp:[GI:e1182070:g2632404] [LN:BSUB0001] [AC:Z99104:AL009126] [PN:adenylate kinase] [GN:adk] [OR:*Bacillus subtilis*] [DB:genpept-bct1] [EC:2.7.4.3] [DE:*Bacillus subtilis* complete genome (section 1 of 21): from 1 to 213080.] [SP:P16304] [LE:145875] [RE:146528] [DI:direct]

| ORF Name | NT ID | AA ID | NT LN | AA LN | Score | P-Value |
|---|---|---|---|---|---|---|
| AI7503000996_33463542_c2_337 | 2654 | 6426 | 180 | 59 | | |

Description
NO-HIT

| ORF Name | NT ID | AA ID | NT LN | AA LN | Score | P-Value |
|---|---|---|---|---|---|---|
| AI7503000996_34017517_c2_304 | 2655 | 6427 | 828 | 275 | 714 | 1.6e−70 |

Description
pir:[LN:F69742] [AC:F69742] [PN:hypothetical protein ybaF] [GN:ybaF] [OR:*Bacillus subtilis*] [DB:pir2] >gp:[GI:e1182080:g2632414] [LN:BSUB0001] [AC:Z99104:AL009126] [GN:ybaF] [FN:unknown] [OR:*Bacillus subtilis*] [DB:genpept-bct1] [DE:*Bacillus subtilis* complete genome (section 1 of 21): from 1 to 213080.] [LE:152128] [RE:152925] [DI:direct]

| ORF Name | NT ID | AA ID | NT LN | AA LN | Score | P-Value |
|---|---|---|---|---|---|---|
| AI7503000996_34188213_c2_295 | 2656 | 6428 | 423 | 140 | 579 | 3.3e−56 |

Description
gp:[GI:g1044978] [LN:BACRPLP] [AC:L47971] [PN:ribosomal protein S8] [GN:rpsH] [OR:*Bacillus subtilis*] [DB:genpept-bct1] [DE:*Bacillus subtilis* ribosomal protein (rplPNXEFROQ, rpmCDJ, rpsQNHEMK) genes, integral membrane protein (secY) gene, adenylatekinase (adk) gene, methionine aminopeptidase (map) gene, initiation factor 1 (infA) gene, RNA polymerase alpha (rpoA) gene.] [LE:2198] [RE:2596] [DI:direct]

| ORF Name | NT ID | AA ID | NT LN | AA LN | Score | P-Value |
|---|---|---|---|---|---|---|
| AI7503000996_34406562_c1_259 | 2657 | 6429 | 867 | 288 | 644 | 4.2e−63 |

Description
pir:[LN:E69742] [AC:E69742] [PN:ABC transporter (ATP-binding protein) homolog ybaE] [GN:ybaE] [CL:ATP-binding cassette homology] [OR:*Bacillus subtilis*] [DB:pir2] >gp:[GI:e1182079:g2632413] [LN:BSUB0001] [AC:Z99104:AL009126] [GN:ybaE] [FN:unknown] [OR:*Bacillus subtilis*] [DB:genpept-bct1] [DE:*Bacillus subtilis* complete genome (section 1 of 21): from 1 to 213080.] [NT:similar to ABC transporter (ATP-binding protein)] [LE:151301] [RE:152131] [DI:direct] >gp:[GI:d1011642:g1644203] [LN:D64126] [AC:D64126] [PN:unknown] [GN:orf5] [OR:*Bacillus subtilis*] [SR:*Bacillus subtilis* (strain:168) DNA] [DB:genpept-bct1] [DE:*Bacillus subtilis* genes for ribosomal proteins L13 and S9, putative cell wall hydrolase CwlD, gerD protein, 16S ribosomal RNA and 23S ribosomal RNA.] [LE:861] [RE:1691] [DI:direct]

| ORF Name | NT ID | AA ID | NT LN | AA LN | Score | P-Value |
|---|---|---|---|---|---|---|
| AI7503000996_34557262_c3_384 | 2658 | 6430 | 135 | 44 | | |

Description
NO-HIT

| ORF Name | NT ID | AA ID | NT LN | AA LN | Score | P-Value |
|---|---|---|---|---|---|---|
| AI7503000996_34647177_c2_296 | 2659 | 6431 | 558 | 185 | 638 | 1.8e−62 |

-continued

| Description |
|---|
| gp:[GI:d1039022:g4512419] [LN:AB017508] [AC:AB017508] [GN:rplF] [OR:*Bacillus halodurans*] [SR:*Bacillus halodurans* (strain:C-125) DNA] [DB:genpept-bct1] [DE:*Bacillus halodurans* C-125 genomic DNA, 32 kb fragment, complete cds.] [NT:rplF homologue (identity of 78% to *B. subtilis*)] [LE:20357] [RE:20893] [DI:direct] |

| ORF Name | NT ID | AA ID | NT LN | AA LN | Score | P-Value |
|---|---|---|---|---|---|---|
| AI7503000996_34651577_f2_127 | 2660 | 6432 | 1047 | 348 | 502 | 4.7e−48 |

| Description |
|---|
| pir:[LN:D69756] [AC:D69756] [PN:conserved hypothetical protein yceB] [GN:yceB] [CL:ynbW protein] [OR:*Bacillus subtilis*] [DB:pir2] >gp:[GI:d1023111:g2415739] [LN:AB000617] [AC:AB000617] [PN:YceB] [GN:yceB] [OR:*Bacillus subtilis*] [SR:*Bacillus subtilis* (strain:168 trpC2) DNA] [DB:genpept-bct1] [DE:*Bacillus subtilis* genomic DNA, 22 to 25 degree region, complete cds.] [NT:homologue of a hypothetical 36.6 kDa protein in] [LE:23969] [RE:24910] [DI:complement] >gp:[GI:e1182240:g2632574] [LN:BSUB0002] [AC:Z99105:AL009126] [GN:yceB] [FN:unknown] [OR:*Bacillus subtilis*] [DB:genpept-bct1] [DE:*Bacillus subtilis* complete genome (section 2 of 21): from 194651 to 415810.] [NT:similar to hypothetical proteins] [LE:115784] [RE:116725] [DI:complement] |

| ORF Name | NT ID | AA ID | NT LN | AA LN | Score | P-Value |
|---|---|---|---|---|---|---|
| AI7503000996_35348182_f2_94 | 2661 | 6433 | 231 | 76 | | |

| Description |
|---|
| NO-HIT |

| ORF Name | NT ID | AA ID | NT LN | AA LN | Score | P-Value |
|---|---|---|---|---|---|---|
| AI7503000996_36135437_c2_287 | 2662 | 6434 | 648 | 215 | 676 | 1.7e−66 |

| Description |
|---|
| sp:[LN:RL4_BACST] [AC:P28601] [GN:RPLD] [OR:*BACILLUS STEAROTHERMOPHILUS*] [DE:50S RIBOSOMAL PROTEIN L4] [SP:P28601] [DB:swissprot] >pir:[LN:S24364] [AC:S24364:S36086] [PN:ribosomal protein L4] [GN:rpl4] [CL:*Escherichia coli* ribosomal protein L4] [OR:*Bacillus stearothermophilus*] [DB:pir2] >gp:[GI:g40103] [LN:BSRPLCLD] [AC:X67014:S42397] [PN:ribosomal protein L4] [GN:rp1D] [OR:*Bacillus stearothermophilus*] [DB:genpept-bct1] [DE:*B. stearothermophilus* genes rplC and rplD for ribosomal proteins L3 and L4, respectively.] [SP:P28601] [LE:724] [RE:1347] [DI:direct] |

| ORF Name | NT ID | AA ID | NT LN | AA LN | Score | P-Value |
|---|---|---|---|---|---|---|
| AI7503000996_36226575_c1_251 | 2663 | 6435 | 558 | 185 | 766 | 5.0e−76 |

| Description |
|---|
| sp:[LN:RL5_BACSU] [AC:P12877] [GN:RPLE] [OR:*BACILLUS SUBTILIS*] [DE:50S RIBOSOMAL PROTEIN L5 (BL6)] [SP:P12877] [DB:swissprot] >pir:[LN:R5BS5] [AC:S05994:A69695] [PN:ribosomal protein L5:BL6] [GN:rplE] [CL:*Escherichia coli* ribosomal protein L5] [OR:*Bacillus subtilis*] [DB:pir1] >gp:[GI:g1044976] [LN:BACRPLP] [AC:L47971] [PN:ribosomal protein L5] [GN:rplE] [OR:*Bacillus subtilis*] [DB:genpept-bct1] [DE:*Bacillus subtilis* ribosomal protein (rplPNXEFROQ, rpmCDJ, rpsQNHEMK) genes, integral membrane protein (secY) gene, adenylatekinase (adk) gene, methionine aminopeptidase (map) gene, initiation factor 1 (infA) gene, RNA polymerase alpha (rpoA) gene.] [LE:1419] [RE:1958] [DI:direct] >gp:[GI:g40152] [LN:BSSPC] [AC:X15664] [OR:*Bacillus subtilis*] [DB:genpept-bct1] [DE:*B. subtilis* S10/spc operon rpmC, rpsQ, rplN, rplX, rplE, rpsN genes.] [NT:L5 protein (AA 1–179)] [SP:P12877] [LE:1584] [RE:2123] [DI:direct] >gp:[GI:e1182061:g2632395] [LN:BSUB0001] [AC:Z99104:AL009126] [PN:ribosomal protein L5 (BL6)] [GN:rplE] [OR:*Bacillus subtilis*] [DB:genpept-bct1] [DE:*Bacillus subtilis* complete genome (section 1 of 21): from 1 to 213080.] [SP:P12877] [LE:141193] [RE:141732] [DI:direct] |

| ORF Name | NT ID | AA ID | NT LN | AA LN | Score | P-Value |
|---|---|---|---|---|---|---|
| AI7503000996_4062510_f3_217 | 2664 | 6436 | 168 | 55 | | |

| Description |
|---|
| NO-HIT |

| ORF Name | NT ID | AA ID | NT LN | AA LN | Score | P-Value |
|---|---|---|---|---|---|---|
| AI7503000996_4100327_f3_181 | 2665 | 6437 | 360 | 119 | 133 | 6.0e−09 |

-continued

| Description |
|---|
| pir:[LN:D69798] [AC:D69798] [PN:hypothetical protein yetG] [GN:yetG] [OR:*Bacillus subtilis*] [DB:pir2] >gp:[GI:e1182694:g2633028] [LN:BSUB0004] [AC:Z99107:AL009126] [GN:yetG] [FN:unknown] [OR:*Bacillus subtilis*] [DB:genpept-bct1] [DE:*Bacillus subtilis* complete genome (section 4 of 21): from 600701 to 813890.] [LE:183921] [RE:184298] [DI:complement] |

| ORF Name | NT ID | AA ID | NT LN | AA LN | Score | P-Value |
|---|---|---|---|---|---|---|
| AI7503000996_4165677_c2_305 | 2666 | 6438 | 807 | 268 | 544 | 1.7e−52 |

| Description |
|---|
| sp:[LN:TRUA_BACSU] [AC:P70973] [GN:TRUA] [OR:*BACILLUS SUBTILIS*] [EC:4.2.1.70] [DE:I) (PSEUDOURIDINE SYNTHASE I) (URACIL HYDROLYASE)] [SP:P70973] [DB:swissprot] >pir:[LN:F69726] [AC:F69726] [PN:pseudouridylate synthase I truA] [GN:truA] [CL:tRNA-pseudouridine synthase I] [OR:*Bacillus subtilis*] [DB:pir2] >gp:[GI:e1182081:g2632415] [LN:BSUB0001] [AC:Z99104:AL009126] [PN:pseudouridylate synthase I] [GN:truA] [OR:*Bacillus subtilis*] [DB:genpept-bct1] [EC:4.2.1.70] [DE:*Bacillus subtilis* complete genome (section 1 of 21): from 1 to 213080.] [NT:alternate gene name: ybaH] [SP:P70973] [LE:152935] [RE:153678] [DI:direct] >gp:[GI:d1011645:g1644206] [LN:D64126] [AC:D64126] [PN:unknown] [GN:orf8] [OR:*Bacillus subtilis*] [SR:*Bacillus subtilis* (strain:168) DNA] [DB:genpept-bct1] [DE:*Bacillus subtilis* genes for ribosomal proteins L13 and S9, putative cell wall hydrolase CwlD, gerD protein, 16S ribosomal RNA and 23S ribosomal RNA.] [LE:2496] [RE:3239] [DI:direct] |

| ORF Name | NT ID | AA ID | NT LN | AA LN | Score | P-Value |
|---|---|---|---|---|---|---|
| AI7503000996_4305287_f3_211 | 2667 | 6439 | 123 | 40 | | |

| Description |
|---|
| NO-HIT |

| ORF Name | NT ID | AA ID | NT LN | AA LN | Score | P-Value |
|---|---|---|---|---|---|---|
| AI7503000996_4564036_c3_363 | 2668 | 6440 | 1044 | 347 | 898 | 5.2e−90 |

| Description |
|---|
| pir:[LN:A69813] [AC:A69813] [PN:quinone oxidoreductase homolog yfmJ] [GN:yfmJ] [OR:*Bacillus subtilis*] [DB:pir2] >gp:[GI:e1182735:g2633069] [LN:BSUB0005] [AC:Z99108:AL009126] [GN:yfmJ] [FN:unknown] [OR:*Bacillus subtilis*] [DB:genpept-bct1] [DE:*Bacillus subtilis* complete genome (section 5 of 21): from 802821 to 1011250.] [NT:similar to quinone oxidoreductase] [LE:14498] [RE:15517] [DI:complement] >gp:[GI:d1023187:g2443253] [LN:D86417] [AC:D86417] [PN:YfmJ] [OR:*Bacillus subtilis*] [SR:*Bacillus subtilis* (strain:AC327) DNA] [DB:genpept-bct1] [DE:*Bacillus subtilis* 35.7 kb genomic DNA, 70–73 degree region, complete cds.] [LE:33004] [RE:34023] [DI:direct] |

| ORF Name | NT ID | AA ID | NT LN | AA LN | Score | P-Value |
|---|---|---|---|---|---|---|
| AI7503000996_4694030_c3_367 | 2669 | 6441 | 1236 | 411 | 362 | 3.2e−33 |

| Description |
|---|
| gp:[GI:g5354197] [LN:AF157493] [AC:AF157493] [PN:putative transporter] [GN:ditE] [OR:*Zymomonas mobilis*] [DB:genpept] [DE:*Zymomonas mobilis* ZM4 fosmid clone 42D7, complete sequence.] [LE:17549] [RE:18844] [DI:direct] |

| ORF Name | NT ID | AA ID | NT LN | AA LN | Score | P-Value |
|---|---|---|---|---|---|---|
| AI7503000996_4697262_c2_310 | 2670 | 6442 | 540 | 179 | 806 | 2.9e−80 |

| Description |
|---|
| pir:[LN:D43258] [AC:D43258] [PN:galactose-6-phosphate isomerase subunit LacB] [OR:*Streptococcus mutans*] [DB:pir2] |

| ORF Name | NT ID | AA ID | NT LN | AA LN | Score | P-Value |
|---|---|---|---|---|---|---|
| AI7503000996_4714817_c2_315 | 2671 | 6443 | 879 | 292 | 200 | 1.0e−14 |

| Description |
|---|
| gp:[GI:g4206189] [LN:LLU60828] [AC:U60828] [PN:unknown] [OR:*Lactococcus lactis*] [DB:genpept-bct2] [DE:*Lactococcus lactis* galactose-lactose operon, complete sequence.] [NT:orfx] [LE:12631] [RE:13554] [DI:direct] |

| ORF Name | NT ID | AA ID | NT LN | AA LN | Score | P-Value |
|---|---|---|---|---|---|---|
| AI7503000996_4886592_c3_341 | 2672 | 6444 | 450 | 149 | 614 | 6.4e−60 |

-continued

| Description |
|---|
| sp:[LN:RL16_BACSU] [AC:P14577] [GN:RPLP] [OR:*BACILLUS SUBTILIS*] [DE:50S RIBOSOMAL PROTEIN L16] [SP:P14577] [DB:swissprot] >pir:[LN:B69696] [AC:B69696:S05989] [PN:ribosomal protein L16 (rplP)] [GN:rplP] [CL:*Escherichia coli* ribosomal protein L16] [OR:*Bacillus subtilis*] [DB:pir2] >gp:[GI:e1182056:g2632390] [LN:BSUB0001] [AC:Z99104:AL009126] [PN:ribosomal protein L16] [GN:rplP] [OR:*Bacillus subtilis*] [DB:genpept-bct1] [DE:*Bacillus subtilis* complete genome (section 1 of 21): from 1 to 213080.] [LE:139498] [RE:139932] [DI:direct] |

| ORF Name | NT ID | AA ID | NT LN | AA LN | Score | P-Value |
|---|---|---|---|---|---|---|
| AI7503000996_4897202_c1_257 | 2673 | 6445 | 768 | 255 | 996 | 2.1e−100 |

| Description |
|---|
| sp:[LN:RPOA_BACS5] [AC:O50634] [GN:RPOA] [OR:*BACILLUS* SP] [SR:C-125,] [EC:2.7.7.6] [DE:ALPHA CHAIN) (RNA POLYMERASE ALPHA SUBUNIT)] [SP:O50634] [DB:swissprot] >gp:[GI:d1025104:g2760185] [LN:AB010082] [AC:AB010082] [PN:RNA polymerase alpha subunit] [GN:rpoA] [OR:*Bacillus halodurans*] [SR:*Bacillus halodurans* (strain:C-125) DNA] [DB:genpept-bct1] [DE:*Bacillus halodurans* C-125 gene for initiation factor IF-I, RNA polymerase alpha subunit and ribosomal proteins, partial and complete cds.] [LE:1701] [RE:2645] [DI:direct] >gp:[GI:d1039034:g4512431] [LN:AB017508] [AC:AB017508] [GN:rpoA] [OR:*Bacillus halodurans*] [SR:*Bacillus halodurans* (strain:C-125) DNA] [DB:genpept-bct1] [DE:*Bacillus halodurans* C-125 genomic DNA, 32 kb fragment, complete cds.] [NT:rpoA homologue (identity of 85% to *B. subtilis*)] [LE:26934] [RE:27878] [DI:direct] |

| ORF Name | NT ID | AA ID | NT LN | AA LN | Score | P-Value |
|---|---|---|---|---|---|---|
| AI7503000996_4897253_f3_189 | 2674 | 6446 | 129 | 42 | | |

| Description |
|---|
| NO-HIT |

| ORF Name | NT ID | AA ID | NT LN | AA LN | Score | P-Value |
|---|---|---|---|---|---|---|
| AI7503000996_4901712_c1_261 | 2675 | 6447 | 408 | 135 | 496 | 2.0e−47 |

| Description |
|---|
| pir:[LN:H69699] [AC:H69699:S11359] [PN:ribosomal protein S9 (rpsI):ribosomal protein BS10] [GN:rpsI] [CL:*Escherichia coli* ribosomal protein S9] [OR:*Bacillus subtilis*] [DB:pir2] >gp:[GI:e1182083:g2632417] [LN:BSUB0001] [AC:Z99104:AL009126] [PN:ribosomal protein S9] [GN:rpsI] [OR:*Bacillus subtilis*] [DB:genpept-bct1] [DE:*Bacillus subtilis* complete genome (section 1 of 21): from 1 to 213080.] [SP:P21470] [LE:154299] [RE:154691] [DI:direct] >gp:[GI:d1011647:g1644208] [LN:D64126] [AC:D64126] [PN:ribosomal protein S9] [GN:rpsI] [OR:*Bacillus subtilis*] [SR:*Bacillus subtilis* (strain:168) DNA] [DB:genpept-bct1] [DE:*Bacillus subtilis* genes for ribosomal proteins L13 and S9, putative cell wall hydrolase CwlD, gerD protein, 16S ribosomal RNA and 23S ribosomal RNA.] [LE:3860] [RE:4252] [DI:direct] |

| ORF Name | NT ID | AA ID | NT LN | AA LN | Score | P-Value |
|---|---|---|---|---|---|---|
| AI7503000996_5110637_c2_306 | 2676 | 6448 | 129 | 42 | | |

| Description |
|---|
| NO-HIT |

| ORF Name | NT ID | AA ID | NT LN | AA LN | Score | P-Value |
|---|---|---|---|---|---|---|
| AI7503000996_5189012_f1_55 | 2677 | 6449 | 168 | 55 | | |

| Description |
|---|
| NO-HIT |

| ORF Name | NT ID | AA ID | NT LN | AA LN | Score | P-Value |
|---|---|---|---|---|---|---|
| AI7503000996_55437_c2_314 | 2678 | 6450 | 1428 | 475 | 2439 | 2.6e−253 |

| Description |
|---|
| sp:[LN:LACG_STAAU] [AC:P11175] [GN:LACG] [OR:*STAPHYLOCOCCUS AUREUS*] [EC:3.2.1.85] [DE:GALACTOHYDROLASE) (PGALASE) (P-BETA-GAL) (PBG)] [SP:P11175] [DB:swissprot] >pir:[LN:A27233] [AC:A27233] [PN:beta-galactosidase,:lactase] [CL:Agrobacterium beta-glucosidase] [OR:*Staphylococcus aureus*] [EC:3.2.1.23] [DB:pir2] >gp:[GI:g153039] [LN:STALACS] [AC:J03479:M17729] [OR:*Staphylococcus aureus*] [SR:*S. aureus* (strain 8325-4) DNA, clone pFB34] [DB:genpept-bct1] [DE:*S. aureus* enzyme |

-continued

III-lac (lacF), enzyme II-lac (lacE), and phospho-beta-galactosidase (lacG) genes, complete cds.] [NT:phospho-beta-galactosidase (lacG)] [LE:2149] [RE:3561] [DI:direct]

| ORF Name | NT ID | AA ID | NT LN | AA LN | Score | P-Value |
|---|---|---|---|---|---|---|
| AI7503000996_6854675_f1_20 | 2679 | 6451 | 279 | 92 | 119 | 1.8e−07 |

Description
pir:[LN:A69895] [AC:A69895] [PN:hypothetical protein ynzG] [GN:ynzG] [CL:hypothetical protein yolF] [OR:*Bacillus subtilis*] [DB:pir2] >gp:[GI:e1183408:g2634133] [LN:BSUB0010] [AC:Z99113:AL009126] [GN:ynzG] [FN:unknown] [OR:*Bacillus subtilis*] [DB:genpept-bct1] [DE:*Bacillus subtilis* complete genome (section 10 of 21): from 1781201 to 2014980.] [LE:99142] [RE:99393] [DI:direct]

| ORF Name | NT ID | AA ID | NT LN | AA LN | Score | P-Value |
|---|---|---|---|---|---|---|
| AI7503000996_797308_f2_112 | 2680 | 6452 | 189 | 62 | | |

Description
NO-HIT

| ORF Name | NT ID | AA ID | NT LN | AA LN | Score | P-Value |
|---|---|---|---|---|---|---|
| AI7503000996_812840_c1_260 | 2681 | 6453 | 144 | 47 | | |

Description
NO-HIT

| ORF Name | NT ID | AA ID | NT LN | AA LN | Score | P-Value |
|---|---|---|---|---|---|---|
| AI7503000996_9771907_c2_334 | 2682 | 6454 | 165 | 54 | | |

Description
NO-HIT

| ORF Name | NT ID | AA ID | NT LN | AA LN | Score | P-Value |
|---|---|---|---|---|---|---|
| AI7503000997_10406642_f1_38 | 2683 | 6455 | 342 | 113 | 165 | 2.8e−12 |

Description
sp:[LN:NARQ_BACSU] [AC:P39756] [GN:NARQ:NARAA] [OR:*BACILLUS SUBTILIS*] [DE:NARQ PROTEIN] [SP:P39756] [DB:swissprot] >pir:[LN:B69665] [AC:B69665] [PN:required for formate dehydrogenase activity narQ] [GN:narQ] [OR:*Bacillus subtilis*] [DB:pir2] >gp:[GI:e276834:g1648855] [LN:BSATPC] [AC:Z81356] [PN:unknown] [GN:narQ] [OR:*Bacillus subtilis*] [DB:genpept-bct1] [DE:*B. subtilis* atpC gene.] [SP:P39756] [LE:7048] [RE:7836] [DI:direct] >gp:[GI:g580895] [LN:BSNARAAB] [AC:Z35277] [PN:unknown] [GN:narAA] [OR:*Bacillus subtilis*] [DB:genpept-bct1] [DE:*B. subtilis* (168) narA gene.] [SP:P39756] [LE:490] [RE:1278] [DI:direct] >gp:[GI:e1184577:g2636196] [LN:BSUB0019] [AC:Z99122:AL009126] [GN:narQ] [FN:required for formate dehydrogenase activity] [OR:*Bacillus subtilis*] [DB:genpept-bct1] [DE:*Bacillus subtilis* complete genome (section 19 of 21): from 3597091 to 3809700.] [NT:alternate gene name: narAA] [SP:P39756] [LE:175331] [RE:176119] [DI:complement] >gp:[GI:e1184577:g2636196] [LN:BSUB0019] [AC:Z99122:AL009126] [GN:narQ] [FN:required for formate dehydrogenase activity] [OR:*Bacillus subtilis*] [DB:genpept] [DE:*Bacillus subtilis* complete genome (section 19 of 21): from 3597091 to 3809700.] [NT:alternate gene name: narAA] [SP:P39756] [LE:175331] [RE:176119] [DI:complement]

| ORF Name | NT ID | AA ID | NT LN | AA LN | Score | P-Value |
|---|---|---|---|---|---|---|
| AI7503000997_1054640_f3_189 | 2684 | 6456 | 213 | 70 | 170 | 7.2e−13 |

Description
sp:[LN:NARQ_BACSU] [AC:P39756] [GN:NARQ:NARAA] [OR:*BACILLUS SUBTILIS*] [DE:NARQ PROTEIN] [SP:P39756] [DB:swissprot] >pir:[LN:B69665] [AC:B69665] [PN:required for formate dehydrogenase activity narQ] [GN:narQ] [OR:*Bacillus subtilis*] [DB:pir2] >gp:[GI:e276834:g1648855] [LN:BSATPC] [AC:Z81356] [PN:unknown] [GN:narQ] [OR:*Bacillus subtilis*] [DB:genpept-bct1] [DE:*B. subtilis* atpC gene.] [SP:P39756] [LE:7048] [RE:7836] [DI:direct] >gp:[GI:g580895] [LN:BSNARAAB] [AC:Z35277] [PN:unknown] [GN:narAA] [OR:*Bacillus subtilis*] [DB:genpept-bct1] [DE:*B. subtilis* (168) narA gene.] [SP:P39756] [LE:490] [RE:1278] [DI:direct] >gp:[GI:e1184577:g2636196] [LN:BSUB0019] [AC:Z99122:AL009126] [GN:narQ] [FN:required for formate dehydrogenase activity] [OR:*Bacillus subtilis*] [DB:genpept-bct1] [DE:*Bacillus subtilis* complete genome (section 19 of 21): from 3597091 to 3809700.] [NT:alternate gene name: narAA] [SP:P39756] [LE:175331]

-continued

[RE:176119] [DI:complement] >gp:[GI:e1184577:g2636196] [LN:BSUB0019]
[AC:Z99122:AL009126] [GN:narQ] [FN:required for formate dehydrogenase
activity] [OR:*Bacillus subtilis*] [DB:genpept] [DE:*Bacillus subtilis* complete
genome (section 19 of 21): from 3597091 to 3809700.] [NT:alternate gene name:
narAA] [SP:P39756] [LE:175331] [RE:176119] [DI:complement]

| ORF Name | NT ID | AA ID | NT LN | AA LN | Score | P-Value |
|---|---|---|---|---|---|---|
| AI7503000997_10580182_f1_9 | 2685 | 6457 | 123 | 40 | | |

Description
NO-HIT

| ORF Name | NT ID | AA ID | NT LN | AA LN | Score | P-Value |
|---|---|---|---|---|---|---|
| AI7503000997_10646887_f1_25 | 2686 | 6458 | 126 | 41 | | |

Description
NO-HIT

| ORF Name | NT ID | AA ID | NT LN | AA LN | Score | P-Value |
|---|---|---|---|---|---|---|
| AI7503000997_11756250_f3_197 | 2687 | 6459 | 144 | 47 | | |

Description
NO-HIT

| ORF Name | NT ID | AA ID | NT LN | AA LN | Score | P-Value |
|---|---|---|---|---|---|---|
| AI7503000997_11767205_f3_213 | 2688 | 6460 | 126 | 41 | | |

Description
NO-HIT

| ORF Name | NT ID | AA ID | NT LN | AA LN | Score | P-Value |
|---|---|---|---|---|---|---|
| AI7503000997_1209800_c2_304 | 2689 | 6461 | 282 | 93 | 72 | 0.0011 |

Description
sp:[LN:LACF_AGRRD] [AC:P29823] [GN:LACF] [OR:*AGROBACTERIUM RADIOBACTER*]
[DE:LACTOSE TRANSPORT SYSTEM PERMEASE PROTEIN LACF] [SP:P29823]
[DB:swissprot] >pir:[LN:MMAGCF] [AC:S25248:S22740] [PN:membrane protein
lacF] [GN:lacF] [CL:inner membrane protein ugpA] [OR:*Agrobacterium
radiobacter*] [DB:pir1] >gp:[GI:g38969] [LN:ARLACOP]
[AC:X66596:S40378:S40757] [GN:lacF] [OR:*Agrobacterium radiobacter*]
[DB:genpept-bct1] [DE:*A. radiobacter* lac operon.] [SP:P29823] [LE:1897]
[RE:2793] [DI:direct]

| ORF Name | NT ID | AA ID | NT LN | AA LN | Score | P-Value |
|---|---|---|---|---|---|---|
| AI7503000997_12270176_c2_349 | 2690 | 6462 | 180 | 59 | | |

Description
NO-HIT

| ORF Name | NT ID | AA ID | NT LN | AA LN | Score | P-Value |
|---|---|---|---|---|---|---|
| AI7503000997_12595175_f2_140 | 2691 | 6463 | 498 | 165 | 261 | 1.6e−22 |

Description
sp:[LN:YKKC_BACSU] [AC:P49856] [GN:YKKC] [OR:*BACILLUS SUBTILIS*]
[DE:HYPOTHETICAL 11.9 KD PROTEIN IN HMP 3'REGION] [SP:P49856] [DB:swissprot]
>pir:[LN:A69857] [AC:A69857] [PN:chaperonin homolog ykkC] [GN:ykkC]
[CL:sugE protein] [OR:*Bacillus subtilis*] [DB:pir2]
>gp:[GI:d1011924:g1063251] [LN:BAC168TRP2] [AC:D78189] [OR:*Bacillus
subtilis*] [SR:*Bacillus subtilis* (strain:168trpC2) DNA] [DB:genpept-bct1]
[DE:*Bacillus subtilis* hmp DNA for 7 ORFs, complete cds.] [NT:unnamed protein
product] [LE:4724] [RE:5062] [DI:direct] >gp:[GI:e1181509:g2632029]
[LN:BSAJ2571] [AC:AJ002571] [PN:YkkC] [GN:ykkC] [FN:unknown] [OR:*Bacillus
subtilis*] [DB:genpept-bct1] [DE:*Bacillus subtilis* 168 56 kb DNA fragment
between xlyA and ykoR.] [SP:P49856] [LE:28642] [RE:28980] [DI:direct]
>gp:[GI:e1183329:g2633663] [LN:BSUB0007] [AC:Z99110:AL009126] [GN:ykkC]
[FN:unknown] [OR:*Bacillus subtilis*] [DB:genpept-bct1] [DE:*Bacillus subtilis*
complete genome (section 7 of 21): from 1194391 to 1411140.] [NT:similar to
chaperonin] [SP:P49856] [LE:181591] [RE:181929] [DI:direct]

-continued

| ORF Name | NT ID | AA ID | NT LN | AA LN | Score | P-Value |
|---|---|---|---|---|---|---|
| AI7503000997_1375308_c2_341 | 2692 | 6464 | 411 | 136 | 103 | 9.0e−06 |

Description
gp:[GI:g3283053] [LN:AF054173] [AC:AF054173] [PN:staphylococcal accessory
regulator A homolog] [GN:sarA] [OR:*Staphylococcus epidermidis*]
[DB:genpept-bct2] [DE:*Staphylococcus epidermidis* staphylococcal accessory
regulator A homolog (sarA) gene, complete cds.] [LE:887] [RE:1261]
[DI:direct]

| ORF Name | NT ID | AA ID | NT LN | AA LN | Score | P-Value |
|---|---|---|---|---|---|---|
| AI7503000997_13849056_c1_251 | 2693 | 6465 | 279 | 92 | 79 | 0.041 |

Description
gp:[GI:e1313955:g3392923] [LN:LLNISG] [AC:AJ000993] [PN:hypothetical
protein] [GN:orfD] [OR:*Lactococcus lactis*] [DB:genpept-bct1] [DE:*Lactococcus
lactis* nisG gene, orfA, orfB, orfC, and orfD.] [LE:3153] [RE:4799]
[DI:direct]

| ORF Name | NT ID | AA ID | NT LN | AA LN | Score | P-Value |
|---|---|---|---|---|---|---|
| AI7503000997_1406552_c1_252 | 2694 | 6466 | 123 | 40 | | |

Description
NO-HIT

| ORF Name | NT ID | AA ID | NT LN | AA LN | Score | P-Value |
|---|---|---|---|---|---|---|
| AI7503000997_14094002_c2_303 | 2695 | 6467 | 138 | 45 | | |

Description
NO-HIT

| ORF Name | NT ID | AA ID | NT LN | AA LN | Score | P-Value |
|---|---|---|---|---|---|---|
| AI7503000997_14097586_f3_201 | 2696 | 6468 | 438 | 145 | 470 | 1.2e−44 |

Description
sp:[LN:URE2_STAXY] [AC:P42874] [GN:UREB] [OR:*STAPHYLOCOCCUS XYLOSUS*]
[EC:3.5.1.5] [DE:UREASE BETA SUBUNIT, (UREA AMIDOHYDROLASE)] [SP:P42874]
[DB:swissprot] >pir:[LN:S38484] [AC:S38484] [PN:urease, beta chain]
[CL:urease 12K chain:urease 12K chain homology] [OR:*Staphylococcus xylosus*]
[EC:3.5.1.5] [DB:pir1] >gp:[GI:g410515] [LN:SXUREABC] [AC:X74600] [PN:urease
beta subunit] [GN:ureB] [OR:*Staphylococcus xylosus*] [DB:genpept-bct1]
[DE:*S. xylosus* gene for ureA, ureB, and ureC genes for urease gamma, beta and
alpha subunits.] [SP:P42874] [LE:886] [RE:1299] [DI:direct]

| ORF Name | NT ID | AA ID | NT LN | AA LN | Score | P-Value |
|---|---|---|---|---|---|---|
| AI7503000997_14220635_c3_380 | 2697 | 6469 | 150 | 49 | | |

Description
NO-HIT

| ORF Name | NT ID | AA ID | NT LN | AA LN | Score | P-Value |
|---|---|---|---|---|---|---|
| AI7503000997_14454632_c2_289 | 2698 | 6470 | 177 | 58 | 226 | 8.4e−19 |

Description
gp:[GI:g1022726] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000997_14460882_f1_23 | 2699 | 6471 | 189 | 62 | 221 | 2.8e−18 |

Description
gp:[GI:g1022726] [LN:SHU35635] [AC:U35635] [PN:unknown] [OR:*Staphylococcus
haemolyticus*] [SR:*Staphylococcus haemolyticus* strain = Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000997__14501888__f2__129 | 2700 | 6472 | 126 | 41 | | |

Description
NO-HIT

| ORF Name | NT ID | AA ID | NT LN | AA LN | Score | P-Value |
|---|---|---|---|---|---|---|
| AI7503000997__14549010__c2__339 | 2701 | 6473 | 666 | 221 | 531 | 4.0e−51 |

Description
gp:[GI:e1429630:g4756162] [LN:A67171] [AC:A67171] [FN:MOBA GENE]
[OR:*Staphylococcus carnosus*] [DB:genpept-pat] [DE:Sequence 11 from Patent
EP0805205.] [NT:unnamed protein product] [LE:4821] [RE:5411] [DI:direct]
>gp:[GI:g3955208] [LN:AF022796] [AC:AF022796] [PN:MobA] [GN:mobA]
[OR:*Staphylococcus carnosus*] [DB:genpept-bct2] [DE:*Staphylococcus carnosus*
molybdenum cofactor biosynthetic gene cluster, complete sequence.]
[NT:protein similar to MobA of *Escherichia coli*] [LE:7042] [RE:7632]
[DI:direct]

| ORF Name | NT ID | AA ID | NT LN | AA LN | Score | P-Value |
|---|---|---|---|---|---|---|
| AI7503000997__14550133__f1__14 | 2702 | 6474 | 543 | 180 | | |

Description
NO-HIT

| ORF Name | NT ID | AA ID | NT LN | AA LN | Score | P-Value |
|---|---|---|---|---|---|---|
| AI7503000997__15820176__f3__207 | 2703 | 6475 | 126 | 41 | | |

Description
NO-HIT

| ORF Name | NT ID | AA ID | NT LN | AA LN | Score | P-Value |
|---|---|---|---|---|---|---|
| AI7503000997__16129817__f1__68 | 2704 | 6476 | 156 | 51 | | |

Description
NO-HIT

| ORF Name | NT ID | AA ID | NT LN | AA LN | Score | P-Value |
|---|---|---|---|---|---|---|
| AI7503000997__19533567__f2__100 | 2705 | 6477 | 264 | 87 | 80 | 0.0025 |

Description
gp: [GI:g5306165] [LN:AF160864] [AC:AF160864] [PN:orf98] [GN:orf98]
[OR:*Mitochondrion Tetrahymena pyriformis*] [SR:*Tetrahymena pyriformis*]
[DB:genpept] [DE:*Tetrahymena pyriformis* mitochondrial DNA, complete genome.]
[NT:Open reading frame ymf71 (CPGN); ATT initiation] [LE:37598] [RE:37894]
[DI:direct]

| ORF Name | NT ID | AA ID | NT LN | AA LN | Score | P-Value |
|---|---|---|---|---|---|---|
| AI7503000997__20112790__c3__399 | 2706 | 6478 | 126 | 41 | | |

Description
NO-HIT

| ORF Name | NT ID | AA ID | NT LN | AA LN | Score | P-Value |
|---|---|---|---|---|---|---|
| AI7503000997__20345067__c3__365 | 2707 | 6479 | 126 | 41 | | |

Description
NO-HIT

| ORF Name | NT ID | AA ID | NT LN | AA LN | Score | P-Value |
|---|---|---|---|---|---|---|
| AI7503000997__2126925__f3__211 | 2708 | 6480 | 153 | 50 | | |

Description
NO-HIT

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000997__21611592__f3__236 | 2709 | 6481 | 369 | 122 | 89 | 0.0017 |

Description
pir: [LN:E71805] [AC:E71805] [PN:protein-export membrane protein] [GN:secF]
[CL:*Escherichia coli* preprotein translocase chain secF] [OR:*Helicobacter pylori*] [SR:strain J99, , strain J99] [SR:strain J99,] [DB:pir2]
>gp:[GI:g4156068] [LN:AE001567] [AC:AE001567:AE001439] [PN:PROTEIN-EXPORT MEMBRANE PROTEIN] [GN:secF] [OR:*Helicobacter pylori* J99] [DB:genpept-bct2] [DE:*Helicobacter pylori*, strain J99 section 128 of 132 of the complete genome.] [NT:similar to *H. pylori* 26695 gene HP1549] [LE:9115] [RE:10086] [DI:direct]

| ORF Name | NT ID | AA ID | NT LN | AA LN | Score | P-Value |
|---|---|---|---|---|---|---|
| AI7503000997__21646015__f2__104 | 2710 | 6482 | 210 | 69 | 158 | 1.3e−11 |

Description
gp: [GI:g1022725] [LN:SHU35635] [AC:U35635] [PN:unknown] [OR:*Staphylococcus haemolyticus*] [SR:*Staphylococcus haemolyticus* strain = Y176] [DB:genpept-bct1] [DE:*Staphylococcus haemolyticus* IS1272 ORF1 and ORF2 genes, complete cds.] [NT:ORF2] [LE:394] [RE:1083] [DI:complement] >gp: [GI:g295162] [LN:STAMECRA] [AC:L14017] [OR:*Staphylococcus aureus*] [SR:*Staphylococcus aureus* (strain COL) DNA] [DB:genpept-bct1] [DE:*Staphylococcus aureus* methicillin-resistance protein (mecR) geneand unknown ORF, complete cds.] [NT:unknown ORF1; putative] [LE:1492] [RE:2181] [DI:complement]

| ORF Name | NT ID | AA ID | NT LN | AA LN | Score | P-Value |
|---|---|---|---|---|---|---|
| AI7503000997__21675050__f3__230 | 2711 | 6483 | 360 | 119 | | |

Description
NO-HIT

| ORF Name | NT ID | AA ID | NT LN | AA LN | Score | P-Value |
|---|---|---|---|---|---|---|
| AI7503000997__21681561__f1__74 | 2712 | 6484 | 891 | 296 | 776 | 4.4e−77 |

Description
pir: [LN:D69744] [AC:D69744] [PN:conserved hypothetical protein ybbI]
[GN:ybbI] [CL:conserved hypothetical protein b2428] [OR:*Bacillus subtilis*]
[DB:pir2] >gp: [GI:e1182103:g2632437] [LN:BSUB0001] [AC:Z99104:AL009126]
[GN:ybbI] [FN:unknown] [OR:*Bacillus subtilis*] [DB:genpept-bct1] [DE:*Bacillus subtilis* complete genome (section 1 of 21): from 1 to213080.] [NT:similar to hypothetical proteins] [LE:192050] [RE:192964] [DI:complement]

| ORF Name | NT ID | AA ID | NT LN | AA LN | Score | P-Value |
|---|---|---|---|---|---|---|
| AI7503000997__21776942__c1__244 | 2713 | 6485 | 642 | 213 | 855 | 1.9e−85 |

Description
sp: [LN:YBXG__BACSU] [AC:P54425:O31438] [GN:YBXG:YBDP] [OR:*BACILLUS SUBTILIS*]
[DE:HYPOTHETICAL TRANSPORT PROTEIN IN NDHF-CSGA INTERGENIC REGION (ORF1)]
[SP:P54425:O31438] [DB:swissprot] >pir: [LN:H69751] [AC:H69751:PC6045]
[PN:amino acid permease homolog ybxG] [GN:ybxG] [CL:arginine permease]
[OR:*Bacillus subtilis*] [DB:pir2] >gp: [GI:d1034070:g3599629] [LN:AB006424]
[AC:AB006424] [GN:ybdP] [OR:*Bacillus subtilis*] [SR:*Bacillus subtilis*
(strain:168) DNA] [DB:genpept-bct1] [DE:*Bacillus subtilis* genomic DNA, 70 kb
region between 17 and 23degree.] [LE:29556] [RE:30944] [DI:direct]
>gp: [GI:e1182158:g2632492] [LN:BSUB0002] [AC:Z99105:AL009126] [GN:ybxG]
[FN:unknown] [OR:*Bacillus subtilis*] [DB:genpept-bct1] [DE:*Bacillus subtilis*
complete genome (section 2 of 21): from 194651 to415810.] [NT:alternate gene
name: ybdP; similar to amino acid] [SP:P54425] [LE:31905] [RE:33293]
[DI:direct]

| ORF Name | NT ID | AA ID | NT LN | AA LN | Score | P-Value |
|---|---|---|---|---|---|---|
| AI7503000997__2211433__f3__205 | 2714 | 6486 | 867 | 288 | 534 | 1.9e−51 |

Description
sp: [LN:URED_BACSB] [AC:Q07400] [GN:URED] [OR:*BACILLUS* SP] [SR:TB-90,]
[DE:UREASE ACCESSORY PROTEIN URED] [SP:Q07400] [DB:swissprot]
>pir: [LN:G36950] [AC:G36950] [PN:ureD protein] [OR:*Bacillus* sp.] [DB:pir2]
>gp: [GI:d1003839:g216366] [LN:BACUREA] [AC:D14439] [PN:urease accessory
protein] [GN:UreD] [OR:*Bacillus* sp.] [SR:*Bacillus* sp. (strain:TB-90) DNA]
[DB:genpept-bct1] [DE:Thermophilic *Bacillus* genes for urease subunits and
ureaseaccessory proteins, complete cds.] [LE:4281] [RE:5096] [DI:direct]

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000997__22290657__c3__382 | 2715 | 6487 | 387 | 128 | 164 | 3.1e−12 |

Description
gp: [GI:g3283053] [LN:AF054173] [AC:AF054173] [PN:staphylococcal accessory regulator A homolog] [GN:sarA] [OR:*Staphylococcus epidermidis*] [DB:genpept-bct2] [DE:*Staphylococcus epidermidis* staphylococcal accessory regulator Ahomolog (sarA) gene, complete cds.] [LE:887] [RE:1261] [DI:direct]

| ORF Name | NT ID | AA ID | NT LN | AA LN | Score | P-Value |
|---|---|---|---|---|---|---|
| AI7503000997__22455337__f3__217 | 2716 | 6488 | 168 | 55 | | |

Description
NO-HIT

| ORF Name | NT ID | AA ID | NT LN | AA LN | Score | P-Value |
|---|---|---|---|---|---|---|
| AI7503000997__22692177__c1__271 | 2717 | 6489 | 537 | 178 | 556 | 9.0e−54 |

Description
gp: [GI:e1429621:g4756159] [LN:A67171] [AC:A67171] [FN:MOAB GENE] [OR:*Staphylococcus carnosus*] [DB:genpept-pat] [DE:Sequence 11 from Patent EP0805205.] [NT:unnamed protein product] [LE:1150] [RE:1662] [DI:direct] >gp: [GI:g3955202] [LN:AF022796] [AC:AF022796] [PN:MoaB] [GN:moaB] [OR:*Staphylococcus carnosus*] [DB:genpept-bct2] [DE:*Staphylococcus carnosus* molybdenum cofactor biosynthetic genecluster, complete sequence.] [NT:protein similar to MoaB of *Escherichia coli*] [LE:3371] [RE:3883] [DI:direct]

| ORF Name | NT ID | AA ID | NT LN | AA LN | Score | P-Value |
|---|---|---|---|---|---|---|
| AI7503000997__22734582__c2__293 | 2718 | 6490 | 141 | 46 | | |

Description
NO-HIT

| ORF Name | NT ID | AA ID | NT LN | AA LN | Score | P-Value |
|---|---|---|---|---|---|---|
| AI7503000997__23538332__f1__18 | 2719 | 6491 | 150 | 49 | | |

Description
NO-HIT

| ORF Name | NT ID | AA ID | NT LN | AA LN | Score | P-Value |
|---|---|---|---|---|---|---|
| AI7503000997__23609628__c2__330 | 2720 | 6492 | 975 | 324 | 385 | 1.2e−35 |

Description
gp: [GI:g2645495] [LN:AF017231] [AC:AF017231] [PN:inosine-adenosine-guanosine-nucleoside] [FN:catalyzes the hydrolysis of the N-ribosidic] [OR:*Trypanosoma brucei brucei*] [DB:genpept-inv1] [DE:*Trypanosoma brucei brucei* inosine-adenosine-guanosine-nucleosidehydrolase mRNA, complete cds.] [NT:N-ribohydrolase; IAG-nucleoside hydrolase] [LE:187] [RE:1170] [DI:direct]

| ORF Name | NT ID | AA ID | NT LN | AA LN | Score | P-Value |
|---|---|---|---|---|---|---|
| AI750300997__23620260__c2__311 | 2721 | 6493 | 1107 | 368 | 334 | 3.0e−30 |

Description
sp: [LN:ODH__ARTSP] [AC:Q44297] [GN:ODH] [OR:*ARTHROBACTER* SP] [SR:1C,] [EC:l.5.1.28] [DE:OPINE DEHYDROGENASE,] [SP:Q44297] [DB:swissprot] >pir: [LN:I39664] [AC:I39664] [PN:probable D-octopine dehydrogenase,] [OR:*Arthrobacter* sp.] [EC:1.5.1.11] [DB:pir2] >gp:[GI:d1008736:g1060848] [LN:ARGOD] [AC:D45211] [PN:opine dehydrogenase] [OR:*Arthrobacter* sp.] [SR:*Arthrobacter* sp. DNA, clone pODH1] [DB:genpept-bct1] [DE:*Arthrobacter* sp. gene for opine dehydrogenase, complete cds.] [LE:254] [RE:1333] [DI:direct]

| ORF Name | NT ID | AA ID | NT LN | AA LN | Score | P-Value |
|---|---|---|---|---|---|---|
| AI7503000997__23631551__c3__395 | 2722 | 6494 | 792 | 263 | | |

Description
NO-HIT

-continued

| ORF Name | NT ID | AA ID | NT LN | AA LN | Score | P-Value |
|---|---|---|---|---|---|---|
| AI7503000997__23642167__f3__175 | 2723 | 6495 | 1218 | 405 | 611 | 1.3e−59 |

Description
pir: [LN:B70065] [AC:B70065] [PN:antibiotic resistance protein homolog ywoG]
[GN:ywoG] [OR:*Bacillus subtilis*] [DB:pir2] >gp: [GI:e1184551:g2636170]
[LN:BSUB0019] [AC:Z99122:AL009126] [GN:ywoG] [FN:unknown] [OR:*Bacillus
subtilis*] [DB:genpept-bct1] [DE:*Bacillus subtilis* complete genome (section
19 of 21): from 3597091to 3809700.] [NT:similar to antibiotic resistance
protein] [LE:151451] [RE:152641] [DI:direct] >gp: (GI:e283116:g1684651]
[LN:BSZ82987] [AC:Z82987] [PN:unknown similar to quinolon resistance
protein] [GN:ywoG] [OR:*Bacillus subtilis*] [DB:genpept-bct1] [DE:*B. subtilis*
ywo[A,B,C,D,E,F,G,H], nrg[A,B], spoIIID and mb1 genes.] [LE:8662] [RE:9852]
[DI:complement] >gp: [GI:e1184551:g2636170] [LN:BSUB0019]
[AC:Z99122:AL009126] [GN:ywoG] [FN:unknown] [OR:*Bacillus subtilis*]
[DB:genpept] [DE:*Bacillus subtilis* complete genome (section 19 of 21): from
3597091to 3809700.] [NT:similar to antibiotic resistance protein]
[LE:151451] [RE:152641] [DI:direct]

| ORF Name | NT ID | AA ID | NT LN | AA LN | Score | P-Value |
|---|---|---|---|---|---|---|
| AI7503000997__23678262__c3__394 | 2724 | 6496 | 573 | 190 | 370 | 4.6e−34 |

Description
pir: [LN:B69832] [AC:B69832] [PN:biotin biosynthesis homolog yhfU] [GN:yhfU]
[OR:*Bacillus subtilis*] [DB:pir2] >gp: [GI:e1183039:g2633373] [LN:BSUB0006]
[AC:Z99109:AL009126] [GN:yhfU] [FN:unknown] [OR:*Bacillus subtilis*]
[DB:genpept-bct1] [DE:*Bacillus subtilis* complete genome (section 6 of 21):
from 999501 to1209940.] [NT:similar to biotin biosynthesis] [LE:111897]
[RE:112457] [DI:complement] >gp: [GI:e325000:g2226257] [LN:BSY14084]
[AC:Y14084] [PN:hypothetical protein] [GN:yhfu] [OR:*Bacillus subtilis*]
[DB:genpept-bct1] [DE:*B.subtilis* chromosomal DNA, region 78–80 degrees: aprE
to comK.] [NT:similarity to BioY from *Bacillus sphaericus* (Swiss) [LE:6325]
[RE:6885] [DI:complement]

| ORF Name | NT ID | AA ID | NT LN | AA LN | Score | P-Value |
|---|---|---|---|---|---|---|
| AI7503000997__24104677__c2__291 | 2725 | 6497 | 1656 | 551 | 1619 | 2.0e−166 |

Description
sp: [LN:PTIB_BACSU] [AC:P54715] [GN:GLVC:GLVCB:GLV-2] [OR:*BACILLUS SUBTILIS*]
[EC:2.7.1.69] [DE:II, BC COMPONENT),] [SP:P54715] [DB:swissprot]
>pir: [LN:G69635] [AC:G69635] [PN:PTS arbutin-like enzyme IIBC component
glvC] [GN:glvC] [OR:*Bacillus subtilis*] [DB:pir2] >gp: [GI:e1182810:g2633144]
[LN:BSUB0005] [AC:Z99108:AL009126] [PN:phosphotransferase system (PTS)
arbutin-like] [GN:glvC] [OR:*Bacillus subtilis*] [DB:genpept-bct1]
[DE:*Bacillus subtilis* complete genome (section 5 of 21): from 802821
to1011250.] [NT:alternate gene name: yfiB] [SP:P54715] [LE:88901] [RE:90484]
[DI:direct] >gp: [GI:d1009740:g1486243] [LN:D50543] [AC:D50543] [PN:unknown]
[GN:glv-2] [FN:unknown] [OR:*Bacillus subtilis*] [SR:*Bacillus subtilis*
(strain:168, haplotype:haploid) DNA] [DB:genpept-bct1] [DE:*Bacillus subtilis*
DNA for 76-degree region, complete cds.] [LE:2577] [RE:4160] [DI:direct]

| ORF Name | NT ID | AA ID | NT LN | AA LN | Score | P-Value |
|---|---|---|---|---|---|---|
| AI7503000997__24257012__c1__268 | 2726 | 6498 | 735 | 244 | 927 | 4.4e−93 |

Description
gp: [GI:g3955199] [LN:AF022796] [AC:AF022796] [PN:ModB] [GN:modB]
[OR:*Staphylococcus carnosus*] [DB:genpept-bct2] [DE:*Staphylococcus carnosus*
molybdenum cofactor biosynthetic genecluster, complete sequence.]
[NT:integral membrane-spanning protein of the] [LE:906] [RE:1577]
[DI:direct]

| ORF Name | NT ID | AA ID | NT LN | AA LN | Score | P-Value |
|---|---|---|---|---|---|---|
| AI7503000997__24303812__c3__352 | 2727 | 6499 | 123 | 40 | | |

Description
NO-HIT

| ORF Name | NT ID | AA ID | NT LN | AA LN | Score | P-Value |
|---|---|---|---|---|---|---|
| AI7503000997__24314818__c2__340 | 2728 | 6500 | 1035 | 344 | 1410 | 2.9e−144 |

Description
gp: [GI:e1429633:g4756163] [LN:A67171] [AC:A67171] [PN:MOPA GENE]
[OR:*Staphylococcus carnosus*] [DB:genpept-pat] [DE:Sequence 11 from Patent -continued EP0805205.] [LE:5470] [RE:6492] [DI:direct] >gp: [GI:g3955209] [LN:AF022796]
[AC:AF022796] [PN:MoaA] [GN:moaA] [OR:*Staphylococcus carnosus*]
[DB:genpept-bct2] [DE:*Staphylococcus carnosus* molybdenum cofactor
biosynthetic genecluster, complete sequence.] [NT:protein similar to MoaA of
*Escherichia coli*] [LE:7691] [RE:8713] [DI:direct]

| ORF Name | NT ID | AA ID | NT LN | AA LN | Score | P-Value |
|---|---|---|---|---|---|---|
| AI7503000997__24406502__f2__127 | 2729 | 6501 | 171 | 56 | | |

Description
NO-HIT

| ORF Name | NT ID | AA ID | NT LN | AA LN | Score | P-Value |
|---|---|---|---|---|---|---|
| AI7503000997__24406577__c2__346 | 2730 | 6502 | 3156 | 1051 | 2317 | 2.2e−240 |

Description
pir: [LN:E69795] [AC:E69795] [PN:acriflavin resistance protein homolog yerP]
[GN:yerP] [OR:*Bacillus subtilis*] [DB:pir2] >gp:[GI:e1182651:g2632985]
[LN:BSUB0004] [AC:Z99107:AL009126] [GN:yerP] [FN:unknown] [OR:*Bacillus
subtilis*] [DB:genpept-bct1] [DE:*Bacillus subtilis* complete genome (section 4
of 21): from 600701 to813890.] [NT:similar to acriflavin resistance protein]
[LE:131722] [RE:134919] [DI:direct]

| ORF Name | NT ID | AA ID | NT LN | AA LN | Score | P-Value |
|---|---|---|---|---|---|---|
| AI7503000997__24431532__c1__277 | 2731 | 6503 | 1254 | 417 | 1796 | 3.6e−185 |

Description
gp: [GI:g4574235] [LN:AF106850] [AC:AF106850] [PN:FmhB] [GN:fmhB]
[OR:*Staphylococcus aureus*] [DB:genpept-bct2] [DE:*Staphylococcus aureus* FmhB
(fmhB) gene, complete cds.] [NT:similar to *Staphylococcus aureus* FemA and
FemE] [LE:204] [RE:1469] [DI:direct]

| ORF Name | NT ID | AA ID | NT LN | AA LN | Score | P-Value |
|---|---|---|---|---|---|---|
| AI7503000997__24616251__f2__148 | 2732 | 6504 | 696 | 231 | 139 | 2.6e−07 |

Description
gp: [GI:g567887] [LN:STMDNRN] [AC:L37338] [PN:putative repressor] [GN:dnrO]
[OR:*Streptomyces peucetius*] [SR:*Streptomyces peucetius* ATCC 29050 DNA]
[DB:genpept-bct2] [DE:*Streptomyces peucetius* TDP-D-glucose-4,6-dehydratase
(dnrM) gene,3' end, regulatory protein (dnrN) gene, complete cds, and
repressorprotein (dnrO) gene, complete cds.] [NT:putative] [LE:1085]
[RE:2107] [DI:direct]

| ORF Name | NT ID | AA ID | NT LN | AA LN | Score | P-Value |
|---|---|---|---|---|---|---|
| AI7503000997__24644008__c3__396 | 2733 | 6505 | 792 | 263 | 911 | 2.2e−91 |

Description
gp: [GI:g3955198] [LN:AF022796] [AC:AF022796] [PN:ModA] [GN:modA]
[OR:*Staphylococcus carnosus*] [DB:genpept-bct2] [DE:*Staphylococcus carnosus*
molybdenum cofactor biosynthetic genecluster, complete sequence.]
[NT:molybdate-binding lipoprotein of the] [LE:109] [RE:894] [DI:direct]

| ORF Name | NT ID | AA ID | NT LN | AA LN | Score | P-Value |
|---|---|---|---|---|---|---|
| AI7503000997__24650452__f1__64 | 2734 | 6506 | 153 | 50 | | |

Description
NO-HIT

| ORF Name | NT ID | AA ID | NT LN | AA LN | Score | P-Value |
|---|---|---|---|---|---|---|
| AI7503000997__24804077__c3__358 | 2735 | 6507 | 153 | 50 | | |

Description
NO-HIT

| ORF Name | NT ID | AA ID | NT LN | AA LN | Score | P-Value |
|---|---|---|---|---|---|---|
| AI7503000997__25430317__c1__274 | 2736 | 6508 | 492 | 163 | 446 | 4.1e−42 |

Description
gp: [GI:g3955205] [LN:AF022796] [AC:AF022796] [PN:MobB] [GN:mobB]
[OR:*Staphylococcus carnosus*] [DB:genpept-bct2] [DE:*Staphylococcus carnosus*
molybdenum cofactor biosynthetic genecluster, complete sequence.]

-continued

[NT:protein similar to MobB of *Escherichia coli*] [LE:5873] [RE:6355]
[DI:direct]

| ORF Name | NT ID | AA ID | NT LN | AA LN | Score | P-Value |
|---|---|---|---|---|---|---|
| AI7503000997_25443838_c2_305 | 2737 | 6509 | 789 | 262 | 448 | 2.5e−42 |

Description
gp: [GI:d1023468:g2506027] [LN:D42078] [AC:D42078] [GN:NAG]
[OR:*Staphylococcus aureus*] [SR:*Staphylococcus aureus* DNA] [DB:genpept-bct1]
[DE:*Staphylococcus aureus* DNA for N-acetyl-glucosaminidase, partialcds.]
[LE:<1] [RE:1448] [DI:direct] >gp: [GI:d1023468:g2506027] [LN:D42078]
[AC:D42078] [GN:NAG] [OR:*Staphylococcus aureus*] [SR:*Staphylococcus aureus*
DNA] [DB:genpept] [DE:*Staphylococcus aureus* DNA for
N-acetyl-glucosaminidase, partialcds.] [LE:<1] [RE:1448] [DI:direct]

| ORF Name | NT ID | AA ID | NT LN | AA LN | Score | P-Value |
|---|---|---|---|---|---|---|
| AI7503000997_25548385_f1_7 | 2738 | 6510 | 144 | 47 | | |

Description
NO-HIT

| ORF Name | NT ID | AA ID | NT LN | AA LN | Score | P-Value |
|---|---|---|---|---|---|---|
| AI7503000997_25554213_f1_49 | 2739 | 6511 | 627 | 208 | 943 | 8.8e−95 |

Description
sp: [LN:UREG_STAXY] [AC:P42877] [GN:UREG] [OR:*STAPHYLOCOCCUS XYLOSUS*]
[DE:UREASE ACCESSORY PROTEIN UREG] [SP:P42877] [DB:swissprot]
>gp: [GI:g511070] [LN:SXUREFG] [AC:Z35136] [PN:UreG] [OR:*Staphylococcus
xylosus*] [DB:genpept-bct1] [DE:*S.xylosus* (C2a) UreF and UreG genes.]
[SP:P42877] [LE:781] [RE:1395] [DI:direct]

| ORF Name | NT ID | AA ID | NT LN | AA LN | Score | P-Value |
|---|---|---|---|---|---|---|
| AI7503000997_25582885_f1_22 | 2740 | 6512 | 453 | 150 | 153 | 4.6e−11 |

Description
pir: [LN:C70065] [AC:C70065] [PN:transcription regulator MarR family homolog
ywoH] [GN:ywoH] [OR:*Bacillus subtilis*] [DB:pir2] >gp: [GI:e1184550:g2636169]
[LN:BSUB0019] [AC:Z99122:AL009126] [GN:ywoH] [FN:unknown] [OR:*Bacillus
subtilis*] [DB:genpept-bct1] [DE:*Bacillus subtilis* complete genome (section
19 of 21): from 3597091to 3809700.] [NT:similar to transcriptional regulator
(MarR family)] [LE:151016] [RE:151429] [DI:direct] >gp: [GI:e283130:g1684652]
[LN:BSZ82987] [AC:Z82987] [PN:unknown, similar to cytolysin SlyA from]
[GN:ywoH] [OR:*Bacillus subtilis*] [DB:genpept-bct1] [DE:*B.subtilis*
ywo[A,B,C,D,EF,G,HJ, nrg[A,B], spoIIID and mb1 genes.] [LE:9874] [RE:10287]
[DI:complement] >gp: [GI:e1184550:g2636169] [LN:BSUB0019]
[AC:Z99122:AL009126] [GN:ywoH] [FN:unknown] [OR:*Bacillus subtilis*]
[DB:genpept] [DE:*Bacillus subtilis* complete genome (section 19 of 21): from
3597091to 3809700.] [NT:similar to transcriptional regulator (MarR family)]
[LE:151016] [RE:151429] [DI:direct]

| ORF Name | NT ID | AA ID | NT LN | AA LN | Score | P-Value |
|---|---|---|---|---|---|---|
| AI7503000997_25679762_c1_248 | 2741 | 6513 | 831 | 276 | 374 | 1.7e−34 |

Description
sp: [LN:SUHB_BACSU] [AC:Q45499] [GN:SUHB] [OR:*BACILLUS SUBTILIS*]
[DE:EXTRAGENIC SUPPRESSOR PROTEIN SUHB HOMOLOG] [SP:Q45499] [DB:swissprot]
>pir: [LN:E69864] [AC:E69864] [PN:myo-inositol-1(or 4)-monophosphatase
homolog yktC] [GN:yktC] [CL:suppressor protein suhB] [OR:*Bacillus subtilis*]
[DB:pir2] >gp: [GI:e1185057:g2633838] [LN:BSUB0008] [AC:Z99111:AL009126]
[GN:yktC] [FN:unknown] [OR:*Bacillus subtilis*] [DB:genpept-bct1] [DE:*Bacillus
subtilis* complete genome (section 8 of 21): from 1394791to 1603020.]
[NT:similar to myo-inositol-1(or 4)-monophosphatase] [SP:Q45499] [LE:142056]
[RE:142853] [DI:direct] >gp: [GI:g3282150] [LN:AF012285]
[AC:AF0122285:AF012284:U51911] [PN:unknown] [GN:yktC] [FN:unknown]
[OR:*Bacillus subtilis*] [DB:genpept-bct2] [DE:*Bacillus subtilis* mobA-nprE
gene region.] [NT:similar to *E. coli* extragenic suppressor protein]
[LE:42544] [RE:43341] [DI:direct]

| ORF Name | NT ID | AA ID | NT LN | AA LN | Score | P-Value |
|---|---|---|---|---|---|---|
| AI7503000997_26182800_c1_276 | 2742 | 6514 | 813 | 270 | 90 | 0.045 |

Description
sp: [LN:YCX3_ASTLO] [AC:P34778] [OR:*ASTASIA LONGA*] [SR:,*EUGLENOPHYCEAN ALGA*]

-continued

[DE:HYPOTHETICAL 20.1 KD PROTEIN IN TRNS-RPL20 INTERGENIC REGION (ORF170)]
[SP:P34778] [DB:swissprot] >pir: [LN:S38600] [AC:S38600] [PN:hypothetical
protein 170 [rp120 5' region)] [OR:plastid *Astasia longa*] [DB:pir2]
>gp: [GI:g414866] [LN:ALRIBPTR] [AC:X75653] [GN:orf170] [OR:Chloroplast
*Astasia longa*] [SR:*euglenophycean alga*] [DB:genpept-pln1] [DE:*A.longa*
plastid genes for ribosomal proteins and tRNAs.] [SP:P34778] [LE:1985]
[RE:2497] [DI:complement]

| ORF Name | NT ID | AA ID | NT LN | AA LN | Score | P-Value |
|---|---|---|---|---|---|---|
| AI7503000997_26367127_f1_44 | 2743 | 6515 | 168 | 55 | | |

Description
NO-HIT

| ORF Name | NT ID | AA ID | NT LN | AA LN | Score | P-Value |
|---|---|---|---|---|---|---|
| AI7503000997_26375031_f1_8 | 2744 | 6516 | 195 | 64 | 86 | 0.015 |

Description
pir: [LN:A70387] [AC:A70387] [PN:conserved hypothetical protein aq_1006]
[GN:aq_1006] [OR:*Aquifex aeolicus*] [DB:pir2] >gp: [GI:g2983515]
[LN:AE000718] [AC:AE000718:AE000657] [PN:hypothetical protein] [GN:aq_1006]
[OR:*Aquifex aeolicus*] [DB:genpept-bct2] [DE:*Aquifex aeolicus* section 50 of
109 of the complete genome.] [LE:2797] [RE:5733] [DI:direct]

| ORF Name | NT ID | AA ID | NT LN | AA LN | Score | P-Value |
|---|---|---|---|---|---|---|
| AI7503000997_26758426_c2_316 | 2745 | 6517 | 750 | 249 | 121 | 2.8e−07 |

Description
gp: [GI:g3283053] [LN:AF054173] [AC:AF054173] [PN:staphylococcal accessory
regulator A homolog] [GN:sarA] [OR:*Staphylococcus epidermidis*]
[DB:genpept-bct2] [DE:*Staphylococcus epidermidis* staphylococcal accessory
regulator Ahomolog (sarA) gene, complete cds.] [LE:887] [RE:1261]
[DI:direct]

| ORF Name | NT ID | AA ID | NT LN | AA LN | Score | P-Value |
|---|---|---|---|---|---|---|
| AI7503000997_29494067_c3_356 | 2746 | 6518 | 213 | 70 | 50 | 0.031 |

Description
pir: [LN:PC1133] [AC:PC1133:S18087] [PN:hypothetical protein 119 (rmpG 5'
region)] [OR:*Lactococcus lactis*] [DB:pir2]

| ORF Name | NT ID | AA ID | NT LN | AA LN | Score | P-Value |
|---|---|---|---|---|---|---|
| AI7503000997_29697752_c2_302 | 2747 | 6519 | 786 | 261 | 499 | 9.8e−48 |

Description
sp: [LN:LYTR_BACSU] [AC:Q02115] [GN:LYTR] [OR:*BACILLUS SUBTILIS*]
[DE:MEMBRANE-BOUND PROTEIN LYTR] [SP:Q02115] [DB:swissprot] >pir: [LN:A47679]
[AC:A47679:H69654] [PN:lyt divergon expression attenuator LytR] [GN:lytR]
[CL:*Bacillus subtilis* probable transcription regulator yvhJ] [OR:*Bacillus
subtilis*] [DB:pir2] >gp: [GI:g143156] [LN:BACLYTABCD] [AC:M87645]
[PN:membrane bound protein] [GN:lytR] [OR:*Bacillus subtilis*] [SR:*Bacillus
subtilis* (strain W168) DNA] [DB:genpept-bct1] [DE:*Bacillus subtillis*
membrane bound protein (lytA and lytR) ; amidaseenhancer (lytB); and amidase
(lytC) genes, complete cds's.) [LE:92] [RE:1012] [DI:complement]
>gp: [GI:e1184471:g2636091] [LN:BSUB0019] [AC:Z99122:AL009126]
[PN:membrane-bound protein] [GN:lytR] [FN:attenuator role for lytABC and
lytR expression] [OR:*Bacillus subtilis*] [DB:genpept-bct1] [DE:*Bacillus
subtilis* complete genome (section 19 of 21): from 3597091to 3809700.]
[SP:Q02115] [LE:65251] [RE:66171] [DI:direct] >gp: [GI:e1184471:g2636091]
[LN:BSUB0019] [AC:Z99122:AL009126] [PN:membrane-bound protein] [GN:lytR]
[FN:attenuator role for lytABC and lytR expression] [OR:*Bacillus subtilis*]
[DB:genpept] [DE:*Bacillus subtilis* complete genome (section 19 of 21): from
3597091to 3809700.] [SP:Q02115] [LE:65251] [RE:66171] [DI:direct]

| ORF Name | NT ID | AA ID | NT LN | AA LN | Score | P-Value |
|---|---|---|---|---|---|---|
| AI7503000997_31284550_f3_237 | 2748 | 6520 | 174 | 57 | | |

Description
NO-HIT

-continued

| ORF Name | NT ID | AA ID | NT LN | AA LN | Score | P-Value |
|---|---|---|---|---|---|---|
| AI7503000997_3250075_f3_220 | 2749 | 6521 | 1008 | 335 | 705 | 1.5e−69 |

Description
pir: [LN:A71175] [AC:A71175] [PN:probable dehydrogenase] [GN:PH0597]
[OR:*Pyrococcus horikoshii*] [DB:pir2] >gp: [GI:d1030629:g3257003]
[LN:AP000002]
[AC:AP000002:AB009475:AB009476:AB009477:AB009478:AB009479:AB009480]
[PN:376aa long hypothetical dehydrogenase] [GN:PH0597] [OR:*Pyrococcus horikoshii*] [SR:*Pyrococcus horikoshii* (strain:OT3) DNA] [DB:genpept-bct1]
[DE:*Pyrococcus horikoshii* OT3 genomic DNA, 287001–544000 nt. position (2/7) .]
[NT:similar to owl:BSZ9404317 percent identity: 49.821] [LE:248539]
[RE:249669] [DI:complement]

| ORF Name | NT ID | AA ID | NT LN | AA LN | Score | P-Value |
|---|---|---|---|---|---|---|
| AI7503000997_33360910_f3_216 | 2750 | 6522 | 549 | 182 | 120 | 1.4e−07 |

Description
pir: [LN:S74932] [AC:S74932] [PN:hypothetical protein slr0686]
[OR:*Synechocystis* sp.] [SR:PCC 6803, , PCC 6803] [SR:PCC 6803,] [DB:pir2]
>gp: [GI:d1017705:g1652047] [LN:D90902] [AC:D90902:AB001339] [PN:hypothetical
protein] [OR:*Synechocystis* sp.] [SR:*Synechocystis* sp. (strain:PCC6803) DNA]
[DB:genpept-bct1] [DE:*Synechocystis* sp. PCC6803 complete genome, 4/27,
402290–524345.] [NT:ORF_ID:slr0686] [LE:27521] [RE:27880] [DI:direct]

| ORF Name | NT ID | AA ID | NT LN | AA LN | Score | P-Value |
|---|---|---|---|---|---|---|
| AI7503000997_33694505_f3_198 | 2751 | 6523 | 162 | 53 | 47 | 0.0063 |

Description
gp: [GI:d1042768:g5103471] [LN:AP000058] [AC:AP000058] [PN:102aa long
hypothetical protein] [GN:APE0083] [OR:*Aeropyrum pernix*] [SR:*Aeropyrum pernix* (strain:K1) DNA] [DB:genpept] [DE:*Aeropyrum pernix* genomic DNA,
section 1/7.] [LE:56764] [RE:57072] [DI:direct]

| ORF Name | NT ID | AA ID | NT LN | AA LN | Score | P-Value |
|---|---|---|---|---|---|---|
| AI7503000997_3371062_f1_10 | 2752 | 6524 | 333 | 110 | 90 | 0.0034 |

Description
gp: [GI:g1040951] [LN:AOU35271] [AC:U35271] [PN:NADH dehydrogenase subunit 6]
[OR:Mitochondrion *Anopheles oswaldoi*] [SR:*Anopheles oswaldoi*]
[DB:genpept-inv1] [DE:*Anopheles oswaldoi* NADH dehydrogenase subunit 6 gene,
mitochondrialgene encoding mitochondrial product, partial cds.] [LE:<1]
[RE:525] [DI:direct]

| ORF Name | NT ID | AA ID | NT LN | AA LN | Score | P-Value |
|---|---|---|---|---|---|---|
| AI7503000997_34192165_f1_63 | 2753 | 6525 | 345 | 114 | 264 | 7.9e−23 |

Description
pir: [LN:B69857] [AC:B69857] [PN:chaperonin homolog ykkD] [GN:ykkD]
[CL:sugE protein] [OR:*Bacillus subtilis*] [DB:pir2]
>gp: [GI:e1181510:g2632030] [LN:BSAJ2571] [AC:AJ002571] [PN:YkkD] [GN:ykkD]
[FN:unknown] [OR:*Bacillus subtilis*] [DB:genpept-bct1] [DE:*Bacillus subtilis*
168 56 kb DNA fragment between xlyA and ykoR.] [LE:28980] [RE:29297]
[DI:direct] >gp: [GI:e1183330:g2633664] [LN:BSUB0007] [AC:Z99110:AL009126]
[GN:ykkD] [FN:unknown] [OR:*Bacillus subtilis*] [DB:genpept-bct1] [DE:*Bacillus subtilis* complete genome (section 7 of 21): from 1194391to 1411140.]
[NT:similar to chaperonin] [LE:181929] [RE:182246] [DI:direct]

| ORF Name | NT ID | AA ID | NT LN | AA LN | Score | P-Value |
|---|---|---|---|---|---|---|
| AI7503000997_34411552_f2_123 | 2754 | 6526 | 1722 | 573 | 2703 | 2.8e−281 |

Description
sp: [LN:URE1_STAXY] [AC:P42873] [GN:UREC] [OR:*STAPHYLOCOCCUS XYLOSUS*]
[EC:3.5.1.5] [DE:UREASE ALPHA SUBUNIT, (UREA AMIDOHYDROLASE)] [SP:P42873]
[DB:swissprot] >pir: [LN:S38485] [AC:538485] [PN:urease, 62K chain:urease
alpha chain] [GN:ureC] [CL:urease 62K chain:urease 62K chain homology]
[OR:*Staphylococcus xylosus*] [EC:3.5.1.5] [DB:pir2] >gp: [GI:g410516]
[LN:SXUREABC] [AC:X74600] [PN:urease alpha subunit] [GN:ureC]
[OR:*Staphylococcus xylosus*] [DB:genpept-bct1] [DE:*S.xylosus* gene for ureA,
ureB, and ureC genes for urease gamma,beta and alpha subunits.] [SP:P42873]
[LE:1296] [RE:3011] [DI:direct]

-continued

| ORF Name | NT ID | AA ID | NT LN | AA LN | Score | P-Value |
|---|---|---|---|---|---|---|
| AI7503000997_34430_f2_96 | 2755 | 6527 | 156 | 51 | | |

Description
NO-HIT

| ORF Name | NT ID | AA ID | NT LN | AA LN | Score | P-Value |
|---|---|---|---|---|---|---|
| AI7503000997_34431300_c2_300 | 2756 | 6528 | 774 | 257 | 139 | 2.8e−09 |

Description
gp: [GI:d1011987:g1402529] [LN:D78257] [AC:D78257] [PN:ORF8] [GN:orf8]
[OR:*Enterococcus faecalis*] [SR:*Enterococcus faecalis* plasmid:pYI17 DNA]
[DB:genpept-bct1] [DE:*Enterococcus faecalis* plasmid pYI17 genes for BacA,
BacB, ORF3,ORF4, ORF5, ORF6, ORF7, ORF8, ORF9, ORF10, ORF11,partial cds.]
[LE:1899] [RE:2261] [DI:complement]

| ORF Name | NT ID | AA ID | NT LN | AA LN | Score | P-Value |
|---|---|---|---|---|---|---|
| AI7503000997_34617187_f2_156 | 2757 | 6529 | 207 | 68 | 74 | 0.00010 |

Description
gp: [GI:g4164553] [LN:AF081828] [AC:AF081828] [PN:NADH dehydrogenase 6]
[OR:Mitochondrion *Ixodes hexagonus*] [SR:*Ixodes hexagonus*] [DB:genpept-inv2]
[DE:*Ixodes hexagonus* mitochondrial DNA, complete genome.] [LE:9406]
[RE:9831] [DI:direct]

| ORF Name | NT ID | AA ID | NT LN | AA LN | Score | P-Value |
|---|---|---|---|---|---|---|
| AI7503000997_35191527_f1_19 | 2758 | 6530 | 156 | 51 | | |

Description
NO-HIT

| ORF Name | NT ID | AA ID | NT LN | AA LN | Score | P-Value |
|---|---|---|---|---|---|---|
| AI7503000997_35319025_f3_200 | 2759 | 6531 | 132 | 43 | | |

Description
NO-HIT

| ORF Name | NT ID | AA ID | NT LN | AA LN | Score | P-Value |
|---|---|---|---|---|---|---|
| AI7503000997_35547892_f3_218 | 2760 | 6532 | 156 | 51 | 161 | 8.5e−12 |

Description
gp: [GI:g2735506] [LN:SCU96107] [AC:U96107] [PN:SceB precursor] [GN:sceB]
[OR:*Staphylococcus carnosus*] [DB:genpept-bct2] [DE:*Staphylococcus carnosus*
N5,N10-methylenetetrahydromethanopterinreductase homolog, SceB precursor
(sceB) and putative transmembraneprotein genes, complete cds, and putative
Na+/H+ antiporter NhaC(nhaC) gene, partial cds.] [NT:major secreted protein]
[LE:1894] [RE:2685] [DI:direct]

| ORF Name | NT ID | AA ID | NT LN | AA LN | Score | P-Value |
|---|---|---|---|---|---|---|
| AI7503000997_35572051_f1_72 | 2761 | 6533 | 129 | 42 | | |

Description
NO-HIT

| ORF Name | NT ID | AA ID | NT LN | AA LN | Score | P-Value |
|---|---|---|---|---|---|---|
| AI7503000997_36017151_f2_110 | 2762 | 6534 | 141 | 46 | | |

Description
NO-HIT

| ORF Name | NT ID | AA ID | NT LN | AA LN | Score | P-Value |
|---|---|---|---|---|---|---|
| AI7503000997_36113805_c1_245 | 2763 | 6535 | 750 | 249 | 775 | 5.6e−77 |

Description
sp: [LN:YBXG_BACSU] [AC:P54425:O31438] [GN:YBXG:YBDP] [OR:*BACILLUS SUBTILIS*]
[DE:HYPOTHETICAL TRANSPORT PROTEIN IN NDHF-CSGA INTERGENIC REGION (ORF1)]
[SP:P54425:O31438] [DB:swissprot] >pir: [LN:H69751] [AC:H69751:PC6045]
[PN:amino acid permease homolog ybxG] [GN:ybxG] [CL:arginine permease]
[OR:*Bacillus subtilis*] [DB:pir2] >gp: [GI:d1034070:g3599629] [LN:AB006424]
[AC:AB006424] [GN:ybdP] [OR:*Bacillus subtilis*] [SR:*Bacillus subtilis*

-continued (strain:168) DNA] [DB:genpept-bct1] [DE:*Bacillus subtilis* genomic DNA, 70 kb region between 17 and 23degree.] [LE:29556] [RE:30944] [DI:direct] >gp: [GI:e1l82158:g2632492] [LN:BSUB0002] [AC:Z99105:AL00912E] [GN:ybxG] [FN:unknown] [OR:*Bacillus subtilis*] [DB:genpept-bct1] [DE:*Bacillus subtilis* complete genome (section 2 of 21): from 194651 to415810.] [NT:alternate gene name: ybdP; similar to amino acid] [SP:P54425] [LE:31905] [RE:33293] [DI:direct]

| ORF Name | NT ID | AA ID | NT LN | AA LN | Score | P-Value |
|---|---|---|---|---|---|---|
| AI7503000997__36132792__c3__402 | 2764 | 6536 | 255 | 84 | 218 | 5.9e−18 |

Description
gp: [GI:e1429627:g4756161] [LN:A67171] [AC:A67171] [PN:MOAD GENE] [OR:*Staphylococcus carnosus*] [DB:genpept-pat] [DE:Sequence 11 from Patent EP0805205.] [LE:4583] [RE:4816] [DI:direct] >gp: [GI:g3955207] [LN:AF022796] [AC:AF022796] [PN:MoaD] [GN:moaD] [OR:*Staphylococcus carnosus*] [DB:genpept-bct2] [DE:*Staphylococcus carnosus* molybdenum cofactor biosynthetic genecluster, complete sequence.] [NT:protein similar to MoaD of *Escherichia coli*] [LE:6804] [RE:7037] [DI:direct]

| ORF Name | NT ID | AA ID | NT LN | AA LN | Score | P-Value |
|---|---|---|---|---|---|---|
| AI7503000997__36134427__c1__241 | 2765 | 6537 | 657 | 218 | 251 | 1.9e−21 |

Description
sp: [LN:YHCW__BACSU] [AC:P54607] [GN:YHCW] [OR:*BACILLUS SUBTILIS*] [DE:HYPOTHETICAL 24.7 KD PROTEIN IN CSPB-GLPP INTERGENIC REGION] [SP:P54607] [DB:swissprot] >pir: [LN:C69824] [AC:C69824] [PN:phosphoglycolate phosphatase homolog yhcW] [GN:yhcW] [CL:hypothetical protein b2690] [OR:*Bacillus subtilis*] [DB:pir2] >gp: [GI:e233881:g1239999] [LN:BS75DGREG] [AC:X96983] [PN:hypothetical protein] [GN:yhcW] [OR:*Bacillus subtilis*] [DB:genpept-bct1] [DE:*B.subtilis* chromosomal DNA (region 75 degrees: cspB upstream ofglpPFKD operon) .] [NT:similarity to phosphoglycolate phosphatase from] [SP:P54607] [LE:18604] [RE:19266] [DI:direct] >gp: [GI:e1l82913:g2633247] [LN:BSUB0005] [AC:Z99108:AL009126] [GN:yhcW] [FN:unknown] [OR:*Bacillus subtilis*] [DB:genpept-bct1] [DE:*Bacillus subtilis* complete genome (section 5 of 21): from 802821 to1011250.] [NT:similar to phosphoglycolate phosphatase] [SP:P546071 [LE:194410] [RE:195072] [DI:direct]

| ORF Name | NT ID | AA ID | NT LN | AA LN | Score | P-Value |
|---|---|---|---|---|---|---|
| AI7503000997__36209660__f2__116 | 2766 | 6538 | 378 | 125 | | |

Description
NO-HIT

| ORF Name | NT ID | AA ID | NT LN | AA LN | Score | P-Value |
|---|---|---|---|---|---|---|
| AI7503000997__36225625__f1__56 | 2767 | 6539 | 795 | 264 | 1034 | 2.0e−104 |

Description
gp: [GI:e244971:g1340128] [LN:SA1234] [AC:X97985] [OR:*Staphylococcus aureus*] [DB:genpept-bct1] [DE:*S.aureus* orfs 1,2,3 & 4.] [NT:ORF1] [LE:537] [RE:1304] [DI:direct]

| ORF Name | NT ID | AA ID | NT LN | AA LN | Score | P-Value |
|---|---|---|---|---|---|---|
| AI7503000997__36615903__c2__329 | 2768 | 6540 | 1164 | 387 | 1007 | 1.5e−101 |

Description
pir: [LN:H69771] [AC:H69771] [PN:butyryl-CoA dehydrogenase homolog ydbM] [GN:ydbM] [OR:*Bacillus subtilis*] [DB:pir2] >gp: [GI:d1020042:g188l262] [LN:AB001488] [AC:AB001488] [GN:ydbM] [OR:*Bacillus subtilis*] [SR:*Bacillus subtilis* (strain:168) DNA] [DB:genpept-bct1] [DE:*Bacillus subtilis* genome sequence, 148 kb sequence of the regionbetween 35 and 47 degree.] [NT:SIMILAR TO ACYL-COA DEHYDROGENASE.] [LE:38215] [RE:39360] [DI:direct] >gp: [GI:e1l82418:g2632752] [LN:BSUB0003] [AC:Z99106:AL009126] [GN:ydbM] [FN:unknown] [OR:*Bacillus subtilis*] *[DB:genpept-bct1]* *[DE:Bacillus subtilis* complete genome (section 3 of 21): from 402751 to611850.] [NT:similar to butyryl-CoA dehydrogenase] [LE:101959] [RE:103104] [DI:direct]

| ORF Name | NT ID | AA ID | NT LN | AA LN | Score | P-Value |
|---|---|---|---|---|---|---|
| AI7503000997__3943752__f2__128 | 2769 | 6541 | 150 | 49 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000997__3947153__f3__204 | 2770 | 6542 | 456 | 151 | 482 | 6.2e-46 |

Description
sp: [LN:UREE_BACSB] [AC:Q07401] [GN:UREE] [OR:*BACILLUS* SP] [SR:TB-90,] [DE:UREASE ACCESSORY PROTEIN UP.EE] [SP:Q07401] [DB:swissprot] >pir: [LN:D36950] [AC:D36950] [PN:ureE protein] [OR:*Bacillus* sp.] [DB:pir2] >gp: [GI:d1003836:g393297] [LN:BACUREA] [AC:D14439] [PN:urease accessory protein] [GN:UreE] [OR:*Bacillus* sp.] [SR:*Bacillus* sp. (strain:TB-90) DNA] [DB:genpept-bct1] [DE:Thermophilic *Bacillus* genes for urease subunits and ureaseaccessory proteins, complete cds.] [LE:2521] [RE:2967] [DI:direct]

| ORF Name | NT ID | AA ID | NT LN | AA LN | Score | P-Value |
|---|---|---|---|---|---|---|
| AI7503000997__3991557__f1__55 | 2771 | 6543 | 141 | 46 | | |

| Description | | | | | | |
|---|---|---|---|---|---|---|
| NO-HIT | | | | | | |
| ORF Name | NT ID | AA ID | NT LN | AA LN | Score | P-Value |
| AI7503000997__4042327__c3__390 | 2772 | 6544 | 918 | 305 | 309 | 1.3e-27 |

Description
gp: [GI:g1322222] [LN:HSU35735] [AC:U35735] [PN:RACH1] [GN:RACH1] [OR:*Homo sapiens*] [SR:human] [DB:genpept-pri2] [DE:Human RACH1 (RACH1) mRNA, complete cds.] [LE:169] [RE:1338] [DI:direct].

| ORF Name | NT ID | AA ID | NT LN | AA LN | Score | P-Value |
|---|---|---|---|---|---|---|
| AI7503000997__4086568__c3__381 | 2773 | 6545 | 1983 | 660 | 130 | 1.8e-07 |

Description
sp: [LN:SOXS_ECOLI] [AC:P22539] [GN:SOXS] [OR:*ESCHERICHIA COLI*] [DE:REGULATORY PROTEIN SOXS] [SP:P22539] [DB:swissprot]

| ORF Name | NT ID | AA ID | NT LN | AA LN | Score | P-Value |
|---|---|---|---|---|---|---|
| AI7503000997__42500__f1__24 | 2774 | 6546 | 159 | 52 | | |

| Description | | | | | | |
|---|---|---|---|---|---|---|
| NO-HIT | | | | | | |
| ORF Name | NT ID | AA ID | NT LN | AA LN | Score | P-Value |
| AI7503000997__4459380__f1__84 | 2775 | 6547 | 207 | 68 | | |

| Description | | | | | | |
|---|---|---|---|---|---|---|
| NO-HIT | | | | | | |
| ORF Name | NT ID | AA ID | NT LN | AA LN | Score | P-Value |
| AI7503000997__44595905__c2__343 | 2776 | 6548 | 129 | 42 | | |

| Description | | | | | | |
|---|---|---|---|---|---|---|
| NO-HIT | | | | | | |
| ORF Name | NT ID | AA ID | NT LN | AA LN | Score | P-Value |
| AI7503000997__4486693__f2__92 | 2777 | 6549 | 804 | 267 | 976 | 2.8e-98 |

Description
gp: [GI:e324856:g2226002] [LN:SXY14043] [AC:Y14043] [PN:glucose-1-dehydrogenase] [GN:gdh] [OR:*Staphylococcus xylosus*] [DB:genpept-bct1] [DE:*Staphylococcus xylosus* glcU and gdh genes.] [LE:1222] [RE:2013] [DI:direct]

| ORF Name | NT ID | AA ID | NT LN | AA LN | Score | P-Value |
|---|---|---|---|---|---|---|
| AI7503000997__4491450__f2__150 | 2778 | 6550 | 873 | 290 | 310 | 1.0e-27 |

Description
gp: [GI:g4980827] [LN:AE001714] [AC:AE001714:AE000512] [PN:transcriptional regulator, RpiR family] [GN:TM0326] [OR:*Thermotoga maritima*] [DB:genpept-bct2] [DE:*Thermotoga maritima* section 26 of 136 of the complete -continued genome.] [NT:similar to SP:P46118 PID:881368 GB:U00096] [LE:3706] [RE:4548]
[DI:direct]

| ORF Name | NT ID | AA ID | NT LN | AA LN | Score | P-Value |
|---|---|---|---|---|---|---|
| AI7503000997_4547163_f1_48 | 2779 | 6551 | 699 | 232 | 741 | 2.2e−73 |

Description
sp: [LN:UREF_STAXY] [AC:P42876] [GN:UREF] [OR:*STAPHYLOCOCCUS XYLOSUS*]
[DE:UREASE ACCESSORY PROTEIN UREF] [SP:P42876] [DB:swissprot]
>gp: [GI:g511069] [LN:SXUREFG] [AC:Z35136] [PN:UreF] [OR:*Staphylococcus xylosus*] [DB:genpept-bct1] [DE:*S.xylosus* (C2a) UreF and UreG genes.]
[SP:P42876] [LE:79] [RE:648] [DI:direct]

| ORF Name | NT ID | AA ID | NT LN | AA LN | Score | P-Value |
|---|---|---|---|---|---|---|
| AI7503000997_4569012_f1_79 | 2780 | 6552 | 588 | 195 | | |

Description
NO-HIT

| ORF Name | NT ID | AA ID | NT LN | AA LN | Score | P-Value |
|---|---|---|---|---|---|---|
| AI7503000997_4720290_f2_145 | 2781 | 6553 | 138 | 45 | | |

Description
NO-HIT

| ORF Name | NT ID | AA ID | NT LN | AA LN | Score | P-Value |
|---|---|---|---|---|---|---|
| AI7503000997_4720928_f1_11 | 2782 | 6554 | 186 | 61 | | |

Description
NO-HIT

| ORF Name | NT ID | AA ID | NT LN | AA LN | Score | P-Value |
|---|---|---|---|---|---|---|
| AI7503000997_4726550_f2_143 | 2783 | 6555 | 177 | 58 | | |

Description
NO-HIT

| ORF Name | NT ID | AA ID | NT LN | AA LN | Score | P-Value |
|---|---|---|---|---|---|---|
| AI7503000997_4800202_c1_269 | 2784 | 6556 | 621 | 206 | 694 | 2.1e−68 |

Description
gp: [GI:g3955200] [LN:AF022796] [AC:AF022796] [PN:ModC] [GN:modC]
[OR:*Staphylococcus carnosus*] [DB genpept-bct2] [DE:*Staphylococcus carnosus* molybdenum cofactor biosynthetic genecluster, complete sequence.]
[NT:ATP-binding protein of the molybdate-specific ABC] [LE:1578] [RE:2186]
[DI:direct]

| ORF Name | NT ID | AA ID | NT LN | AA LN | Score | P-Value |
|---|---|---|---|---|---|---|
| AI7503000997_4804153_f1_33 | 2785 | 6557 | 690 | 229 | 618 | 2.4e−60 |

Description
gp: [GI:e1429636:g4756164] [LN:A67171] [AC:A67171] [FN:MOAC GENE]
[OR:*Staphylococcus carnosus*] [DB:genpept-pat] [DE:Sequence 11 from Patent
EP0805205.] [NT:unnamed protein product] [LE:1846] [RE:2331] [DI:complement]
>gp: [GI:g3955203] [LN:AF022796] [AC:AF022796] [PN:MoaC] [GN:moaC]
[OR:*Staphylococcus carnosus*] [DB:genpept-bct2] [DE:*Staphylococcus carnosus* molybdenum cofactor biosynthetic genecluster, complete sequence.]
[NT:protein similar to MoaC of *Escherichia coli*] [LE:4067] [RE:4552]
[DI:complement]

| ORF Name | NT ID | AA ID | NT LN | AA LN | Score | P-Value |
|---|---|---|---|---|---|---|
| AI7503000997_4876675_f2_122 | 2786 | 6558 | 399 | 132 | 430 | 2.0e−40 |

Description
sp: [LN:URE3_STAXY] [AC:P42875] [GN:UREA] [OR:*STAPHYLOCOCCUS XYLOSUS*]
[EC:3.5.1.5] [DE:UREASE GAMMA SUBUNIT, (UREA AMIDOHYDROLASE)] [SP:P42875]
[DB:swissprot] >pir: [LN:S38483] [AC:S38483] [PN:urease, 11K chain:urease
gamma chain] [CL:urease 11K chain:urease 11K chain homology]
[OR:*Staphylococcus xylosus*] [EC:3.5.1.5] [DB:pir2] >gp: [GI:g581787]
[LN:SXUREABC] [AC:X74600] [PN:urease gamma subunit] [GN:ureA]
[OR:*Staphylococcus xylosus*] [DB:genpept-bct1] [DE:*S.xylosus* gene for ureA, -continued ureB, and ureC genes for urease gamma,beta and alpha subunits.] [SP:P42875]
[LE:568] [RE:870] [DI:direct]

| ORF Name | NT ID | AA ID | NT LN | AA LN | Score | P-Value |
|---|---|---|---|---|---|---|
| AI7503000997__4884662__c3__367 | 2787 | 6559 | 1128 | 375 | 333 | 1.0e−32 |

Description
gp: [GI:e1393931:g4490992] [LN:5CE29] [AC:AL035707] [PN:putative salicylate
hydroxylase] [GN:5CE29.14c] [OR:*Streptomyces coelicolor*] [DB:genpept-bct1]
[DE:*Streptomyces coelicolor* cosmid E29.] [NT:5CE29.14c, possible salicylate
hydroxylase, len:] [LE:19076] [RE:20338] [DI:complement]

| ORF Name | NT ID | AA ID | NT LN | AA LN | Score | P-Value |
|---|---|---|---|---|---|---|
| AI7503000997__4976687__c1__281 | 2788 | 6560 | 924 | 307 | 232 | 1.9e−19 |

Description
gp: [GI:g4980727] [LN:AE001707] [AC:AE001707:AE000512] [PN:conserved
hypothetical protein] [GN:TM0229] [OR:*Thermotoga maritima*] [DB:genpept-bct2]
[DE:*Thermotoga maritima* section 19 of 136 of the complete genome.]
[NT:similar to GB:L77117 PID:1591686 percent identity:] [LE:5630] [RE:6487]
[DI:direct]

| ORF Name | NT ID | AA ID | NT LN | AA LN | Score | P-Value |
|---|---|---|---|---|---|---|
| AI7503000997__5082812__c2__310 | 2789 | 6561 | 135 | 44 | | |

Description
NO-HIT

| ORF Name | NT ID | AA ID | NT LN | AA LN | Score | P-Value |
|---|---|---|---|---|---|---|
| AI7503000997__5087556__c2__335 | 2790 | 6562 | 849 | 282 | 990 | 9.2e−100 |

Description
gp: [GI:e1429618:g4756158] [LN:A67171] [AC:A67171] [FN:MOEB GENE]
[OR:*Staphylococcus carnosus*] [DB:genpept-pat] [DE:Sequence 11 from Patent
EP0805205.] [NT:unnamed protein product] [LE:117] [RE:1118] [DI:direct]
>gp: [GI:g3955201] [LN:AF022796] [AC:AF022796] [PN:MoeB] [GN:moeB]
[OR:*Staphylococcus carnosus*] [DB:genpept-bct2] [DE:*Staphylococcus carnosus*
molybdenum cofactor biosynthetic genecluster, complete sequence.]
[NT:protein similar to the molybdopterin synthase] [LE:2338] [RE:3339]
[DI:direct]

| ORF Name | NT ID | AA ID | NT LN | AA LN | Score | P-Value |
|---|---|---|---|---|---|---|
| AI7503000997__5113550__f2__149 | 2791 | 6563 | 1089 | 362 | 269 | 2.3e−23 |

Description
pir: [LN:C70217] [AC:C70217] [PN:outer surface protein homolog] [OR:*Borrelia
burgdorferi*] [SR:, Lyme disease spirochete] [DB:pir2] >gp: [GI:g2689897]
[LN:AE000792] [AC:AE000792] [PN:outer surface protein, putative] [GN:BBB07]
[OR:*Borrelia burgdorferi*] [SR:Lyme disease spirochete] [DB:genpept-bct2]
[DE:*Borrelia burgdorferi* plasmid cp26, complete plasmid sequence.]
[NT:similar to GB:M88764 SP:Q09090 PID:469166] [LE:4769] [RE:5866]
[DI:direct]

| ORF Name | NT ID | AA ID | NT LN | AA LN | Score | P-Value |
|---|---|---|---|---|---|---|
| AI7503000997__5266018__f2__160 | 2792 | 6564 | 771 | 256 | 415 | 7.8e−39 |

Description
sp: [LN:YFIA_BACSU] [AC:P54717] [GN:YFIA] [OR:*BACILLUS SUBTILIS*]
[DE:HYPOTHETICAL 29.3 KD PROTEIN IN GLVG-GLVBC INTERGENIC REGION]
[SP:P54717] [DB:swissprot] >pir: [LN:D69802] [AC:D69802] [PN:conserved
hypothetical protein yfiA] [GN:yfiA] [OR:*Bacillus subtilis*] [DB:pir2]
>gp: [GI:e1182809:g2633143] [LN:BSUB0005] [AC:Z99108:AL009126] [GN:yfiA]
[FN:unknown] [OR:*Bacillus subtilis*] [DB:genpept-bct1] [DE:*Bacillus subtilis*
complete genome (section 5 of 21): from 802821 to1011250.] [NT:similar to
hypothetical proteins] [SP:P54717] [LE:88122] [RE:88886] [DI:direct]
>gp: [GI:d1009739:g1486242] [LN:D50543] [AC:D50543] [PN:unknown] [GN:yfiA]
[FN:unknown] [OR:*Bacillus subtilis*] [SR:*Bacillus subtilis* (strain:168,
haplotype:haploid) DNA] [DB:genpept-bct1] [DE:*Bacillus subtilis* DNA for
76-degree region, complete cds.] [LE:1798] [RE:2562] [DI:direct]

| ORF Name | NT ID | AA ID | NT LN | AA LN | Score | P-Value |
|---|---|---|---|---|---|---|

| | | | | | | |
|---|---|---|---|---|---|---|
| -continued | | | | | | |
| AI7503000997_5898328_f2_91 | 2793 | 6565 | 864 | 287 | 1102 | 1.2e−111 |

Description
gp: [GI:e324855:g2226001] [LN:SXY14043] [AC:Y14043] [PN:glucose uptake protein] [GN:glcU] [OR:*Staphylococcus xylosus*] [DB:genpept-bct1] [DE:*Staphylococcus xylosus* glcU and gdh genes.] [LE:306] [RE:1172] [DI:direct]

| ORF Name | NT ID | AA ID | NT LN | AA LN | Score | P-Value |
|---|---|---|---|---|---|---|
| AI7503000997_6050010_c3_404 | 2794 | 6566 | 129 | 42 | | |

Description
NO-HIT

| ORF Name | NT ID | AA ID | NT LN | AA LN | Score | P-Value |
|---|---|---|---|---|---|---|
| AI7503000997_6757755_f2_121 | 2795 | 6567 | 171 | 56 | | |

Description
NO-HIT

| ORF Name | NT ID | AA ID | NT LN | AA LN | Score | P-Value |
|---|---|---|---|---|---|---|
| AI7503000997_6929676_c1_255 | 2796 | 6568 | 342 | 113 | | |

Description
NO-HIT

| ORF Name | NT ID | AA ID | NT LN | AA LN | Score | P-Value |
|---|---|---|---|---|---|---|
| AI7503000997_7031318_f2_153 | 2797 | 6569 | 339 | 112 | | |

Description
NO-HIT

| ORF Name | NT ID | AA ID | NT LN | AA LN | Score | P-Value |
|---|---|---|---|---|---|---|
| AI7503000997_7086677_c3_364 | 2798 | 6570 | 243 | 80 | 78 | 0.019 |

Description
sp: [LN:LY4F_MOUSE] [AC:Q60653] [GN:LY49F:LY-49F:LY49-F] [OR:*MUS MUSCULUS*] [SR:,MOUSE] [DE:T-CELL SURFACE GLYCOPROTEIN LY-49F (LY-49-F ANTIGEN)] [SP:Q60653] [DB:swissprot] >pir: [LN:149051] [AC:149051] [PN:Ly-49F-GE antigen] [OR:*Mus musculus*] [SR:, house mouse] [DB:pir2] >gp: [GI:g533492] [LN:MMU10092] [AC:U10092] [PN:Ly-49F-GE antigen] [OR:*Mus musculus*] [SR:house mouse] (DB:genpept-rod] [DE:*Mus musculus* C57BL/6 Ly-49F-GE antigen mRNA, complete cds.] [LE:81] [RE:881] [DI:direct]

| ORF Name | NT ID | AA ID | NT LN | AA LN | Score | P-Value |
|---|---|---|---|---|---|---|
| AI7503000997_818812_c2_337 | 2799 | 6571 | 1287 | 428 | 1560 | 3.6e−160 |

Description
gp: [GI:e1429624:g4756160] [LN:A67171] [AC:A67171] [FN:MOEA GENE] [OR:*Staphylococcus carnosus*] [DB:genpept-pat] [DE:Sequence 11 from Patent EP0805205.] [NT:unnamed protein product] [LE:2396] [RE:3655] [DI:direct] >gp: [GI:g3955204] [LN:AF022796] [AC:AF022796] [PN:MoeA] [GN:moeA] [OR:*Staphylococcus carnosus*] [DB genpept-bct2] [DE:*Staphylococcus carnosus* molybdenum cofactor biosynthetic genecluster, complete sequence.] [NT:protein similar to MoeA of *Escherichia coli*] [LE:4617] [RE:5876] [DI:direct]

| ORF Name | NT ID | AA ID | NT LN | AA LN | Score | P-Value |
|---|---|---|---|---|---|---|
| AI7503000997_829761_c1_288 | 2800 | 6572 | 2172 | 723 | 1751 | 2.1e−180 |

Description
pir: [LN:H69724] [AC:H69724] [PN:DNA topoisomerase III topB] [GN:topB] [OR:*Bacillus subtilis*] [DB:pir2] >gp: [GI:d1020016:g1881236] [LN:AB001488] [AC:AB001488] [PN:PROBABLE DNA TOPOISOMERASE III] [GN:topB] [OR:*Bacillus subtilis*] [SR:*Bacillus subtilis* (strain:168) DNA] [DB:genpept-bct1] [EC:5.99.1.2] [DE:*Bacillus subtilis* genome sequence, 148 kb sequence of the regionbetween 35 and 47 degree.] [LE:9617] [RE:11800] [DI:direct] >gp: [GI:e1182392:g2632726] [LN:BSUB0003] [AC:Z99106:AL009126] [PN:DNA topoisomerase III] [GN:topB] [OR:*Bacillus subtilis*] [DB:genpept-bct1] [EC:5.99.1.2] [DE:*Bacillus subtilis* complete genome (section 3 of 21): from 402751 to611850.] [LE:73361] [RE:75544] [DI:direct]

-continued

| ORF Name | NT ID | AA ID | NT LN | AA LN | Score | P-Value |
|---|---|---|---|---|---|---|
| AI7503000997_834686_c2_290 | 2801 | 6573 | 132 | 43 | | |

Description
NO-HIT

| ORF Name | NT ID | AA ID | NT LN | AA LN | Score | P-Value |
|---|---|---|---|---|---|---|
| AI7503000997_959427_f1_62 | 2802 | 6574 | 417 | 138 | 241 | 2.2e−20 |

Description
gp: [GI:g2735506] [LN:5CU96107] [AC:U96107] [PN:SceB precursor] [GN:sceB]
[OR:*Staphylococcus carnosus*] [DB:genpept-bct2] [DE:*Staphylococcus carnosus*
N5,N10-methylenetetrahydromethanopterinreductase homolog, SceB precursor
(sceB) and putative transmembraneprotein genes, complete cds, and putative
Na+/H+ antiporter NhaC(nhaC) gene, partial cds.] [NT:major secreted protein]
[LE:1894] [RE:2685] [DI:direct]

| ORF Name | NT ID | AA ID | NT LN | AA LN | Score | P-Value |
|---|---|---|---|---|---|---|
| AI7503000997_964077_c1_275 | 2803 | 6575 | 453 | 150 | 659 | 1.1e−64 |

Description
gp: [GI:g3955206] [LN:AF022796] [AC:AF022796] [PN:MoaE] [GN:moaE]
[OR:*Staphylococcus carnosus*] [DB:genpept-bct2] [DE:*Staphylococcus carnosus*
molybdenum cofactor biosynthetic genecluster, complete sequence.]
ENT:protein similar to MoaE of *Escherichia coli*] [LE:6352] [RE:6804]
[DI:direct]

| ORF Name | NT ID | AA ID | NT LN | AA LN | Score | P-Value |
|---|---|---|---|---|---|---|
| AI7503000997_975061_c3_377 | 2804 | 6576 | 1455 | 484 | 916 | 6.4e−92 |

Description
sp: [LN:YB07_HAEIN] [AC:Q57007:P96339] [GN:H11107] [OR:*HAEMOPHILUS
INFLUENZAE*] [DE:HYPOTHETICAL NA+/H+ ANTIPORTER H11107] [SP:Q57007:P96339]
[DB:swissprot] >pir: [LN:I64182] [AC:I64182] [PN:Na+/H+-exchanging protein
homolog:Na+/H+ antiporter] [CL:Na+/H+-exchanging protein] [OR:*Haemophilus
influenzae*] [DB:pir2] >gp: [GI:g1574661] [LN:U32790] [AC:U32790:L42023]
[PN:Na+/H+ antiporter (nhaC)] [GN:H11107] [OR:*Haemophilus influenzae* Rd]
[DB:genpept-bct2] [DE:*Haemophilus influenzae* Rd section 105 of 163 of the
completegenome.] [NT:similar to GB:M73530 SP:P27611 PID:143245] [LE:7526]
[RE: 8932] [DI:complement]

| ORF Name | NT ID | AA ID | NT LN | AA LN | Score | P-Value |
|---|---|---|---|---|---|---|
| AI7503000997_9845631_f3_222 | 2805 | 6577 | 156 | 51 | | |

Description
NO-HIT

| ORF Name | NT ID | AA ID | NT LN | AA LN | Score | P-Value |
|---|---|---|---|---|---|---|
| AI7503000997_9928188_f1_39 | 2806 | 6578 | 132 | 43 | 95 | 0.00025 |

Description
sp: [LN:NARQ_BACSU] [AC:P39756] [GN:NARQ:NARAA] [OR:*BACILLUS SUBTILIS*]
[DE:NARQ PROTEIN] [SP:P39756] [DB:swissprot] >pir: [LN:B69665] [AC:B69665]
[PN:required for formate dehydrogenase activity narQ] [GN:narQ]
[OR:*Bacillus subtilis*] [DB:pir2] >gp: [GI:e276834:g1648855] [LN:BSATPC]
[AC:Z81356] [PN:unknown] [GN:narQ] [OR:*Bacillus subtilis*] [DB:genpept-bct1]
[DE:*B.subtilis* atpC gene.] [SP:P39756] [LE:7048] [RE:7836] [DI:direct]
>gp: [GI:g580895] [LN:BSNAPAAB] [AC:Z352773 [PN:unknown] [GN:narAA]
[OR:*Bacillus subtilis*] [DB:genpept-bct1] [DE:*B.subtilis* (168) narA gene.]
[SP:P39756] [LE:490] [RE:1278] [DI:direct] >gp: [GI:e1184577:g2636196]
[LN:BSUB0019] [AC:Z99122:AL009126] [GN:narQ] [FN:required for formate
dehydrogenase activity] [OR:*Bacillus subtilis*] [DB:genpept-bct1]
[DE:*Bacillus subtilis* complete genome (section 19 of 21): from 3597091to
3809700.] [NT:alternate gene name: narAA] [SP:P39756] [LE:175331]
[RE:176119] [DI:complement] >gp: [GI:e1184577:g2636196] [LN:BSUB0019]
[AC:Z99122:AL009126] [GN:narQ] [FN:required for formate dehydrogenase
activity] [OR:*Bacillus subtilis*] EDB:genpept] [DE:*Bacillus subtilis* complete
genome (section 19 of 21): from 3597091to 3809700.] [NT:alternate gene name:
narAA] [SP:P39756] [LE:175331] [RE:176119] [DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000997_9928500_c1_270 | 2807 | 6579 | 261 | 86 | 286 | 3.7e−25 |

Description
gp: [GI:e1429618:g4756158] [LN:A67171] [AC:A67171] [FN:MOEB GENE]
[OR:*Staphylococcus carnosus*] [DB:genpept-pat] [DE:Sequence 11 from Patent
EP0805205.] [NT:unnamed protein product] [LE:117] [RE:1118] [DI:direct]
>gp: [GI:g3955201] [LN:AF022796] [AC:AF022796] [PN:MoeB] [GN:moeB]
[OR:*Staphylococcus carnosus*] [DB:genpept-bct2] [DE:*Staphylococcus carnosus*
molybdenum cofactor biosynthetic genecluster, complete sequence.]
[NT:protein similar to the molybdopterin synthase] [LE:2338] [RE:3339]
[DI:direct]

| ORF Name | NT ID | AA ID | NT LN | AA LN | Score | P-Value |
|---|---|---|---|---|---|---|
| AI7503000997_9977318_f1_75 | 2808 | 6580 | 1437 | 478 | 700 | 4.9e−69 |

Description
pir: [LN:D65017] [AC:D65017] [PN:hypothetical protein b2429]
[CL:phosphotransferase system sucrose-specific enzyme II, factor II]
[OR:*Escherichia coli*] [DB:pir2] >gp: [GI:d1017042:g1799859] [LN:D90872]
[AC:D90872:AB001340] [PN:PTS SYSTEM, SUCROSE-SPECIFIC IIBC COMPONENT]
[GN:IPA-49D] [OR:*Escherichia coli*] [SR:*Escherichia coli* (strain:K12) DNA,
clone_lib:Kohara lambda minise] [DB:genpept-bct1] [DE:*E.coli* genomic DNA,
Kohara clone #419(54.7–55.1 min.).] [NT:similar to [SwissProt Accession
Number P05306] ] [LE:9801] [RE:11225] [DI:direct] >gp: [GI:d1017045:g1799863]
[LN:D90873] [AC:D90873:AB001340] [PN:PTS SYSTEM, SUCROSE-SPECIFIC IIBC
COMPONENT] [GN:IPA-49D] [OR:*Escherichia coli*] [SR:*Escherichia coli*
(strain:K12) DNA, clone_lib:Kohara lambda minise] [DB:genpept-bct1]
[DE:*E.coli* genomic DNA, Kohara clone #420(54.9–55.2 min.).] [NT:similar to
[SwissProt Accession Number P05306] ] [LE:611] [RE:2035] [DI:direct]
>gp: [GI:g1788769] [LN:AE000330] [AC:AE000330:U00096] [PN:putative PTS enzyme
II] [GN:b2429] [FN:putative enzyme; Not classified] [OR:*Escherichia coli*]
[DB:genpept-bct2] [DE:*Escherichia coli* K-12 MG1655 section 220 of 400 of the
completegenome.] [NT:o474; 33 pct identical (29 gaps) to 436 residues]
[LE:5237] [RE:6661] [DI:direct]

| ORF Name | NT ID | AA ID | NT LN | AA LN | Score | P-Value |
|---|---|---|---|---|---|---|
| AI7503000998_10159760_f1_50 | 2809 | 6581 | 156 | 51 | | |

Description
NO-HIT

| ORF Name | NT ID | AA ID | NT LN | AA LN | Score | P-Value |
|---|---|---|---|---|---|---|
| AI7503000998_10312805_f3_197 | 2810 | 6582 | 144 | 47 | | |

Description
NO-HIT

| ORF Name | NT ID | AA ID | NT LN | AA LN | Score | P-Value |
|---|---|---|---|---|---|---|
| AI7503000998_10646950_c1_238 | 2811 | 6583 | 1221 | 406 | 1151 | 8.0e−117 |

Description
pir: [LN:A69974] [AC:A69974] [PN:cystathionine gamma-synthase homolog yrhB]
[GN:yrhB] [CL:O-succinylhomoserine (thiol)-lyase] [OR:*Bacillus subtilis*]
[DB:pir2] >gp: [GI:g1934606] [LN:BSU93874] [AC:U93874] [PN:cystathionine
gamma-lyase] [GN:yrhB] [OR:*Bacillus subtilis*] [DB:genpept-bct1] [DE:*Bacillus
subtilis* cysteine synthase (yrhA), cystathioninegamma-lyase (yrhB), YrhC
(yrhC), YrhD (yrhD), formate dehydrogenasechain A (yrhE), YrhF (yrhF),
formate dehydrogenase (yrhG), YrhH(yrhH), regulatory protein (yrhI),
cytochrome P450 102 (yrhJ), YrhK(yrhK), hypothetical protein YrhL (yrhL),
putative anti-SigV factor(yrhM), RNA polymerase sigma factor SigV (sigV) and
YrhO (yrhO)genes, complete cds, and YrhP (yrhP) gene, partial cds.]
[NT:similar to *Rattus norvegicus* cystathionine] [LE:986] [RE:2125]
[DI:direct] >gp: [GI:e1183955:g2635171] [LN:BSUB0014] [AC:Z99117:AL009126]
[GN:yrhB] [FN:unknown] [OR:*Bacillus subtilis*] [DB:genpept-bct1] [DE:*Bacillus
subtilis* complete genome (section 14 of 21): from 2599451to 2812870.]
[NT:similar to cystathionine gamma-synthase] [LE:184821] [RE:185960]
[DI:complement]

| ORF Name | NT ID | AA ID | NT LN | AA LN | Score | P-Value |
|---|---|---|---|---|---|---|
| AI7503000998_10723177_f1_59 | 2812 | 6584 | 255 | 84 | | |

Description
NO-HIT

-continued

| ORF Name | NT ID | AA ID | NT LN | AA LN | Score | P-Value |
|---|---|---|---|---|---|---|
| AI7303000998__11213532__c3__351 | 2813 | 6585 | 246 | 81 | 90 | 0.00022 |

Description
gp: [GI:g208931] [LN:SYNORFLAC] [AC:M15619] [OR:synthetic construct]
[SR:*E.coli* (strain SE5000) synthetic DNA, clone pKB1] [DB:genpept-syn]
[DE:Synthetic *E.coli* ORF16/lacZ fusion protein, partial cds.] [NT:ORF16-lacZ
fusion protein] [LE:29] [RE:>232] [DI:direct]

| ORF Name | NT ID | AA ID | NT LN | AA LN | Score | P-Value |
|---|---|---|---|---|---|---|
| AI7503000998__1178785__c3__323 | 2814 | 6586 | 939 | 312 | 731 | 2.6e−72 |

Description
pir: [LN:H69973] [AC:H69973] [PN:cysteine synthase homolog yrhA] [GN:yrhA]
[CL:threonine dehydratase] [OR:*Bacillus subtilis*] [DB:pir2]
>gp: [GI:g1934605] [LN:BSU93874] [AC:U93874] [PN:cysteine synthase] [GN:yrhA]
[OR:*Bacillus subtilis*] [DB:genpept-bct1] [DE:*Bacillus subtilis* cysteine
synthase (yrhA), cystathioninegamma-lyase (yrhB), YrhC (yrhC), YrhD (yrhD),
formate dehydrogenasechain A (yrhE), YrhF (yrhF), formate dehydrogenase
(yrhG), YrhH(yrhH), regulatory protein (yrhI), cytochrome P450 102 (yrhJ),
YrhK(yrhK), hypothetical protein YrhL (yrhL), putative anti-SigV
factor(yrhM), RNA polymerase sigma factor SigV (sigV) and YrhO (yrhO)genes,
complete cds, and YrhP (yrhP) gene, partial cds.] [NT:similar to cysteine
synthase from Spinacia] [LE:61] [RE:984] [DI:direct]
>gp: [GI:e1183956:g2635172] [LN:BSUB0014] [AC:Z99117:AL009126] [GN:yrhA]
[FN:unknown] [OR:*Bacillus subtilis*] [DB:genpept-bct1] [DE:*Bacillus subtilis*
complete genome (section 14 of 21): from 2599451to 2812870.] [NT:similar to
cysteine synthase] [LE:185962] [RE:186885] [DI:complement]

| ORF Name | NT ID | AA ID | NT LN | AA LN | Score | P-Value |
|---|---|---|---|---|---|---|
| AI7503000998__11931540__f2__96 | 2815 | 6587 | 825 | 274 | 786 | 3.8e−78 |

Description
sp: [LN:YLAC_STAXY] [AC:O33812] [OR:*STAPHYLOCOCCUS XYLOSUS*] [DE:HYPOTHETICAL
TRANSCRIPTIONAL REGULATOR IN LACR 5'REGION (FRAGMENT)] [SP:O33812]
[DB:swissprot] >gp: [G1:e352090:g2462703] [LN:SXLACRPH] [AC:Y14599]
[PN:transcriptional regulator from the LysR-type] [OR:*Staphylococcus
xylosus*] [DB:genpept-bct1] [DE:*Staphylococcus xylosus* lacR, lacP, lacH genes
and 2 ORF's.] [NT:ORF1] [SP:O33812] [LE:<1] [RE:814] [DI:direct]

| ORF Name | NT ID | AA ID | NT LN | AA LN | Score | P-Value |
|---|---|---|---|---|---|---|
| AI7503000998__1256387__c2__297 | 2816 | 6588 | 129 | 42 | | |

Description
NO-HIT

| ORF Name | NT ID | AA ID | NT LN | AA LN | Score | P-Value |
|---|---|---|---|---|---|---|
| AI7503000998__12603166__f2__86 | 2817 | 6589 | 303 | 100 | 100 | 1.9e−05 |

Description
pir: [LN:G71244] [AC:G71244] [PN:hypothetical protein PH0217] [GN:PH0217]
[OR:*Pyrococcus horikoshii*] [DB:pir2] >gp: [GI:d1030229:g3256603]
[LN:AP000001]
[AC:AP000001:AB009465:AB009464:AB009466:AB009467:AB009468:AB009469]
[PN: 106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1–287000 nt. position (1/7).] [LE:191072]
[RE:191392] [DI complement]

| ORF Name | NT ID | AA ID | NT LN | AA LN | Score | P-Value |
|---|---|---|---|---|---|---|
| AI7503000998__126068__f1__46 | 2818 | 6590 | 555 | 184 | 164 | 3.4e−11 |

Description
pir: [LN:A71661] [AC:A71661] [PN:hypothetical protein RP563] [GN:RP563]
[OR:*Rickettsia prowazekii*] [DB:pir2] >gp: [GI:e1342855:g3861111] [LN:RPXX03]
[AC:AJ235272:AJ235269] [PN:unknown] [GN:RP563] [OR:*Rickettsia prowazekii*]
[DB:genpept-bct1] [DE:*Rickettsia prowazekii* strain Madrid E, complete
genome; segment3/4.] [LE:110476] [RE:112242] [DI:direct]

| ORF Name | NT ID | AA ID | NT LN | AA LN | Score | P-Value |
|---|---|---|---|---|---|---|
| AI7503000998__13089052__f3__214 | 2819 | 6591 | 123 | 40 | | |

-continued

| Description |
|---|
| NO-HIT |

| ORF Name | NT ID | AA ID | NT LN | AA LN | Score | P-Value |
|---|---|---|---|---|---|---|
| AI7503000998_13678300_c2_267 | 2820 | 6592 | 1233 | 410 | 1393 | 1.8e−142 |

Description
pir: [LN:B69760] [AC:B69760] [PN:conserved hypothetical protein yciC]
[GN:yciC] [CL:conserved hypothetical protein yciC] [OR:*Bacillus subtilis*]
[DB:pir2] >gp: [GI:e1182288:g2632622] [LN:BSUB0002] [AC:Z99105:AL009126]
[GN:yciC] [FN:unknown] [OR:*Bacillus subtilis*] [DB:genpept-bct1] [DE:*Bacillus subtilis* complete genome (section 2 of 21): from 194651 to415810.]
[NT:similar to hypothetical proteins] [LE:170984] [RE:172177] [DI:direct]
>gp: [GI:d1009605:g1805408] [LN:D50453] [AC:D50453] [PN:homologues to nitrile
hydratase region] [GN:yciC] [OR:*Bacillus subtilis*] [SR:*Bacillus subtilis*
(strain:168 trpC2) DNA] [DB:genpept-bct1] [DE:*Bacillus subtilis* DNA for
25–36 degree region containing theamyE-srfA region, complete cds.]
[LE:45287] [RE:46480] [DI:direct]

| ORF Name | NT ID | AA ID | NT LN | AA LN | Score | P-Value |
|---|---|---|---|---|---|---|
| AI7503000998_13912712_c3_312 | 2821 | 6593 | 150 | 49 | 52 | 0.015 |

Description
sp: [LN:IMM1_ECOLI] [AC:P02985] [GN:IMM] [OR:*ESCHERICHIA COLI*] [DE:COLICIN E1
IMMUNITY PROTEIN (IMME1) (MICROCIN E1 IMMUNITY PROTEIN)] [SP:P02985]
[DB:swissprot] >gp: [GI:g455140] [LN:CE1CEA] [AC:M12543] [OR:Plasmid ColE1]
[SR:Plasmid ColE1 (a colicin-producing derivative strain from *E.col*]
[DB:genpept-bct1] [DE:Plasmid ColE1 cea (3' end), imm and lys genes
(complete cds) .] [NT:immunity protein] [LE:32] [RE:373] [DI:complement]

| ORF Name | NT ID | AA ID | NT LN | AA LN | Score | P-Value |
|---|---|---|---|---|---|---|
| AI7503000998_13923427_f3_196 | 2822 | 6594 | 135 | 44 | | |

| Description |
|---|
| NO-HIT |

| ORF Name | NT ID | AA ID | NT LN | AA LN | Score | P-Value |
|---|---|---|---|---|---|---|
| AI7503000998_14218805_c2_301 | 2823 | 6595 | 129 | 42 | 80 | 0.0095 |

Description
sp: [LN:TRER_BACSU] [AC:P39796] [GN:TRER] [OR:*BACILLUS SUBTILIS*]
[DE:TREHALOSE OPERON TRANSCRIPTIONAL REPRESSOR] [SP:P39796] [DB:swissprot]
>pir: [LN:JC5038] [AC:JC5038:567931:D69725:I40499:567866] [PN:transcription
repressor of trehalose operon treR] [GN:treR] [OR:*Bacillus subtilis*]
[DB:pir2] >gp: [GI:g1000453] [LN:BSTREAPR] [AC:Z54245] [PN:TreR] [GN:treR]
[FN:repressor of the trehalose operon] [OR:*Bacillus subtilis*]
[DB:genpept-bct1] [DE:*B.subtilis* treA, treP and treR genes.] [NT:position
3684 corresponds to position 2543 of] [SP:P39796] [LE:3352] [RE:4068]
[DI:direct] >gp: [GI:e1182772:g2633106] [LN:BSUB0005] [AC:Z99108:AL009126]
[PN:transcriptional regulator (GntR family)] [GN:treR] [FN:negative
regulation of the trehalose operon] [OR:*Bacillus subtilis*] [DB:genpept-bct1]
[DE:*Bacillus subtilis* complete genome (section 5 of 21): from 802821
to1011250.] [NT:alternate gene name: yfxA] [SP:P39796] [LE:50243] [RE:50959]
[DI:direct] >gp: [GI:d1024286:g2626829] [LN:D83967] [AC:D83967] [PN:TreR]
[OR:*Bacillus subtilis*] [SR:*Bacillus subtilis* (strain:AC327) DNA]
[DB:genpept-bct1] [DE:*Bacillus subtilis* genomic DNA, 74 degree region.]
[LE:16962] [RE:17678] [DI:complement]

| ORF Name | NT ID | AA ID | NT LN | AA LN | Score | P-Value |
|---|---|---|---|---|---|---|
| AI7503000998_14271068_f1_51 | 2824 | 6596 | 261 | 86 | 68 | 0.018 |

Description
sp: [LN:PROP_ECOLI] [AC:P30848] [GN:PROP] [OR:*ESCHERICHIA COLI*]
[DE:PROLINE/BETAINE TRANSPORTER (PROLINE PORTER II) (PPII)] [SP:P30848]
[DB:swissprot] >pir: [LN:532331] [AC:S32331:S56339:F65220]
[PN:proline/betaine transport protein:proline permease II:proline porter II]
[GN:proP] [CL:citrate utilization determinant] [OR:*Escherichia coli*]
[DB:pir2] [MP:93 min] >gp: [GI:g147357] [LN:ECOPROBETT] [AC:M83089] [PN:a
proline/betaine transporter] [GN:proP] [FN:active uptake of proline or
betaine] [OR:*Escherichia coli*] [DB:genpept-bct1] [DE:*E. coli* proline/betaine
transporter (proP) gene, complete cds.] [NT:Evidence that this open reading
frame encodes a] [LE:433] [RE:1935] [DI:direct] >gp: [GI:g536955]
[LN:ECOUW93] [AC:U14003] [GN:proP] [FN:active uptake of proline or betaine]
[OR:*Escherichia coli*] [DB:genpept-bct1] [DE:*Escherichia coli* K-12

-continued chromosomal region from 92.8 to 00.1 minutes.] [NT:CG Site No. 361]
[LE:21331] [RE:22833] [DI:direct] >gp: [GI:g1790550] [LN:AE000483]
[AC:AE000483:U00096] [PN:low-affinity transport system; proline permease]
[GN:proP] [FN:transport; Transport of small molecules: Amino]
[OR:*Escherichia coli*] [DB:genpept-bct2] [DE:*Escherichia coli* K-12 MG1655
section 373 of 400 of the completegenome.] [NT:o500; 100 pct identical to
PROP_ECOLI SW: P30848;] [LE:5301] [RE:6803] [DI:direct]

| ORF Name | NT ID | AA ID | NT LN | AA LN | Score | P-Value |
|---|---|---|---|---|---|---|
| AI7503000998_14460882_c1_217 | 2825 | 6597 | 1695 | 564 | 1304 | 4.9e−133 |

Description
gp: [GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1]
[DE:*Staphylococcus haemolyticus* IS1272 ORF1 and ORF2 genes, completecds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000998_14485686_c2_287 | 2826 | 6598 | 153 | 50 | | |

Description
NO-HIT

| ORF Name | NT ID | AA ID | NT LN | AA LN | Score | P-Value |
|---|---|---|---|---|---|---|
| AI7503000998_15022153_f1_73 | 2827 | 6599 | 189 | 62 | | |

Description
NO-HIT

| ORF Name | NT ID | AA ID | NT LN | AA LN | Score | P-Value |
|---|---|---|---|---|---|---|
| AI7503000998_15900305_f3_177 | 2828 | 6600 | 789 | 262 | 78 | 0.019 |

Description
gp: [GI:g453517] [LN:TETRRTRNA] [AC:L28677] [OR:Mitochondrion *Tetrahymena pyriformis*] [SR:Mitochondrion *Tetrahymena pyriformis* (strain ST, organell]
(DB:genpept-inv1] [DE:*Tetrahymena pyriformis* ribosomal RNA; tRNA-Trp; ORF
1–4; tRNA-Glu;cytochrome oxidase subunit 1; NADH dehydrogenase; ribosomal
proteinLl4.] [NT:ORF3] [LE:4384] [RE:4680] [DI:direct]

| ORF Name | NT ID | AA ID | NT LN | AA LN | Score | P-Value |
|---|---|---|---|---|---|---|
| AI7503000998_16196963_f2_133 | 2829 | 6601 | 192 | 63 | | |

Description
NO-HIT

| ORF Name | NT ID | AA ID | NT LN | AA LN | Score | P-Value |
|---|---|---|---|---|---|---|
| AI7503000998_16257665_f1_37 | 2830 | 6602 | 192 | 63 | | |

Description
NO-HIT

| ORF Name | NT ID | AA ID | NT LN | AA LN | Score | P-Value |
|---|---|---|---|---|---|---|
| AI7503000998_16281286_c3_322 | 2831 | 6603 | 1359 | 452 | 1059 | 4.5e−107 |

Description
pir: [LN:F69825] [AC:F69825] [PN:sodium-dependent transporter homolog yhdH]
[GN:yhdH] [CL:gamma-aminobutyric acid transporter] [OR:*Bacillus subtilis*]
[DB:pir2] >gp: [GI:e1182948:g2633282] [LN:BSUBQ0006] [AC:Z99109:AL009126]
[GN:yhdH] [FN:unknown] [OR:*Bacillus subtilis*] [DB:genpept-bct1] [DE:*Bacillus subtilis* complete genome (section 6 of 21): from 999501 to1209940.]
[NT:similar to sodium-dependent transporter] [LE:24845] [RE:26200]
[DI:direct] >gp: [GI:e1191879:g2226203] [LN:BSY14082] [AC:Y14082]
[PN:hypothetical protein] [GN:yhdH] [OR:*Bacillus subtilis*] [DB:genpept-bct1]
[DE:*Bacillus subtilis* chromosomal DNA, region 72 to 75 degrees: spoVRto
sspB.] [NT:Similarity to sodium dependent transporters;] [LE:11493]
[RE:12848] [DI:direct]

| ORF Name | NT ID | AA ID | NT LN | AA LN | Score | P-Value |
|---|---|---|---|---|---|---|
| AI7503000998_19712762_c3_347 | 2832 | 6604 | 600 | 199 | 813 | 5.2e−81 |

Description
sp: [LN:RECR_BACSU] [AC:P24277] [GN:RECR:RECM:RECD] [OR:*BACILLUS SUBTILIS*]

-continued

[DE:RECOMBINATION PROTEIN RECR] [SP:P24277] [DB:swissprot] >pir: [LN:B69691]
[AC:B69691:S13788:S66051] [PN:DNA repair and genetic recombination
recR:recM protein] [GN:recR] [CL:recR protein] [OR:*Bacillus subtilis*]
[DB:pir2] >gp: [GI:dl005799:g467411] [LN:BAC180K] [AC:D26185]
[PN:recombination protein] [GN:recR] [OR:*Bacillus subtilis*] [SR:*Bacillus
subtilis* (sub_species:Marburg, strain:168) DNA] [DB:genpept-bct1] [DE:*B.
subtilis* DNA, 180 kilobase region of replication origin.] [LE:92467]
[RE:93063] [DI:direct] >gp: [GI:g453239] [LN:BSRECM] [AC:X17014] [GN:recR]
[OR:*Bacillus subtilis*] [DB:genpept-bct1] [DE:*Bacillus subtilis* dnaZX and
recR genes and two unidentified readingframes.] [SP:P24277] [LE:2314]
[RE:2910] [DI:direct] >gp: [GI:e1181954:g2632288] [LN:BSUB0001]
[AC:Z99104:AL009126] [GN:recR] [FN:DNA repair and genetic recombination]
[OR:*Bacillus subtilis*] [DB:genpept-bct1] [DE:*Bacillus subtilis* complete
genome (section 1 of 21): from 1 to213080.] [NT:alternate gene name: recM]
[SP:P24277] [LE:28865] [RE:29461] [DI:direct]

| ORF Name | NT ID | AA ID | NT LN | AA LN | Score | P-Value |
|---|---|---|---|---|---|---|
| AI7503000998_19960162_c1_232 | 2833 | 6605 | 2631 | 876 | 1785 | 5.2e−184 |

Description
pir: [LN:E69745] [AC:E69745] [PN:hypothetical protein ybcD] [GN:ybcD]
[OR:*Bacillus subtilis*] [DB:pir2] >gp: [GI:e1182118:g2632452] [LN:BSUB0001]
[AC:Z99104:AL009126] [GN:ybcD] [FN:unknown] [OR:*Bacillus subtilis*]
[DB:genpept-bct1] [DE:*Bacillus subtilis* complete genome (section 1 of 21):
from 1 to213080.] [LE:207166] [RE:209430] [DI:direct]
>gp: [GI:e1182136:g2632470] [LN:BSUB0002] [AC:Z99105:AL009126] [GN:ybcD]
[FN:unknown] [OR:*Bacillus subtilis*] [DB:genpept-bct1] [DE:*Bacillus subtilis*
complete genome (section 2 of 21): from 194651 to415810.] [LE:12516]
[RE:14780] [DI:direct]

| ORF Name | NT ID | AA ID | NT LN | AA LN | Score | P-Value |
|---|---|---|---|---|---|---|
| AI7503000998_20093_c3_311 | 2834 | 6606 | 306 | 101 | | |

Description
NO-HIT

| ORF Name | NT ID | AA ID | NT LN | AA LN | Score | P-Value |
|---|---|---|---|---|---|---|
| AI7503000998_20314005_c3_335 | 2835 | 6607 | 4590 | 1529 | 4186 | 0.0 |

Description
sp: [LN:GLTB_BACSU] [AC:P39812] [GN:GLTB:GLTA] [OR:*BACILLUS SUBTILIS*]
[EC:1.4.1.13] [DE:GLUTAMATE SYNTHASE [NADPH] LARGE CHAIN, (NADPH-GOGAT)]
[SP:P39812] [DB:swissprot] >pir: [LN:G69634] [AC:G69634] [PN:glutamate
synthase (large subunit) gltA] [GN:gltA] [CL:glutamate synthase (NADPH)]
[OR:*Bacillus subtilis*] [DB:pir2] >gp: [GI:e1183503:g2634228] [LN:BSUB0010]
[AC:Z99113:AL009126] [PN:glutamate synthase (large subunit)] [GN:gltA]
[FN:glutamate biosynthesis] [OR:*Bacillus subtilis*] [DB:genpept-bct1]
[EC:1.4.1.13] [DE:*Bacillus subtilis* complete genome (section 10 of 21): from
1781201to 2014980.] [SP:P39812] [LE:228126] [RE:232688] [DI:complement]
>gp: [GI:e1185318:g2634239] [LN:BSUB0011] [AC:Z99114:AL009126] [PN:glutamate
synthase (large subunit)] [GN:gltA] [FN:glutamate biosynthesis] [OR:*Bacillus
subtilis*] [DB:genpept-bct1] [EC:1.4.1.13] [DE:*Bacillus subtilis* complete
genome (section 11 of 21): from 2000171to 2207900.] [SP:P39812] [LE:9156]
[RE:13718] [DI: complement]

| ORF Name | NT ID | AA ID | NT LN | AA LN | Score | P-Value |
|---|---|---|---|---|---|---|
| AI7503000998_203886_f2_137 | 2836 | 6608 | 159 | 52 | 116 | 2.8e−06 |

Description
gp: [GI:g2689564] [LN:U93688] [AC:U93688] [PN:integrase] [GN:int]
[OR:*Staphylococcus aureus*] [DB:genpept-bct2] [DE:*Staphylococcus aureus* toxic
shock syndrome toxin-1 (tst) ,enterotoxin (ent), and integrase (int) genes,
complete cds.] [NT:similar to staphylococcal phage integrase] [LE:13871]
[RE:15091] [DI:direct]

| ORF Name | NT ID | AA ID | NT LN | AA LN | Score | P-Value |
|---|---|---|---|---|---|---|
| AI7503000998_20602262_c2_303 | 2837 | 6609 | 543 | 180 | 105 | 0.00015 |

Description
sp: [LN:YHBS_ECOLI] [AC:P45473] [GN:YHBS] [OR:*ESCHERICHIA COLI*]
[DE:HYPOTHETICAL 18.5 KD PROTEIN IN SOHA-MTR INTERGENIC REGION (F167)]
[SP:P45473] [DB:swissprot] >pir: [LN:H65105] [AC:H65105] [PN:hypothetical
protein b3156] [OR:*Escherichia coli*] [DB:pir2] >gp: [GI:g606096] [LN:ECOUW67]
[AC:U18997] [OR:*Escherichia coli*] [DB:genpept-bct1] [DE:*Escherichia coli*

-continued

K-12 chromosomal region from 67.4 to 76.0 minutes.] [NT:ORF_f167; end overlaps end of o100 by 14 bases;] [LE:81007] [RE:81510] [DI:complement] >gp: [GI:g1789546] [LN:AE000396] [AC:AE000396:U00096] [PN:orf, hypothetical protein] [GN:yhbS] [FN:orf; Unknown] [OR:*Escherichia coli*] [DB:genpept-bct2] [DE:*Escherichia coli* K-12 MG1655 section 286 of 400 of the completegenome.] [NT:f167; f167; end overlaps end of 0100 by 14] [LE:6918] [RE:7421] [DI:complement]

| ORF Name | NT ID | AA ID | NT LN | AA LN | Score | P-Value |
|---|---|---|---|---|---|---|
| AI7503000998_20602263_c2_270 | 2838 | 6610 | 1512 | 503 | 1414 | 1.1e−144 |

Description
sp: [LN:NDHF_BACSU] [AC:P39755] [GN:NDHF] [OR:*BACILLUS SUBTILIS*] [EC:1.6.5.3] [DE:OXIDOREDUCTASE CHAIN 5)] [SP:P39755] [DB:swissprot] >pir: [LN:C69666] [AC:C69666] [PN:NADH dehydrogenase (subunit 5) ndhF] [GN:ndhF] [OR:*Bacillus subtilis*] [DB:pir2] >gp: [GI:d1034042:g3599601] [LN:AB006424] [AC:AB006424] [PN:NADH DEHYDROGENASE SUBUNIT 5] [GN:ndhF] [OR:*Bacillus subtilis*] [SR:*Bacillus subtilis* (strain:168) DNA] [DB:genpept-bct1] [DE:*Bacillus subtilis* genomic DNA, 70 kb region between 17 and 23degree.] [LE:8378] [RE:9895] [DI:direct] >gp: [GI:g903587] [LN:BSU28323] [AC:U28323] [PN:NADH dehydrogenase subunit 5] [GN:ndhF] [OR:*Bacillus subtilis*] [DB:genpept-bct1] [DE:*Bacillus subtilis* NADH dehydrogenase subunit 5 (ndhF) gene,complete cds.] [LE:519] [RE:2036] [DI:direct] >gp: [GI:e1182116:g2632450] [LN:BSUB0001] [AC:Z99104:AL009126] [PN:NADH dehydrogenase (subunit 5)] [GN:ndhF] [OR:*Bacillus subtilis*] [DB:genpept-bct1] [EC:1.6.5.3] [DE:*Bacillus subtilis* complete genome (section 1 of 21): from 1 to213080.] [NT:alternate gene name: ybxE] [SP:P39755] [LE:205395] [RE:206912] [DI:direct] >gp: [GI:e1182134:g2632468] [LN:BSUB0002] [AC:Z99105:AL009126] [PN:NADH dehydrogenase (subunit 5)] [GN:ndhF] [OR:*Bacillus subtilis*] [DB:genpept-bct1] [EC:1.6.5.3] [DE:*Bacillus subtilis* complete genome (section 2 of 21): from 194651 to415810.] [NT:alternate gene name: ybxE] [SP:P39755] [LE:10745] [RE:12262] [DI:direct]

| ORF Name | NT ID | AA ID | NT LN | AA LN | Score | P-Value |
|---|---|---|---|---|---|---|
| AI7503000998_2142316_f3_207 | 2839 | 6611 | 213 | 70 | 52 | 0.040 |

Description
gp: [GI:e1287275:g3063696] [LN:ATF4D11] [AC:AL022537] [PN:putative protein] [GN:F4D11.60] [OR:*Arabidopsis thaliana*] [SR:thale cress] [DB:genpept-pln1] [DE:*Arabidopsis thaliana* DNA chromosome 4, BAC clone F4D11 (ESSAIIproject) .] [NT:contains EST gb:W43721] [LE:21418:21729:22060] [RE:21537:22004:22174] (DI:complementJoin]

| ORF Name | NT ID | AA ID | NT LN | AA LN | Score | P-Value |
|---|---|---|---|---|---|---|
| AI7503000998_21516287_f1_2 | 2840 | 6612 | 126 | 41 | | |

Description
NO-HIT

| ORF Name | NT ID | AA ID | NT LN | AA LN | Score | P-Value |
|---|---|---|---|---|---|---|
| AI7503000998_2195338_c3_342 | 2841 | 6613 | 165 | 54 | | |

Description
NO-HIT

| ORF Name | NT ID | AA ID | NT LN | AA LN | Score | P-Value |
|---|---|---|---|---|---|---|
| AI7503000998_22305342_f3_205 | 2842 | 6614 | 543 | 180 | 162 | 8.7e−11 |

Description
gp: [GI:g4019275] [LN:AF083424] [AC:AF083424] [OR:*Ateline herpesvirus* 3] [DB:genpept-vrl] [DE:*Ateline herpesvirus* 3 complete genome.] [NT:orf 48] [LE:62159] [RE:64537] [DI:complement]

| ORF Name | NT ID | AA ID | NT LN | AA LN | Score | P-Value |
|---|---|---|---|---|---|---|
| AI7503000998_22437751_c3_307 | 2843 | 6615 | 489 | 162 | 160 | 5.5e−11 |

Description
pir: [LN:T03492] [AC:T03492] [PN:hypothetical protein] [OR:*Rhodobacter capsulatus*] [DB:pir2] [MP:1] >gp: [GI:g3128293] [LN:AF010496] [AC:AF010496] [PN:hypothetical protein] [OR:*Rhodobacter capsulatus*] [DB:genpept-bct2] [DE:*Rhodobacter capsulatus* strain SB1003, partial genome.] [LE:54291] [RE:55613] [DI:complement]

-continued

| ORF Name | NT ID | AA ID | NT LN | AA LN | Score | P-Value |
|---|---|---|---|---|---|---|
| AI7503000998_22459802_f2_135 | 2844 | 6616 | 156 | 51 | 117 | 1.0e−06 |

Description
gp: [GI:g1022726] [LN:SHU35635] [AC:U35635] [PN:unknown] [OR:*Staphylococcus haemolyticus*] [SR:*Staphylococcus haemolyticus* strain = Y176] [DB:genpept-bct1] [DE:*Staphylococcus haemolyticus* IS1272 ORF1 and ORF2 genes, completecds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000998_22688428_c3_348 | 2845 | 6617 | 144 | 47 | | |

Description
NO-HIT

| ORF Name | NT ID | AA ID | NT LN | AA LN | Score | P-Value |
|---|---|---|---|---|---|---|
| AI7503000998_23484678_c2_304 | 2846 | 6618 | 1731 | 576 | 1263 | 1.1e−128 |

Description
pir: [LN:S13786] [AC:S13786:S00745:S66049:B69618] [PN:DNA-directed DNA polymerase, III chain dnaX:DNA polymerase III (gamma and tau subunits) dnax] [GN:dnaX:dnaZX] [OR:*Bacillus subtilis*] [EC:2.7.7.7] [DB:pir2]
>gp: [GI:dl005797:g467409] [LN:BAC180K] [AC:D26185] [PN:DNA polymerase III subunit] [GN:dnaH] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:90414] [RE:92105] [DI:direct] >gp: [GI:g580914] [LN:BSRECM] [AC:X17014] [GN:dnaZX] [OR:*Bacillus subtilis*] [DB:genpept-bct1] [DE:*Bacillus subtilis* dnaZX and recR genes and two unidentified readingframes.] [SP:P09122] [LE:261] [RE:1952] [DI:direct]
>gp: [GI:e1181952:g2632286] [LN:BSUB0001] [AC:Z99104:AL009126] [PN:DNA polymerase III (gamma and tau subunits)] [GN:dnaX] [FN:DNA synthesis] [OR:*Bacillus subtilis*] [DB:genpept-bct1] [EC:2.7.7.7] [DE:*Bacillus subtilis* complete genome (section 1 of 21): from 1 to213080.] [NT:alternate gene name: dnaH, dna-8132] [SP:P09122] [LE:26812] [RE:28503] [DI:direct]

| ORF Name | NT ID | AA ID | NT LN | AA LN | Score | P-Value |
|---|---|---|---|---|---|---|
| AI7503000998_23556500_f1_33 | 2847 | 6619 | 282 | 93 | | |

Description
NO-HIT

| ORF Name | NT ID | AA ID | NT LN | AA LN | Score | P-Value |
|---|---|---|---|---|---|---|
| AI7503000998_2359675_c3_329 | 2848 | 6620 | 141 | 46 | 68 | 0.047 |

Description
pir: [LN:S72295] [AC:S72295] [PN:ribosomal protein S8] [GN:rps8] [OR:plastid *Plasmodium falciparum*] LDB:pir2] >gp: [GI:e220199:g1171601] [LN:PFCOMPIRB] [AC:X95276] [GN:rps8] [OR:*Plasmodium falciparum*] [SR:malaria parasite *P. falciparum*] [DB:genpept-inv1] [DE:*P.falciparum* complete gene map of plastid-like DNA (IR-B) .] [LE:5492] [RE:5878] [DI:direct]

| ORF Name | NT ID | AA ID | NT LN | AA LN | Score | P-Value |
|---|---|---|---|---|---|---|
| AI7503000998_23631262_f2_94 | 2849 | 6621 | 150 | 49 | | |

Description
NO-HIT

| ORF Name | NT ID | AA ID | NT LN | AA LN | Score | P-Value |
|---|---|---|---|---|---|---|
| AI7503000998_23994687_f1_45 | 2850 | 6622 | 132 | 43 | | |

Description
NO-HIT

| ORF Name | NT ID | AA ID | NT LN | AA LN | Score | P-Value |
|---|---|---|---|---|---|---|
| AI7503000998_24016916_c3_341 | 2851 | 6623 | 1044 | 347 | 396 | 8.1e−37 |

Description
sp: [LN:YEIH_ECOLI] [AC:P33019] [GN:YEIH] [OR:*ESCHERICHIA COLI*] [DE:HYPOTHETICAL 36.9 KD PROTEIN IN LYSP-NFO INTERGENIC REGION] [SP:P33019] [DB:swissprot] >pir: [LN:E64984] [AC:E64984] [PN:hypothetical 36.9 kD protein in lysP-nfo intergenic region] [GN:yeiH] [OR:*Escherichia coli*]

-continued

[DB:pir2] >gp: [GI:g405879] [LN:ECOHU47] [AC:U00007] [PN:yeiH]
[OR:*Escherichia coli*] [SR:*Escherichia coli* K12 BHB2600] [DB:genpept-bct1]
[DE:47 to 48 centisome region of *E.coli* K12 BHB2600.] [LE:57462] [RE:58511]
[DI:direct] >gp: [GI:g1788482] [LN:AE000305] [AC:AE000305:U00096] [PN:orf, hypothetical protein] [GN:yeiH] [FN:orf; Unknown] [OR:*Escherichia coli*]
[DB:genpept-bct2] [DE:*Escherichia coli* K-12 MG1655 section 195 of 400 of the completegenome.] [NT:o349; 100 pct identical to YEIH_ECOLI SW: P33019]
[LE:2831] [RE:3880] [DI:direct]

| ORF Name | NT ID | AA ID | NT LN | AA LN | Score | P-Value |
| --- | --- | --- | --- | --- | --- | --- |
| AI7503000998_24220967_c1_228 | 2852 | 6624 | 138 | 45 | | |

Description
NO-HIT

| ORF Name | NT ID | AA ID | NT LN | AA LN | Score | P-Value |
| --- | --- | --- | --- | --- | --- | --- |
| AI7503000998_24227192_c3_343 | 2853 | 6625 | 147 | 48 | | |

Description
NO-HIT

| ORF Name | NT ID | AA ID | NT LN | AA LN | Score | P-Value |
| --- | --- | --- | --- | --- | --- | --- |
| AI7503000998_24235626_c1_257 | 2854 | 6626 | 159 | 52 | | |

Description
NO-HIT

| ORF Name | NT ID | AA ID | NT LN | AA LN | Score | P-Value |
| --- | --- | --- | --- | --- | --- | --- |
| AI7503000998_24272337_f3_204 | 2855 | 6627 | 432 | 143 | 96 | 0.0025 |

Description
pir: [LN:D69633] [AC:D69633] [PN:glutamine ABC transporter
(glutamine-binding protein) ginH] [GN:glnH]
[CL:lysine-arginine-ornithine-binding protein] [OR:*Bacillus subtilis*]
[DB:pir2] >gp: [GI:e1183973:g2635189] [LN:BSUB0014] [AC:Z99117:AL009126]
[PN:glutamine ABC transporter (glutamine-binding)] [GN:glnH] [OR:*Bacillus subtilis*] [DB:genpept-bct1] [DE:*Bacillus subtilis* complete genome (section 14 of 21) from 2599451to 2812870.] [LE:202928] [RE:203749] [DI:direct]
>gp: [GI:e1183991:g2635207] [LN:BSUB0015] [AC:Z99118:AL009126] [PN:glutamine ABC transporter (glutamine-binding)] [GN:glnH] [OR:*Bacillus subtilis*]
[DB:genpept-bct1] [DE:*Bacillus subtilis* complete genome (section 15 of 21):
from 2795131to 3013540.] [LE:7248] [RE:8069] [DI:direct]

| ORF Name | NT ID | AA ID | NT LN | AA LN | Score | P-Value |
| --- | --- | --- | --- | --- | --- | --- |
| AI7503000998_24350953_f1_6 | 2856 | 6628 | 132 | 43 | 72 | 0.017 |

Description
pir: [LN:G71244] [AC:G71244] [PN:hypothetical protein PH0217] [GN:PH0217]
[OR:*Pyrococcus horikoshii*] [DB:pir2] >gp: [GI:d1030229:g3256603]
[LN:AP000001]
[AC:AP000001:AB009465:AB009464:AB009466:AB009467:AB009468:AB009469]
[PN:106aa long hypothetical protein] [GN:PH0217] [OR:*Pyrococcus horikoshii*]
[SR:*Pyrococcus horikoshii* (strain:OT3) DNA] [DB:genpept-bct1] [DE:*Pyrococcus horikoshii* OT3 genomic DNA, 1-287000 nt. position (1/7) .] [LE:191072]
[RE:191392] [DI:complement]

| ORF Name | NT ID | AA ID | NT LN | AA LN | Score | P-Value |
| --- | --- | --- | --- | --- | --- | --- |
| AI7503000998_24390937_f3_198 | 2857 | 6629 | 156 | 51 | | |

Description
NO-HIT

| ORF Name | NT ID | AA ID | NT LN | AA LN | Score | P-Value |
| --- | --- | --- | --- | --- | --- | --- |
| AI7503000998_24391885_f3_178 | 2858 | 6630 | 183 | 60 | | |

Description
NO-HIT

| ORF Name | NT ID | AA ID | NT LN | AA LN | Score | P-Value |
| --- | --- | --- | --- | --- | --- | --- |
| AI7503000998_24475252_f3_213 | 2859 | 6631 | 159 | 52 | | |

-continued

| ORF Name | NT ID | AA ID | NT LN | AA LN | Score | P-Value |
|---|---|---|---|---|---|---|
| Description NO-HIT | | | | | | |
| AI7503000998_24664802_c1_234 | 2860 | 6632 | 747 | 248 | 380 | 4.0e−35 |

Description
pir: [LN:H70027] [AC:H70027] [PN:carboxylesterase homolog yvaK] [GN:yvaK]
[OR:*Bacillus subtilis*] [DB:pir2] >gp: [GI:e1186050:g2635875] [LN:BSUB0018]
[AC:Z99121:AL009126] [GN:yvaK] [FN:unknown] [OR:*Bacillus subtilis*]
[DB:genpept-bct1] [DE:*Bacillus subtilis* complete genome (section 18 of 21):
from 3399551to 3609060.] [NT:similar to carboxylesterase] [LE:53733]
[RE: 54479] [DI: complement]

| ORF Name | NT ID | AA ID | NT LN | AA LN | Score | P-Value |
|---|---|---|---|---|---|---|
| AI7503000998_25422288_c2_277 | 2861 | 6633 | 153 | 50 | | |
| Description NO-HIT | | | | | | |

| ORF Name | NT ID | AA ID | NT LN | AA LN | Score | P-Value |
|---|---|---|---|---|---|---|
| AI7503000998_25442803_c2_306 | 2862 | 6634 | 261 | 86 | | |
| Description NO-HIT | | | | | | |

| ORF Name | NT ID | AA ID | NT LN | AA LN | Score | P-Value |
|---|---|---|---|---|---|---|
| AI7503000998_25586693_c3_346 | 2863 | 6635 | 333 | 110 | 374 | 1.7e−34 |

Description
sp: [LN:YAAK_BACSU] [AC:P24281] [GN:YAAK] [OR:*BACILLUS SUBTILIS*]
[DE:HYPOTHETICAL 11.8 KD PROTEIN IN DNAZ-RECR INTERGENIC REGION] [SP:P24281]
[DB:swissprot] >pir: [LN:S13787] [AC:S13787:S66050:C69737] [PN:conserved
hypothetical protein yaaK] [GN:yaaK] [OR:*Bacillus subtilis*] [DB:pir2]
>gp: [GI:d1005798:g467410] [LN:BAC180K] [AC:D26185] [PN:unknown] [OR:*Bacillus
subtilis*] [SR:*Bacillus subtilis* (sub species:Marburg, strain:168) DNA]
[DB:genpept-bct1] [DE:*B. subtilis* DNA, 180 kilobase region of replication
origin.] [LE:92129] [RE:92452] [DI:direct] >gp: [GI:g40073] [LN:BSRECM]
[AC:X17014] [OR:*Bacillus subtilis*] [DB:genpept-bct1] [DE:*Bacillus subtilis*
dnaZX and recR genes and two unidentified readingframes.] [NT:ORF107]
[SP:P24281] [LE:1976] [RE:2299] [DI:direct] >gp: [GI:e1181953:g2632287]
[LN:BSUB0001] [AC:Z99104:AL009126] [GN:yaaK] [FN:unknown] [OR:*Bacillus
subtilis*] [DB:genpept-bct1] [DE:*Bacillus subtilis* complete genome (section 1
of 21): from 1 t0213080.] [NT:similar to hypothetical proteins] [SP:P24281]
[LE:28527] [RE:28850] [DI:direct]

| ORF Name | NT ID | AA ID | NT LN | AA LN | Score | P-Value |
|---|---|---|---|---|---|---|
| AI7503000998_256468_c2_294 | 2864 | 6636 | 330 | 109 | | |
| Description NO-HIT | | | | | | |

| ORF Name | NT ID | AA ID | NT LN | AA LN | Score | P-Value |
|---|---|---|---|---|---|---|
| AI7503000998_26460887_f1_34 | 2865 | 6637 | 1524 | 507 | 366 | 6.4e−32 |

Description
sp: [LN:TAGE_BACSU] [AC:P13484] [GN:TAGE:RODD:GTAA] [OR:*BACILLUS SUBTILIS*]
[EC:2.4.1.52] [DE:(EC 2.4.1.52) (TEICHOIC ACID BIOSYNTHESIS PROTEIN E)]
[SP:P13484] [DB:swissprot] >pir: [LN:506048] [AC:506048:F69720]
[PN:poly(glycerol-phosphate) alpha-glucosyltransferase, tagE:probable rodD
protein:UDP-glucose- -polyglycerol phosphate glucosyltransferase tagE]
[GN:tagE:rodD] [OR:*Bacillus subtilis*] [EC: 2.4.1.52] [DB:pir2] [MP:310
degrees] >gp: [GI:g580920] [LN:BSRODC] [AC:X15200] [OR:*Bacillus subtilis*]
[DB:genpept-bct1] [DE:*Bacillus subtilis* rodC operon.] [NT:rodD (gtaA)
polypeptide (AA 1–673)] [SP:P13484] [LE:157] [RE:2178] [DI:direct]
>gp: [GI:e1184479:g2636099] [LN:BSUB0019] [AC:Z99122:AL009126]
[PN:UDP-glucose:polyglycerol phosphate] [GN:tagE] [FN:teichoic acid
biosynthesis] [OR:*Bacillus subtilis*] [DB:genpept-bct1] [EC:2.4.1.52]
[DE:*Bacillus subtilis* complete genome (section 19 of 21): from 3597091to
3809700.] [NT:alternate gene name: rodD, gtaA, gtaD] [SP:P13484] [LE:80369]
[RE:82390] [DI:complement] >gp: [GI:e1184479:g2636099] [LN:BSUB0019]
[AC:Z99122:AL009126] [PN:UDP-glucose:polyglycerol phosphate] [GN:tagE]
[FN:teichoic acid biosynthesis] [OR:*Bacillus subtilis*] [DB:genpept]

-continued (EC:2.4.1.52] [DE:*Bacillus subtilis* complete genome (section 19 of 21): from 3597091to 3809700.] [NT:alternate gene name: rodD, gtaA, gtaD] [SP:P13484] [LE:80369] [RE:82390] [DI:complement]

| ORF Name | NT ID | AA ID | NT LN | AA LN | Score | P-Value |
|---|---|---|---|---|---|---|
| AI7503000998__26776562__c3__317 | 2866 | 6638 | 399 | 132 | | |

Description
NO-HIT

| ORF Name | NT ID | AA ID | NT LN | AA LN | Score | P-Value |
|---|---|---|---|---|---|---|
| AI7503000998__2769816__f3__206 | 2867 | 6639 | 135 | 44 | 135 | 2.5e−08 |

Description
gp: [GI:g2689564] [LN:U93688] [AC:U93688] [PN:integrase] [GN:int]
[OR:*Staphylococcus aureus*] [DB:genpept-bct2] [DE:*Staphylococcus aureus* toxic
shock syndrome toxin-1 (tst) ,enterotoxin Cent), and integrase (int) genes,
complete cds.] [NT:similar to staphylococcal phage integrase] [LE:13871]
[RE:15091] [DI:direct]

| ORF Name | NT ID | AA ID | NT LN | AA LN | Score | P-Value |
|---|---|---|---|---|---|---|
| AI7503000998__30265952__c2__291 | 2868 | 6640 | 387 | 128 | 118 | 2.3e−07 |

Description
pir: [LN:H69029] [AC:H69029] [PN:mutator MutT related protein] [GN:MTH122]
[CL:mutT domain homology] [OR:*Methanobacterium thermoautotrophicum*]
[DB:pir2] >gp: [GI:g2621161] [LN:AE000801] [AC:AE000801:AE000666] [PN:mutator
MutT related protein] [GN:MTH122] [OR:*Methanobacterium thermoautotrophicum*]
[DB:genpept-bct1] [DE:*Methanobacterium thermoautotrophicum* from bases 68653
to 79584 (section 7 of 148) of the complete genome.] [NT:Function Code:10.09 -
Metabolism of Macromolecules,] [LE:9193] [RE:9660] [DI:complement]

| ORF Name | NT ID | AA ID | NT LN | AA LN | Score | P-Value |
|---|---|---|---|---|---|---|
| AI7503000998__30682802__c3__321 | 2869 | 6641 | 261 | 86 | | |

Description
NO-HIT

| ORF Name | NT ID | AA ID | NT LN | AA LN | Score | P-Value |
|---|---|---|---|---|---|---|
| AI7503000998__33399055__c2__273 | 2870 | 6642 | 393 | 130 | 419 | 3.0e−39 |

Description
pir: [LN:H69745] [AC:H69745] [PN:hypothetical protein ybcI] [GN:ybcI]
[OR:*Bacillus subtilis*] [DB:pir2] >gp: [GI:d1034047:g3599606] [LN:AB006424]
[AC:AB006424] [GN:ybcI] [OR:*Bacillus subtilis*] [SR:*Bacillus subtilis*
(strain:168) DNA] [DB:genpept-bct1] [DE:*Bacillus subtilis* genomic DNA, 70 kb
region between 17 and 23degree.] [LE:13549] [RE:13923] [DI:direct]
>gp: [GI:e1182121:g2632455] [LN:BSUB0001] [AC:Z99104:AL009126] [GN:ybcI]
[FN:unknown] [OR:*Bacillus subtilis*] [DB:genpept-bct1] [DE:*Bacillus subtilis*
complete genome (section 1 of 21): from 1 to213080.] [LE:210558] [RE:210932]
[DI:direct] >gp: [GI:e1182139:g2632473] [LN:BSUB0002] [AC:Z99105:AL009126]
[GN:ybcI] [FN:unknown] [OR:*Bacillus subtilis*] [DB:genpept-bct1] [DE:*Bacillus
subtilis* complete genome (section 2 of 21): from 194651 to415810.]
[LE:15908] [RE:16282] [DI:direct]

| ORF Name | NT ID | AA ID | NT LN | AA LN | Score | P-Value |
|---|---|---|---|---|---|---|
| AI7503000998__33756432__f1__7 | 2871 | 6643 | 141 | 46 | | |

Description
NO-HIT

| ORF Name | NT ID | AA ID | NT LN | AA LN | Score | P-Value |
|---|---|---|---|---|---|---|
| AI7503000998__34407625__c3__309 | 2872 | 6644 | 354 | 117 | 587 | 4.7e−57 |

Description
gp: [GI:g1658281] [LN:SLU74623] [AC:U74623] [PN:CadX] [FN:cadmium resistance]
[OR:*Staphylococcus lugdunensis*] [DB:genpept-bct1] [DE:*Staphylococcus
lugdunensis* strain 995 cadmium resistance plasmidpLUG10, complete sequence.]
[LE:2624] [RE:2971] [DI:direct]

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000998_34557262_c3_349 | 2873 | 6645 | 135 | 44 | | |

Description
NO-HIT

| ORF Name | NT ID | AA ID | NT LN | AA LN | Score | P-Value |
|---|---|---|---|---|---|---|
| AI7503000998_35431657_f2_114 | 2874 | 6646 | 135 | 44 | | |

Description
NO-HIT

| ORF Name | NT ID | AA ID | NT LN | AA LN | Score | P-Value |
|---|---|---|---|---|---|---|
| AI7503000998_36227142_c1_240 | 2875 | 6647 | 993 | 330 | 409 | 3.4e−38 |

Description
sp: [LN:LYTE_BACSU] [AC:P54421] [GN:LYTE:PAPQ] [OR:*BACILLUS SUBTILIS*]
[DE:PAPQ PRECURSOR) (CELL WALL-ASSOCIATED POLYPEPTIDE CWBP33)] [SP:P54421]
[DB:swissprot] >gp: [GI:g1488662] [LN:BSU38819] [AC:U38819]
[PN:phosphatase-associated protein] [GN: lytE] [OR:*Bacillus subtilis*]
[DB:genpept-bct2] [DE:*Bacillus subtilis* phosphatase-associated protein
(lytE) gene,complete cds.] [NT:Muralytic when cloned in *E.coli*; Iap60
homolog;] [LE:443] [RE:1447] [DI:direct]

| ORF Name | NT ID | AA ID | NT LN | AA LN | Score | P-Value |
|---|---|---|---|---|---|---|
| AI7503000998_36568828_c2_266 | 2876 | 6648 | 1050 | 349 | 984 | 4.0e−99 |

Description
pir: [LN:A43577] [AC:A43577] [PN:regulatory protein pfoR] [OR:*Clostridium
perfringens*] [DB:pir2]

| ORF Name | NT ID | AA ID | NT LN | AA LN | Score | P-Value |
|---|---|---|---|---|---|---|
| AI7503000998_36593802_c2_282 | 2877 | 6649 | 867 | 288 | 454 | 5.8e−43 |

Description
sp: [LN:PLPA_PASHA] [AC:Q08868:Q07363] [GN:PLPA] [OR:*PASTEURELLA HABMOLYTICA*]
[DE:OUTER MEMBRANE LIPOPROTEIN 1 PRECURSOR (PLP1)] [SP:Q08868:Q07363]
[DB:swissprot] >pir: [LN:JN0751] [AC:JN0751] [PN:Outer membrane 30K
protein:ORF1] [CL:lipoprotein-28] [OR:*Pasteurella haemolytica*] [DB:pir2]
>gp: [GI:g349530] [LN:PASLIPOPR] [AC:L11037] [PN:lipoprotein] [OR:*Pasteurella
haemolytica*] [SR:*Pasteurella haemolytica* (strain A1) DNA] [DB:genpept-bct1]
[DE:*Pasteurella haemolytica* lipoprotein gene, complete cds.] [NT:precursor]
[LE:171] [RE:1004] [DI:direct] >gp: [GI:g150508] [LN:PASLIPOPRO] [AC:M91072]
[PN:lipoprotein] [OR:*Pasteurella haemolytica*] [SR:*Pasteurella haemolytica*
(strain A1) (library: pUCl9 of R. Craven e] [DB:genpept-bct1]
[DE:*Pasteurella haemolytica* (clones pGEB2830,pBRES2830) lipoproteingene,
complete cds.] [LE:136] [RE:969] [DI:direct]

| ORF Name | NT ID | AA ID | NT LN | AA LN | Score | P-Value |
|---|---|---|---|---|---|---|
| AI7503000998_3944143_c3_308 | 2878 | 6650 | 627 | 208 | 971 | 9.5e−98 |

Description
gp: [GI:g1916729] [LN:AF134905] [AC:AF134905:U76550] [PN:CadD] [GN:cadD]
[OR:*Staphylococcus aureus*] [DB:genpept-bct2] [DE:*Staphylococcus aureus*
plasmid pRW001 CadD (cadD) gene, completecds.] [NT:confers low level cadmium
resistance] [LE:2328] [RE:2957] [DI:direct]

| ORF Name | NT ID | AA ID | NT LN | AA LN | Score | P-Value |
|---|---|---|---|---|---|---|
| AI7503000998_3945253_f3_203 | 2879 | 6651 | 126 | 41 | | |

Description
NO-HIT

| ORF Name | NT ID | AA ID | NT LN | AA LN | Score | P-Value |
|---|---|---|---|---|---|---|
| AI7503000998_3954385_f1_32 | 2880 | 6652 | 123 | 40 | | |

Description
NO-HIT

| ORF Name | NT ID | AA ID | NT LN | AA LN | Score | P-Value |
|---|---|---|---|---|---|---|
| AI7503000998_4064818_c1_239 | 2881 | 6653 | 675 | 224 | 533 | 2.5e−51 |

-continued

Description
sp: [LN:YAEE_ECOLI] [AC:P31547] [GN:YAEE] [OR:*ESCHERICHIA COLI*]
[DE:HYPOTHETICAL ABC TRANSPORTER PERMEASE PROTEIN YAEE] [SP:P31547]
[DB:swissprot] >pir: [LN:F64744] [AC:F64744] [PN:probable transport protein
yaeE] [GN:yaeE] [CL:probable transport protein yaeE] [OR:*Escherichia coli*]
[DB:pir2] >gp: [GI:d1041643:g49029941] [LN:ECOTSF] [AC:D83536]
[PN:Hypothetical 23.3 kd protein in rcsF-abc] [GN:yaeE] [OR:*Escherichia
coli*] [SR:*Escherichia coli* (strain:K12) DNA] [DB:genpept-bct1]
[DE:*Escherichia coli* genomic DNA. (4.1–6.1 min) .] [NT:ORF_ID:o124#1;
similar to SwissProt Accession] [LE:30521] [RE:31174] [DI:complement]
>gp: [GI:g1552774] [LN:ECU70214] [AC:U70214] [GN:yaeE] [OR:*Escherichia coli*]
[DB:genpept-bct1] [DE:*Escherichia coli* chromosome minutes 4–6.]
[NT:hypothetical] [LE:52043] [RE:52696] [DI:complement] >gp: [GI:g1786397]
[LN:AE000129] [AC:AE000129:U00096] [PN:putative transport system permease
protein] [GN:yaeE] [FN:putative transport; Not classified] [OR:*Escherichia
coli*] [DB:genpept-bct2] [DE:*Escherichia coli* K-12 MG1655 section 19 of 400
of the completegenome.] [NT:f218; 100 pct identical to YAEE_ECOLI SW:
P31547] [LE:944] [RE:1597] [DI:complement]

| ORF Name | NT ID | AA ID | NT LN | AA LN | Score | P-Value |
|---|---|---|---|---|---|---|
| AI7503000998_4082828_c3_320 | 2882 | 6654 | 702 | 233 | 211 | 3.3e−17 |

Description
pir: [LN:F71886] [AC:F71886] [PN:hypothetical protein jhp0787] [GN:jhp0787]
[OR:*Helicobacter pylori*] [SR:strain J99, , strain J99] [SR:strain J99,]
[DB:pir2] >gp: [GI:g4155367] [LN:AE001509] [AC:AE001509:AE001439]
[PN:putative] [GN:jhp0787] [OR:*Helicobacter pylori* J99] [DB:genpept-bct2]
[DE:*Helicobacter pylori*, strain J99 section 70 of 132 of the
completegenome.] [NT:similar to *H. pylori* 26695 gene HP0851] [LE:2708]
[RE:3394] [DI:direct]

| ORF Name | NT ID | AA ID | NT LN | AA LN | Score | P-Value |
|---|---|---|---|---|---|---|
| AI7503000998_4101525_f1_60 | 2883 | 6655 | 135 | 44 | | |

Description
NO-HIT

| ORF Name | NT ID | AA ID | NT LN | AA LN | Score | P-Value |
|---|---|---|---|---|---|---|
| AI7503000998_4328468_c2_298 | 2884 | 6656 | 1473 | 490 | 1279 | 2.2e−130 |

Description
pir: [LN:H69634] [AC:H69634] [PN:glutamate synthase (small subunit) gltB]
[GN:gltB] [OR:*Bacillus subtilis*] [DB:pir2] >gp: [GI:e1183502:g2634227]
[LN:BSUB0010] [AC:Z99113:AL009126] [PN:glutamate synthase (small subunit)]
[GN:gltB] [FN:glutamate biosynthesis] [OR:*Bacillus subtilis*]
[DB:genpept-bct1] [EC:1.4.1.13] [DE:*Bacillus subtilis* complete genome
(section 10 of 21): from 1781201to 2014980.] [LE:226628] [RE:228109]
[DI:complement] >gp: [GI:e1185317:g2634238] [LN:BSUB0011]
[AC:Z99114:AL009126] [PN:glutamate synthase (small subunit)] [GN:gltB]
[FN:glutamate biosynthesis] [OR:*Bacillus subtilis*] [DB:genpept-bct1]
[EC:1.4.1.13] [DE:*Bacillus subtilis* complete genome (section 11 of 21): from
2000171to 2207900.] [LE:7658] [RE:9139] [DI:complement]

| ORF Name | NT ID | AA ID | NT LN | AA LN | Score | P-Value |
|---|---|---|---|---|---|---|
| AI7503000998_4335766_c1_261 | 2885 | 6657 | 141 | 46 | | |

Description
NO-HIT

| ORF Name | NT ID | AA ID | NT LN | AA LN | Score | P-Value |
|---|---|---|---|---|---|---|
| AI7503000998_4344011_f3_152 | 2886 | 6658 | 252 | 83 | 60 | 0.023 |

Description
gp: [GI:d1036760:g4062561] [LN:D90737] [AC:D90737:AB001340]
[PN:4-hydroxyphenylacetate 3-monooxygenase (EC) [GN nmoB] [OR:*Escherichia
coli*] [SR:*Escherichia coli*(strain:K12) DNA, clone:Kohara clone #227]
[DB:genpept-bct1] [DE:*Escherichia coli* genomic DNA. (22.8–23.1 min) .]
[NT:ORF_ID:o228#5; similar to PIR Accession Number] [LE:15357] [RE:15932]
[DI:complement] >gp: [GI:d1036770:g4062570] [LN:D90738] [AC:D90738:AB001340]
[PN:4-hydroxyphenylacetate 3-monooxygenase (EC) [GN:nmoB] [OR:*Escherichia
coli*] [SR:*Escherichia coli*(strain:K12) DNA, clone:Kohara clone #228]

-continued

[DB:genpept-bct1] [DE:*Escherichia coli* genomic DNA. (23.0–23.4 min) .]
[NT:ORF_ID:o228#5; similar to PIR Accession Number] [LE:3821] [RE:4396]
[DI:complement]

| ORF Name | NT ID | AA ID | NT LN | AA LN | Score | P-Value |
|---|---|---|---|---|---|---|
| AI7503000998_4485682_f3_159 | 2887 | 6659 | 264 | 87 | | |

Description
NO-HIT

| ORF Name | NT ID | AA ID | NT LN | AA LN | Score | P-Value |
|---|---|---|---|---|---|---|
| AI7503000998_4580132_f1_72 | 2888 | 6660 | 171 | 56 | 161 | 3.6e−11 |

Description
gp: [GI:g2689564] [LN:U93688] [AC:U93688] [PN:integrase] [GN:int]
[OR:*Staphylococcus aureus*] [DB:genpept-bct2] [DE:*Staphylococcus aureus* toxic
shock syndrome toxin-1 (tst),enterotoxin (ent), and integrase (int) genes,
complete cds.] [NT:similar to staphylococcal phage integrase] [LE:13871]
[RE:15091] [DI:direct]

| ORF Name | NT ID | AA ID | NT LN | AA LN | Score | P-Value |
|---|---|---|---|---|---|---|
| AI7503000998_4703167_f1_44 | 2889 | 6661 | 144 | 47 | | |

Description
NO-HIT

| ORF Name | NT ID | AA ID | NT LN | AA LN | Score | P-Value |
|---|---|---|---|---|---|---|
| AI7503000998_4703512_c3_315 | 2890 | 6662 | 486 | 161 | 335 | 2.4e−30 |

Description
pir: [LN:A70068] [AC:A70068 ] [PN:conserved hypothetical protein ywqN]
[GN:ywqN] [OR:*Bacillus subtilis*] [DB:pir2] >gp: [GI:e1184521:g2636140]
[LN:BSUB0019] [AC:Z99122:AL009126] [GN:ywqN] [FN:unknown] [OR:*Bacillus
subtilis*] [DB:genpept-bct1] [DE:*Bacillus subtilis* complete genome (section
19 of 21): from 3597091to 3809700.] [NT:similar to hypothetical proteins]
[LE:124753] [RE:125298] [DI:complement] >gp: [GI:e308071:g1894752]
[LN:BSZ92952] [AC:Z92952] [PN:unknown] [GN:ywqN] [OR:*Bacillus subtilis*]
[DB:genpept-bct1] [DE:*B.subtilis* ywq[A,B,C,D,E,F,G,H,I,J,K,L,M,N,O] genes.]
[LE:13028] [RE:13573] [DI:direct] >gp: [GI:e1184521:g2636140] [LN:BSUB0019]
[AC:Z99122:AL009126] [GN:ywqN] [FN:unknown] [OR:*Bacillus subtilis*]
[DB:genpept] [DE:*Bacillus subtilis* complete genome (section 19 of 21): from
3597091to 3809700.] [NT:similar to hypothetical proteins] [LE:124753]
[RE:125298] [DI:complement]

| ORF Name | NT ID | AA ID | NT LN | AA LN | Score | P-Value |
|---|---|---|---|---|---|---|
| AI7503000998_47343_c1_219 | 2891 | 6663 | 132 | 43 | | |

Description
NO-HIT

| ORF Name | NT ID | AA ID | NT LN | AA LN | Score | P-Value |
|---|---|---|---|---|---|---|
| AI7503000998_5265643_f1_30 | 2892 | 6664 | 1122 | 373 | | |

Description
NO-HIT

| ORF Name | NT ID | AA ID | NT LN | AA LN | Score | P-Value |
|---|---|---|---|---|---|---|
| AI7503000998_5343760_f2_129 | 2893 | 6665 | 267 | 88 | | |

Description
NO-HIT

| ORF Name | NT ID | AA ID | NT LN | AA LN | Score | P-Value |
|---|---|---|---|---|---|---|
| AI7503000998_5860927_f2_138 | 2894 | 6666 | 189 | 62 | 75 | 0.023 |

Description
gp: [GI:e1283542:g4455153] [LN:ATF6I18] [AC:ALO22198] [PN:putative protein]
[GN:F6I18.10] [OR:*Arabidopsis thaliana*] [SR:thale cress] [DB:genpept-pln1]

-continued

[DE:*Arabidopsis thaliana* DNA chromosome 4, BAC clone F6118 (ESSAIIproject) .]
[NT:contains EST gb:T22575, T22317] [LE:>199:404:631] [RE:347:548:921]
[DI:complementJoin]

| ORF Name | NT ID | AA ID | NT LN | AA LN | Score | P-Value |
|---|---|---|---|---|---|---|
| AI7503000998_6052175_f1_65 | 2895 | 6667 | 153 | 50 | | |

Description
NO-HIT

| ORF Name | NT ID | AA ID | NT LN | AA LN | Score | P-Value |
|---|---|---|---|---|---|---|
| AI7503000998_6053437_c3_310 | 2896 | 6668 | 123 | 40 | | |

Description
NO-HIT

| ORF Name | NT ID | AA ID | NT LN | AA LN | Score | P-Value |
|---|---|---|---|---|---|---|
| AI7503000998_6251262_f3_146 | 2897 | 6669 | 189 | 62 | 75 | 0.0084 |

Description
gp: [GI:d1044717:g5105618] [LN:AP000062] [AC:AP000062] [PN:121aa long
hypothetical protein] [GN:APE1925] [OR:*Aeropyrum pernix*] [SR:*Aeropyrum
pernix* (strain:K1) DNA] [DB:genpept] [DE:*Aeropyrum pernix* genomic DNA,
section 5/7.] [NT:similar to OWL:AB00947213 percent identity:62.500]
[LE:233017] [RE:233382] [DI:direct]

| ORF Name | NT ID | AA ID | NT LN | AA LN | Score | P-Value |
|---|---|---|---|---|---|---|
| AI7503000998_657678_f3_208 | 2898 | 6670 | 135 | 44 | | |

Description
NO-HIT

| ORF Name | NT ID | AA ID | NT LN | AA LN | Score | P-Value |
|---|---|---|---|---|---|---|
| AI7503000998_6698526_c2_264 | 2899 | 6671 | 174 | 57 | | |

Description
NO-HIT

| ORF Name | NT ID | AA ID | NT LN | AA LN | Score | P-Value |
|---|---|---|---|---|---|---|
| AI7503000998_6743788_c2_272 | 2900 | 6672 | 132 | 43 | | |

Description
NO-HIT

| ORF Name | NT ID | AA ID | NT LN | AA LN | Score | P-Value |
|---|---|---|---|---|---|---|
| AI7503000998_6760887_f3_174 | 2901 | 6673 | 924 | 307 | 333 | 3.8e−30 |

Description
sp: [LN:GLTC_BACSU] [AC:P20668] [GN:GLTC] [OR:*BACILLUS SUBTILIS*]
[DE:TRANSCRIPTIONAL REGULATORY PROTEIN GLTC] [SP:P20668] [DB:swissprot]
>pir: [LN:A69635] [AC:A69635:A33951:A61642] [PN:transcription activator of
glutamate synthase operon gltC:regulatory protein gltC] [GN:gltC]
[CL:probable transcription regulator lsyR] [OR:*Bacillus subtilis*] [DB:pir2]
>gp: [GI:e1183504:g2634229] [LN:BSUB0010] [AC:Z99113:AL009126]
[PN:transcriptional regulator (LysR family)] [GN:gltC] [FN:positive
regulation of the glutamate synthase] [OR:*Bacillus subtilis*]
[DB:genpept-bct1] [DE:*Bacillus subtilis* complete genome (section 10 of 21):
from 1781201to 2014980.] [SP:P20668] [LE:232835] [RE:233737] [DI:direct]
>gp: [GI:e1185319:g2634240] [LN:BSUB0011] [AC:Z99114:AL009126]
[PN:transcriptional regulator (LysR family)] [GN:gltC] [FN:positive
regulation of the glutamate synthase] [OR:*Bacillus subtilis*]
[DB:genpept-bct1] [DE:*Bacillus subtilis* complete genome (section 11 of 21):
from 2000171to 2207900.] [SP:P20668] [LE:13865] [RE:14767] [DI:direct]
>gp: [GI:g457514] [LN:M28509] [AC:M28509] [GN:gltC] [FN:positive
transcriptional regulator] [OR:*Bacillus subtilis*] [DB:genpept-bct1]
[DE:*Bacillus subtilis* (gltC) gene, complete cds and glutamate synthase,large
subunit (gltA) gene, partial cds. gene.] [LE:34] [RE:936] [DI:complement]

| ORF Name | NT ID | AA ID | NT LN | AA LN | Score | P-Value |
|---|---|---|---|---|---|---|
| AI7503000998_6832950_c1_218 | 2902 | 6674 | 189 | 62 | | |

-continued

| ORF Name | NT ID | AA ID | NT LN | AA LN | Score | P-Value |
|---|---|---|---|---|---|---|
| AI7503000998_956312_f2_139 | 2903 | 6675 | 144 | 47 | | |

Description
NO-HIT

| ORF Name | NT ID | AA ID | NT LN | AA LN | Score | P-Value |
|---|---|---|---|---|---|---|
| AI7503000998_984703_c2_281 | 2904 | 6676 | 1026 | 341 | 763 | 1.0e−75 |

Description
sp: [LN:ABC_ECOLI] [AC:P30750:P77517] [GN:ABC] [OR:*ESCHERICHIA COLI*]
[DE:ATP-BINDING PROTEIN ABC] [SP:P30750:P77517] [DB:swissprot]
>pir: [LN:G64744] [AC:G64744:141113] [PN:probable ABC-type transport protein
abc] [GN:abc] [CL:unassigned ATP-binding cassette proteins: ATP-binding
cassette homology] [OR:*Escherichia coli*] [DB:pir2] >gp: [GI:g1552775]
[LN:ECU70214] [AC:U70214] [PN:ATP-binding protein] [GN:abc] [OR:*Escherichia coli*] [DB:genpept-bct1] [DE:*Escherichia coli* chromosome minutes 4–6.]
[LE:52689] [RE:53720] [DI:complement] >gp: [GI:g1786398] [LN:AE000129]
[AC:AE000129:U00096] [PN:ATP-binding component of a transporter] [GN:abc]
[FN:transport; Not classified] [OR:*Escherichia coli*] [DB:genpept-bct2]
[DE:*Escherichia coli* K-12 MG1655 section 19 of 400 of the completegenome.]
[NT:f343; 98 pct identical to fragment (231) [LE:1590] [RE:2621]
[DI:complement]

| ORF Name | NT ID | AA ID | NT LN | AA LN | Score | P-Value |
|---|---|---|---|---|---|---|
| AI7503000999_10191427_c1_745 | 2905 | 6677 | 135 | 44 | | |

Description
NO-HIT

| ORF Name | NT ID | AA ID | NT LN | AA LN | Score | P-Value |
|---|---|---|---|---|---|---|
| AI7503000999_10320337_c3_1119 | 2906 | 6678 | 192 | 63 | | |

Description
NO-HIT

| ORF Name | NT ID | AA ID | NT LN | AA LN | Score | P-Value |
|---|---|---|---|---|---|---|
| AI7503000999_10359688_f3_633 | 2907 | 6679 | 198 | 65 | | |

Description
NO-HIT

| ORF Name | NT ID | AA ID | NT LN | AA LN | Score | P-Value |
|---|---|---|---|---|---|---|
| AI7503000999_10546925_c3_1155 | 2908 | 6680 | 978 | 325 | 1246 | 6.8e−127 |

Description
sp: [LN:DNAA_STAAU] [AC:P49994] [GN:DNAA] [OR:*STAPHYLOCOCCUS AUREUS*]
[DE:CHROMOSOMAL REPLICATION INITIATOR PROTEIN DNAA] [SP:P49994]
[DB:swissprot] >pir: [LN:JC5607] [AC:JC5607] [PN:replication initiation
protein dnaA] [GN:dnaA] [CL:replication initiation protein dnaA]
[OR:*Staphylococcus aureus*] [DB:pir2] >gp: [GI:d1014451:g1694677] [LN:D89066]
[AC:D89066] [PN:DnaA] [GN:dnaA] [OR:*Staphylococcus aureus*]
[SR:*Staphylococcus aureus* DNA] [DB:genpept-bct1] [DE:*Staphylococcus aureus*
DNA for DnaA, complete cds.] [LE:456] [RE:1817] [DI:direct]

| ORF Name | NT ID | AA ID | NT LN | AA LN | Score | P-Value |
|---|---|---|---|---|---|---|
| AI7503000999_10556300_f2_428 | 2909 | 6681 | 174 | 57 | | |

Description
NO-HIT

| ORF Name | NT ID | AA ID | NT LN | AA LN | Score | P-Value |
|---|---|---|---|---|---|---|
| AI7503000999_10556712_c3_1187 | 2910 | 6682 | 990 | 329 | 1667 | 1.7e−171 |

Description
gp: [GI:g1408063] [LN:STAMECRA] [AC:L14017] [PN:methicillin-resistance
protein] [GN:mecR] [OR:*Staphylococcus aureus*] [SR:*Staphylococcus aureus*
(strain COL) DNA] [DB:genpept-bct1] [DE:*Staphylococcus aureus*

-continued methicillin-resistance protein (mecR) geneand unknown ORF, complete cds.]
[NT:putative] [LE:125] [RE:1111] [DI:direct]

| ORF Name | NT ID | AA ID | NT LN | AA LN | Score | P-Value |
|---|---|---|---|---|---|---|
| AI7503000999_10582782_f3_549 | 2911 | 6683 | 141 | 46 | | |

Description
NO-HIT

| ORF Name | NT ID | AA ID | NT LN | AA LN | Score | P-Value |
|---|---|---|---|---|---|---|
| AI7503000999_10629385_f1_185 | 2912 | 6684 | 153 | 50 | | |

Description
NO-HIT

| ORF Name | NT ID | AA ID | NT LN | AA LN | Score | P-Value |
|---|---|---|---|---|---|---|
| AI7503000999_10634800_c1_819 | 2913 | 6685 | 966 | 321 | 143 | 2.4e−07 |

Description
pir: [LN:D69900] [AC:D69900] [PN:conserved hypothetical protein yobV]
[GN:yobV] [OR:*Bacillus subtilis*] [DB:pir2] >gp: [GI:g2619048] [LN:AF027868]
[AC:AF027868] [PN:transcription regulator] [GN:yobV] [OR:*Bacillus subtilis*]
[DB:genpept-bct1] [DE:*Bacillus subtilis* chromosome region between terC and
odhAB.] [NT:similar to *Mycobacterium tuberculosis* hypothetical] [LE:63061]
[RE:64002] [DI:complement] >gp: [GI:e1185382:g2634303] [LN:BSUB0011]
[AC:Z99114:AL009126] [GN:yobV] [FN:unknown] [OR:*Bacillus subtilis*]
[DB:genpept-bct1] ]DE:*Bacillus subtilis* complete genome (section 11 of 21):
from 2000171to 2207900.] [NT:similar to hypothetical proteins] [LE:82152]
[RE:83 093] [DI:complement]

| ORF Name | NT ID | AA ID | NT LN | AA LN | Score | P-Value |
|---|---|---|---|---|---|---|
| AI7503000999_1071002_f3_616 | 2914 | 6686 | 411 | 136 | 71 | 0.026 |

Description
gp: [GI:g142964] [LN:BACGERD] [AC:M27259] [OR:*Bacillus subtilis*]
[SR:*B.subtilis* (strain 168) DNA, clone lambda-EMBL-3-2H] [DB:genpept-bct1]
[DE:*B.subtilis* gerD gene, complete cds.] [NT:unknown ORF] [LE:<1] [RE:282]
[DI:complement]

| ORF Name | NT ID | AA ID | NT LN | AA LN | Score | P-Value |
|---|---|---|---|---|---|---|
| AI7503000999_10727217_f1_212 | 2915 | 6687 | 270 | 89 | 212 | 2.5e−17 |

Description
pir: [LN:B69770] [AC:B69770] [PN:conserved hypothetical protein ydaS]
[GN:ydaS] [OR:*Bacillus subtilis*] [DB:pir2] >gp: [GI:d1020027:g1881247]
[LN:AB001488] [AC:AB001488] [GN:ydaS] [OR:*Bacillus subtilis*] [SR:*Bacillus
subtilis* (strain:168) DNA] [DB:genpept-bct1] [DE:*Bacillus subtilis* genome
sequence, 148 kb sequence of the regionbetween 35 and 47 degree.]
[NT:FUNCTION UNKNOWN.] [LE:25711] [RE:25968] [DI:complement]
>gp: [GI:e1182403:g2632737] [LN:BSUB0003] [AC:Z99106:AL009126] [GN:ydaS]
[FN:unknown] [OR:*Bacillus subtilis*] [DB:genpept-bct1] [DE:*Bacillus subtilis*
complete genome (section 3 of 21): from 402751 to611850.] [NT:similar to
hypothetical proteins from *B. subtilis*] [LE:89455] [RE:89712]
[DI:complement]

| ORF Name | NT ID | AA ID | NT LN | AA LN | Score | P-Value |
|---|---|---|---|---|---|---|
| AI7503000999_10928_c2_1083 | 2916 | 6688 | 1242 | 413 | 240 | 8.2e−18 |

Description
pir: [LN:T03492] [AC:T03492] [PN:hypothetical protein] [OR:*Rhodobacter
capsulatus*] [DB:pir2] [MP:1] >gp: [GI:g3128293] [LN:AF010496] [AC:AF010496]
[PN: hypothetical protein] [OR:*Rhodobacter capsulatus*] [DB genpept-bct2]
[DE:*Rhodobacter capsulatus* strain SB1003, partial genome.] [LE:54291]
[RE:55613] [DI:complement]

| ORF Name | NT ID | AA ID | NT LN | AA LN | Score | P-Value |
|---|---|---|---|---|---|---|
| AI7503000999_10928_f1_226 | 2917 | 6689 | 1017 | 338 | 175 | 1.3e−10 |

Description
pir: [LN:T03492] [AC:T03492] [PN:hypothetical protein] [OR:*Rhodobacter
capsulatus*] [DB:pir2] [MP:1] >gp: [GI:g3128293] [LN:AF010496] [AC:AF010496]
[PN:hypothetical protein] [OR:*Rhodobacter capsulatus*] [DB:genpept-bct2]

-continued

[DE:*Rhodobacter capsulatus* strain SB1003, partial genome.] [LE:54291] [RE:55613] [DI:complement]

| ORF Name | NT ID | AA ID | NT LN | AA LN | Score | P-Value |
|---|---|---|---|---|---|---|
| AI7503000999_111500_c3_1239 | 2918 | 6690 | 546 | 181 | 101 | 1.9e−05 |

Description
gp: [GI:g940735] [LN:LMIAP1270] [AC:X85869] [PN:invasive associated protein] [GN:iap] [OR:*Listeria monocytogenes*] [DB:genpept-bct1] [DE:*L.monocytogenes* type 1 partial iap gene (strain 12705/89) .] [NT:invades nonprofessional phagocytic cells] [LE:<1] [RE:>260] [DI:direct]

| ORF Name | NT ID | AA ID | NT LN | AA LN | Score | P-Value |
|---|---|---|---|---|---|---|
| AI7503000999_111592_c2_931 | 2919 | 6691 | 243 | 80 | 83 | 0.0083 |

Description
gp: [GI:e1349691:g3880163] [LN:CET24A11] [AC:Z49072] [GN:T24A11.2] [OR:*Caenorhabditis elegans*] [DB:genpept-inv1] [DE:*Caenorhabditis elegans* cosmid T24A11, complete sequence.] [LE:22751:23187:23506] [RE:23145:23464:23646] [DI:complementJoin]

| ORF Name | NT ID | AA ID | NT LN | AA LN | Score | P-Value |
|---|---|---|---|---|---|---|
| AI7503000999_115627_f2_344 | 2920 | 6692 | 168 | 55 | | |

Description
NO-HIT

| ORF Name | NT ID | AA ID | NT LN | AA LN | Score | P-Value |
|---|---|---|---|---|---|---|
| AI7503000999_1205000_f1_183 | 2921 | 6693 | 555 | 184 | 314 | 4.0e−28 |

Description
pir: [LN:F69768] [AC:F69768] [PN:acetyltransferase homolog ydaF] [GN:ydaF] [OR:*Bacillus subtilis*] [DB:pir2] >gp: [GI:d1020012:g1881232] [LN:AB001488] [AC:AB001488] [GN:ydaF] [OR:*Bacillus subtilis*] [SR:*Bacillus subtilis* (strain:168) DNA] [DB:genpept-bct1] [DE:*Bacillus subtilis* genome sequence, 148 kb sequence of the regionbetween 35 and 47 degree.] [NT:PROBABLE ACETYLTRANSFERASE.] [LE:6233] [RE:6784] [DI:direct]
>gp: [GI:e1182387:g2632721] [LN:BSUB0003] [AC:Z99106:AL00912G] [GN:ydaF] [FN:unknown] [OR:*Bacillus subtilis*] [DB:genpept-bct1] [DE:*Bacillus subtilis* complete genome (section 3 of 21): from 402751 toG11850.] [NT:similar to acetyltransferase] [LE:69977] [RE:70528] [DI:direct]

| ORF Name | NT ID | AA ID | NT LN | AA LN | Score | P-Value |
|---|---|---|---|---|---|---|
| AI7503000999_12536337_f2_405 | 2922 | 6694 | 327 | 108 | | |

Description
NO-HIT

| ORF Name | NT ID | AA ID | NT LN | AA LN | Score | P-Value |
|---|---|---|---|---|---|---|
| AI7503000999_12588250_c1_671 | 2923 | 6695 | 198 | 65 | | |

Description
NO-HIT

| ORF Name | NT ID | AA ID | NT LN | AA LN | Score | P-Value |
|---|---|---|---|---|---|---|
| AI7503000999_1259387_f2_250 | 2924 | 6696 | 126 | 41 | | |

Description
NO-HIT

| ORF Name | NT ID | AA ID | NT LN | AA LN | Score | P-Value |
|---|---|---|---|---|---|---|
| AI7503000999_1261078_f1_223 | 2925 | 6697 | 579 | 192 | 471 | 9.1e−45 |

Description
sp: [LN:XPT_BACSU] [AC:P42085] [GN:XPT] [OR:*BACILLUS SUBTILIS*] [EC:2.4.2.—] [DE:XANTHINE PHOSPHORIBOSYLTRANSFERASE,] [SP:P42085] [DB:swissprot] >pir: [LN:S51309] [AC:S51309:E69734] [PN:xanthine phosphoribosyltransferase xpt] [GN:xpt] [OR:*Bacillus subtilis*] [DB:pir2] >gp: p8 GI:g1256617] [LN:BACYACA] [AC:L77246] [PN:adenine phosphoribosyltransferase] [GN:xpt] [FN:purine biosynthesis] [OR:*Bacillus subtilis*] [DB:genpept-bct1] [EC:2.4.2.7] [DE:*Bacillus subtilis* (YAC10-9 clone) DNA region between the serA andkdg loci.] [NT:27% identity with *E.coli* adenine] [LE:1426] [RE:2010]

-continued

[DI:direct] >gp: [GI:e1183653:g2634626] [LN:BSUB0012] [AC:Z99115:AL009126]
[PN:xanthine phosphoribosyltransferase] [GN:xpt] [FN:purine biosynthesis]
[OR:*Bacillus subtilis*] [DB:genpept-bct1] [EC:2.4.2.7] [DE:*Bacillus subtilis*
complete genome (section 12 of 21): from 2195541to 2409220.] [SP:P42085]
[LE:123142] [RE:123726] [DI:complement] >gp: [GI:g633169] [LN:BSXPTPBUX]
[AC:X83878] [PN:xanthine phosphoribosyltransferase] [GN:xpt] [OR:*Bacillus
subtilis*] [DB:genpept-bct1] [DE:*B.subtilis* xpt and pbuX genes.] [SP:P42085]
[LE:357] [RE:941] [DI:direct]

| ORF Name | NT ID | AA ID | NT LN | AA LN | Score | P-Value |
|---|---|---|---|---|---|---|
| AI7503000999_1301_f3_471 | 2926 | 6698 | 123 | 40 | | |

Description
NO-HIT

| ORF Name | NT ID | AA ID | NT LN | AA LN | Score | P-Value |
|---|---|---|---|---|---|---|
| AI7503000999_13089052_f1_2 | 2927 | 6699 | 123 | 40 | | |

Description
NO-HIT

| ORF Name | NT ID | AA ID | NT LN | AA LN | Score | P-Value |
|---|---|---|---|---|---|---|
| AI7503000999_134677_f2_417 | 2928 | 6700 | 1101 | 366 | 1373 | 2.4e-140 |

Description
sp: [LN:YYAF_BACSU] [AC:P37518] [GN:YYAF] [OR:*BACILLUS SUBTILIS*] [DE:REGION]
[SP:P37518] [DB:swissprot] >pir: [LN:S66016] [AC:S66016:E70084] [PN:probable
GTP-binding protein yyaF] [GN:yyaF] [CL:yeast probable purine
nucleotide-binding protein YBRO25c] [OR:*Bacillus subtilis*] [DB:pir2]
>gp: [GI:d1005764:g467376] [LN:BAC180K] [AC:D26185] [PN:unknown] [OR:*Bacillus
subtilis*] [SR:*Bacillus subtilis* (sub species:Marburg, strain:168) DNA]
[DB:genpept-bct1] [DE:*B. subtilis* DNA, 180 kilobase region of replication
origin.] [LE:47839] [RE:48939] [DI:complement] >gp: [GI:e1184818:g2636639]
[LN:BSUB0021] [AC:Z99124:AL009126] [GN:yyaF] [FN:unknown] [OR:*Bacillus
subtilis*] [DB:genpept-bct1] [DE:*Bacillus subtilis* complete genome (section
21 of 21): from 3999281to 4214814.] [NT:similar to hypothetical proteins]
[SP:P37518] [LE:199771] [RE:200871] [DI:complement]

| ORF Name | NT ID | AA ID | NT LN | AA LN | Score | P-Value |
|---|---|---|---|---|---|---|
| AI7503000999_13704191_c1_811 | 2929 | 6701 | 171 | 56 | | |

Description
NO-HIT

| ORF Name | NT ID | AA ID | NT LN | AA LN | Score | P-Value |
|---|---|---|---|---|---|---|
| AI7503000999_13750258_f1_41 | 2930 | 6702 | 162 | 53 | | |

Description
NO-HIT

| ORF Name | NT ID | AA ID | NT LN | AA LN | Score | P-Value |
|---|---|---|---|---|---|---|
| AI7503000999_1379132_c1_806 | 2931 | 6703 | 564 | 187 | 589 | 2.9e-57 |

Description
gp: [GI:d1045999:g5360823] [LN:D86934] [AC:D86934] [PN:IS150-like
transposase] [OR:*Staphylococcus aureus*] [SR:*Staphylococcus aureus*
(strain:N315) DNA, clone_lib:library of N31] [DB:genpept] [DE:*Staphylococcus
aureus* genes, mec region, partial and complete cds.] [NT:ORF N028; putative]
[LE:<20180] [RE:20578] [DI:direct]

| ORF Name | NT ID | AA ID | NT LN | AA LN | Score | P-Value |
|---|---|---|---|---|---|---|
| AI7503000999_13828575_f1_31 | 2932 | 6704 | 444 | 147 | 617 | 3.1e-60 |

Description
sp: [LN:ARSC_STAAU] [AC:P30330] [GN:ARSC] [OR:*STAPHYLOCOCCUS AUREUS*]
[DE:ARSENATE REDUCTASE (ARSENICAL PUMP MODIFIER)] [SP:P30330] [DB:swissprot]
>pir:[LN:D41903] [AC:D41903] [PN:arsenate reductase,] [GN:arsC]
[CL:protein-tyrosine-phosphatase, low molecular weight] [OR:*Staphylococcus
aureus*] [EC:1.—.—.—] [DB:pir1] >gp:[GI:g150729] [LN:PI2ARSRBC] [AC:M86824]
[PN:arsenate reductase] [GN:arsC] [FN:Reduction of arsenate to arsenite]
[OR:Plasmid p1258] [SR:Plasmid p1258 DNA] [DB:genpept-bct1] [DE:Plasmid
p1258 arsenic resistance operon (arsRBC) genes, completecds.] [LE:1894]

-continued

[RE:2289] [DI:direct]

| ORF Name | NT ID | AA ID | NT LN | AA LN | Score | P-Value |
|---|---|---|---|---|---|---|
| AI7503000999_1384628_f2_290 | 2933 | 6705 | 1278 | 425 | 251 | 4.3e−19 |

Description
pir: [LN:H64514] [AC:H64514] [PN:hypothetical protein MJECL41]
[OR:*Methanococcus jannaschii*] [DB:pir2] [MP:ECLREV53908-52610]
>gp:[GI:g1522674] [LN:MII2CG] [AC:L77118] [PN:*M. jannaschii* predicted coding
region MJECL41] [GN:MJECL41] [OR:*Methanococcus jannaschii*] [DB:genpept-bct2]
[DE:*Methanococcus jannaschii* large extra-chromosomal element,
completesequence.] [NT:identified by GeneMark; putative] [LE:52610]
[RE:53908] [DI:complement]

| ORF Name | NT ID | AA ID | NT LN | AA LN | Score | P-Value |
|---|---|---|---|---|---|---|
| AI7503000999_13864680_c2_1056 | 2934 | 6706 | 384 | 127 | 247 | 5.0e−21 |

Description
sp: [LN:YQCJ_BACSU] [AC:P45949] [GN:YQCJ] [OR:*BACILLUS SUBTILIS*]
[DE:HYPOTHETICAL 12.3 KD PROTEIN IN CWLA-CISA INTERGENIC REGION] [SP:P45949]
[DB:swissprot] >pir: [LN:H69949] [AC:H69949] [PN:transcription regulator
ArsR family homolog yqcJ] [GN:yqcJ] [CL:arsenical resistance operon
repressor] [OR:*Bacillus subtilis*] [DB:pir2] >gp: [GI:d1013110:g1303775]
[LN:BACJH642] [AC:D84432:D82370] [PN:YqcJ] [OR:*Bacillus subtilis*]
[SR:*Bacillus subtilis* (strain:JH642(trpC2 PheAl) ) DNA] [DB:genpept-bct1]
[DE:*Bacillus subtilis* DNA, 283 Kb region containing skin element.]
[LE:61977] [RE:62294] [DI:direct] >gp: [GI:d1007542:g1217882] [LN:BACSKIN]
[AC:D32216] [PN:ORF3] [OR:*Bacillus subtilis*] [SR:*Bacillus subtilis*
(strain:JH642 (trpC2 pheA1) ) DNA] [DB:genpept-bct1] [DE:*Bacillus subtilis* 48
kb region including a skin element which islocated between spoIVCB and
spoIIIC.] [NT:similarity to arsenical resistance operon] [LE:43732]
[RE:44049] [DI:direct] >gp: [GI:e1183810:g2635026] [LN:BSUB0014]
[AC:Z99117:AL009126] [GN:yqcJ] [FN:unknown] [OR:*Bacillus subtilis*]
[DB:genpept-bct1] [DE:*Bacillus subtilis* complete genome (section 14 of 21):
from 2599451to 2812870.] [NT:similar to transcriptional regulator (ArsR
family)] [SP:P45949] [LE:57136] [RE:57453] [DI:complement]

| ORF Name | NT ID | AA ID | NT LN | AA LN | Score | P-Value |
|---|---|---|---|---|---|---|
| AI7503000999_13912551_c1_827 | 2935 | 6707 | 1695 | 564 | 156 | 6.7e−08 |

Description
gp: [GI:g4530172] [LN:AF085222] [AC:AF085222] [PN:putative primase]
[OR:*Streptococcus thermophilus* bacteriophage DT1] [DB:genpept-phg]
[DE:*Streptococcus thermophilus* bacteriophage DT1, complete genome.]
[NT:Orf3G] [LE:28549] [RE:30063] [DI:direct]

| ORF Name | NT ID | AA ID | NT LN | AA LN | Score | P-Value |
|---|---|---|---|---|---|---|
| AI7503000999_14111687_f3_529 | 2936 | 6708 | 225 | 74 | 104 | 3.3e−05 |

Description
sp: [LN:Y4IQ_RHISN] [AC:P55500] [GN:Y4IQ,Y4ND,Y4SD] [OR:RHIZOBIUM SP]
[SR:NGR234,] [DE:PUTATIVE INSERTION SEQUENCE ATP-BINDING PROTEIN
Y4IQ/Y4ND/Y4SD] [SP:P55500] [DB:swissprot] >gp: [GI:g2182455] [LN:AE000079]
[AC:AE000079:U00090] [PN:Y4iQ]][GN:y4iQ] [OR:*Rhizobium* sp. NGR234]
[DB:genpept-bct2] [DE:*Rhizobium* sp. NGR234 plasmid pNGR234a, section 16 of
46 of thecomplete plasmid sequence.] [NT:putative insertion sequence
ATP-binding protein;] [LE:1883] [RE:2779] [DI:complement] >gp: [GI:g2182539]
[LN:AE000086] [AC:AE000086:U00090] [PN:Y4nD] [GN:y4nD] [OR:*Rhizobium* sp.
NGR234] [DB:genpept-bct2] [DE:*Rhizobium* sp. NGR234 plasmid pNGR234a, section
23 of 46 of thecomplete plasmid sequence.] [NT:putative insertion sequence
ATP-binding protein;] [LE:8640] [RE:9536] [DI:complement] >gp: [GI:g2182618]
[LN:AE000095] [AC:AE000095:U00090] [PN:Y4sD] [GN:y4sD] [OR:*Rhizobium* sp.
NGR234] [DB:genpept-bct2] [DE:*Rhizobium* sp. NGR234 plasmid pNGR234a, section
32 of 46 of thecomplete plasmid sequence.] [NT:putative insertion sequence
ATP-binding protein;] [LE:7675] [RE:8571] [DI:complement]

| ORF Name | NT ID | AA ID | NT LN | AA LN | Score | P-Value |
|---|---|---|---|---|---|---|
| AI7503000999_14220027_f3_618 | 2937 | 6709 | 1143 | 380 | 190 | 3.0e−12 |

-continued

Description
gp: [GI:d1025733:g2879913] [LN:D85752] [AC:D85752] [GN:bacG] [OR:*Enterococcus faecalis*] [SR:*Enterococcus faecalis* plasmid:pPD1 DNA] [DB:genpept-bct1]
[DE:*Enterococcus faecalis* plasmid pPD1 bacA, bacB, bacC, bacD, bacE,bacF, bacG, bacH and bad genes, complete cds.] [LE:5832] [RE:7055] [DI:direct]

| ORF Name | NT ID | AA ID | NT LN | AA LN | Score | P-Value |
|---|---|---|---|---|---|---|
| AI7503000999__14460882__c3__1296 | 2938 | 6710 | 342 | 114 | 484 | 3.8e−46 |

Description
gp: [GI:g1022726] [LN:5HU35635] [AC:U35635] [PN:unknown] [OR:*Staphylococcus haemolyticus*] [SR:*Staphylococcus haemolyticus* strain = Y176] [DB:genpept-bct1]
[DE:*Staphylococcus haemolyticus* IS1272 ORF1 and ORF2 genes, completecds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503000999__14532058__c3__1228 | 2939 | 6711 | 273 | 90 | 452 | 9.4e−43 |

Description
sp: [LN:TRA1_STAAU] [AC:P14506] [OR:*STAPHYLOCOCCUS AUREUS*] [DE:TRANSPOSASE FOR INSERTION SEQUENCE ELEMENT IS257 IN TRANSPOSON TN4003] [SP:P14506]
[DB:swissprot] >pir: [LN:504162] [AC:S04162] [PN:transposase 1]
[OR:*Staphylococcus aureus*] [DB:pir2] >gp: [GI:g46748] [LN:SATN4003]
[AC:X13290] [OR:*Staphylococcus aureus*] [DB:genpept-bct1] [DE:*Staphylococcus aureus* multi-resistance plasmid pSK1 DNA containingtransposon Tn4003.]
[NT:transposase (AA 1–224)] [SP:P14506] [LE:89] [RE:763] [DI:complement]
>gp: [GI:g46753] [LN:SATN4003] [AC:X13290] [OR:*Staphylococcus aureus*]
[DB:genpept-bct1] [DE:*Staphylococcus aureus* multi-resistance plasmid pSK1
DNA containingtransposon Tn4003.] [NT:transposase (AA 1–224)] [SP:P14506]
[LE:4017] [RE:4691] [DI:complement] >gp: [GI:g1762092] [LN:5EU40381]
[AC:U40381] [PN:transposase] [GN:tnp] [OR:*Staphylococcus epidermidis*]
[DB:genpept-bct1] [DE:*Staphyloccous epidermidis* plasmid pSK697 insertion
sequenceIS257(697A) putative transposase gene, complete cds.] [NT:Tnp;
putative transposase] [LE:57] [RE:731] [DI:direct] >gp: [GI:g1762098]
[LN:SEU40384] [AC:U40384] [PN:transposase] [GN:tnp] [OR:*Staphylococcus epidermidis*] [DB:genpept-bct1] [DE:*Staphyloccous epidermidis* plasmid pSK818
insertion sequenceIS257(818A) putative transposase gene, complete cds.]
[NT:Tnp; putative transposase] [LE:57] [RE:731] [DI:direct]
>gp: [GI:g3676405] [LN:AF051916] [AC:AF051916] [PN:putative transposase TnpC]
[GN:tnpC] [OR:*Staphylococcus aureus*] [DB genpept-bct2] [DE:*Staphylococcus aureus* plasmid pJE1 remnant of replication proteinRep (rep), trimethoprim
resistance protein DfrA (dfrA), thymidylatesynthetase ThyE (thyE), and
putative transposase Tnp (tnp) genes,complete cds; and unknown gene.]
[LE:65] [RE:739] [DI:direct] >gp: [GI:g3676411] [LN:AF051916] [AC:AF051916]
[PN:putative transposase TnpE] [GN:tnpE] [OR:*Staphylococcus aureus*]
[DB:genpept-bct2] [DE:*Staphylococcus aureus* plasmid pJE1 remnant of
replication proteinRep (rep), trimethoprim resistance protein DfrA (dfrA),
thymidylatesynthetase ThyE (thyE), and putative transposase Tnp (tnp)
genes,complete cds; and unknown gene.] [LE:4409] [RE:5083] [DI:direct]
>gp: [GI:g3676433] [LN:AF051917] [AC:AF051917:L19570] [PN:putative
transposase TnpC] [GN:tnpC] [OR:*Staphylococcus aureus*] [DB:genpept-bct2]
[DE:*Staphylococcus aureus* plasmid pSK41. complete sequence.] LE:22981]

| ORF Name | NT ID | AA ID | NT LN | AA LN | Score | P-Value |
|---|---|---|---|---|---|---|
| AI7503000999__14578382__f1__27 | 2940 | 6712 | 192 | 63 | | |

Description
NO-HIT

| ORF Name | NT ID | AA ID | NT LN | AA LN | Score | P-Value |
|---|---|---|---|---|---|---|
| AI7503000999__14625031__f3__489 | 2941 | 6713 | 132 | 43 | | |

Description
NO-HIT

| ORF Name | NT ID | AA ID | NT LN | AA LN | Score | P-Value |
|---|---|---|---|---|---|---|
| AI7503000999__14719827__c3__1275 | 2942 | 6714 | 330 | 109 | 85 | 0.0070 |

Description
gp: [GI:g4049891] [LN:AF063866] [AC:AF063866] [PN:ORF MSV019 hypothetical
protein] [GN:MSV019] [OR:*Melanoplus sanguinipes* entomopoxvirus]
[DB:genpept-vrl] [DE:*Melanoplus sanguinipes* entomopoxvirus, complete
genome.] [LE:21761] [RE:23074] [DI:complement]

-continued

| ORF Name | NT ID | AA ID | NT LN | AA LN | Score | P-Value |
|---|---|---|---|---|---|---|
| AI7503000999__14728382__f1__210 | 2943 | 6715 | 300 | 99 | 336 | 1.8e−30 |

Description
sp: [LN:RSG_BACSU] [AC:P21468] [GN:RPSF] [OR:*BACILLUS SUBTILIS*] [DE:30S
RIBOSOMAL PROTEIN SG (BS9)] [SP:P21468] [DB:swissprot] >pir: [LN:S66015]
[AC:S66015:S11356:E69699] [PN:ribosomal protein S6 (BS9) rpsF:ribosomal
protein BS9] [GN:rpsF] [CL:*Escherichia coli* ribosomal protein S6]
[OR:*Bacillus subtilis*] [DB:pir2] >gp: [GI:d1005763:g467375] [LN:BAC180K]
[AC:D26185] [PN:ribosomal protein 56] [GN:rpsF] [OR:*Bacillus subtilis*]
[SR:*Bacillus subtilis* (sub species:Marburg, strain:168) DNA]
[DB:genpept-bct1] [DE:*B. subtilis* DNA, 180 kilobase region of replication
origin.] [LE:47441] [RE:47728] [DI:complement] >gp: [GI:e1184817:g2636638]
[LN:BSUB0021] [AC:Z99124:AL009126] [PN:ribosomal protein SG (BS9)] [GN:rpsF]
[OR:*Bacillus subtilis*] [DB:genpept-bct1] [DE:*Bacillus subtilis* complete
genome (section 21 of 21): from 3999281to 4214814.] [SP:P21468] [LE:199373]
[RE:199660] [DI:complement]

| ORF Name | NT ID | AA ID | NT LN | AA LN | Score | P-Value |
|---|---|---|---|---|---|---|
| AI7503000999__14881552__f1__187 | 2944 | 6716 | 216 | 71 | | |

Description
NO-HIT

| ORF Name | NT ID | AA ID | NT LN | AA LN | Score | P-Value |
|---|---|---|---|---|---|---|
| AI7503000999__15033181__c3__1093 | 2945 | 6717 | 444 | 147 | 90 | 0.0071 |

Description
gp: [GI:g4176374] [LN:AC004953] [AC:AC004953] [GN:WUGSC:H_DJ1059M17.2]
[OR:*Homo sapiens*] [SR:INFORMATION] [DB:genpept-pri3] [DE:*Homo sapiens* PAC
clone DJ1059M17 from 7q21–q31.1, completesequence.] [NT:myosin regulatory
light chain 2; similar to S22715] [LE:67137:67324:69882]
[RE:67235:67372:69960] [DI:complementJoin]

| ORF Name | NT ID | AA ID | NT LN | AA LN | Score | P-Value |
|---|---|---|---|---|---|---|
| AI7503000999__15052318__f2__391 | 2946 | 6718 | 1395 | 464 | 1606 | 4.9e−165 |

Description
sp: [LN:THDF_BACSU] [AC:P25811] [GN:THDF] [OR:*BACILLUS SUBTILIS*] [DE:POSSIBLE
THIOPHENE AND FURAN OXIDATION PROTEIN THDF] [SP:P25811] [DB:swissprot]
>pir: [LN:JQ1215] [AC:140439:S66026:C69722:JQ1215:S18075] [PN:thiophen /
furan oxidation protein thdF:50K protein homolog] [GN:thdF] [CL:thiophen /
furan oxidation protein:translation elongation factor Tu homology]
[OR:*Bacillus subtilis*] DB:pir2] >gp: [GI:d1005774:g467386] [LN:BAC180K]
[AC:D26185] [PN:thiophen and furan oxidation] [GN:tdhF] [OR:*Bacillus
subtilis*] [SR:*Bacillus subtilis* (sub species:Marburg, strain:168) DNA]
[DB:genpept-bct1] [DE:*B. subtilis* DNA, 180 kilobase region of replication
origin.] [LE:59506] [RE:60885] [DI:complement] >gp: [GI:g40025] [LN:BSORIGS]
[AC:X62539] [OR:*Bacillus subtilis*] [DB:genpept-bct1] [DE:*B.subtilis* genes
rpmH, rnpA, 50kd, gidA and gidB.] [NT:homologous to *E.coli* 50K] [SP:P25811]
[LE:2515] [RE:3894] [DI:direct] >gp: [GI:e1184828:g2636649] [LN:BSUB0021]
[AC:Z99124:AL009126] [GN:thdF] [FN:thiophen and furan oxidation]
[OR:*Bacillus subtilis*] [DB:genpept-bct1] [DE:*Bacillus subtilis* complete
genome (section 21 of 21): from 3999281to 4214814.] [SP:P25811] [LE:211438]
[RE:212817] [DI:complement]

| ORF Name | NT ID | AA ID | NT LN | AA LN | Score | P-Value |
|---|---|---|---|---|---|---|
| AI7503000999__15055313__c3__1183 | 2947 | 6719 | 444 | 147 | 753 | 1.2e−74 |

Description
gp: [GI:d1046028:g5360852] [LN:D86934] [AC:D86934] [OR:*Staphylococcus aureus*]
[SR:*Staphylococcus aureus* (strain:N315) DNA, clone_lib:library of N31]
[DB:genpept] [DE:*Staphylococcus aureus* genes, mec region, partial and
complete cds.] [NT:ORF CN038] [LE:45523] [RE:>45966] [DI:complement]

| ORF Name | NT ID | AA ID | NT LN | AA LN | Score | P-Value |
|---|---|---|---|---|---|---|
| AI7503000999__15632952__c1__833 | 2948 | 6720 | 489 | 162 | | |

Description
NO-HIT

| ORF Name | NT ID | AA ID | NT LN | AA LN | Score | P-Value |
|---|---|---|---|---|---|---|

-continued

| | | | | | | |
|---|---|---|---|---|---|---|
| AI7503000999_157500_c1_771 | 2949 | 6721 | 729 | 242 | 253 | 1.2e−21 |

Description
sp: [LN:YD31_HELPY] [AC:O25889] [GN:HP1331] [OR:*HELICOBACTER PYLORI*]
[SR:,*CANPYLOBACTER PYLORI*] [DE:HYPOTHETICAL PROTEIN HP1331] [SP:025889]
[DB:swissprot] >pir: [LN:C64686] [AC:C64686] [PN:conserved hypothetical
integral membrane protein HP1331] [CL:hypothetical protein b2682]
[OR:*Helicobacter pylori*] [DB:pir2] >gp: [GI:g2314496] [LN:AE000634]
[AC:AE000634:AE000511] [PN:conserved hypothetical integral membrane]
[GN:HP1331] [OR:*Helicobacter pylori* 26695] [DB:genpept-bct2]
[DE:*Helicobacter pylori* 26695 section 112 of 134 of the completegenome.]
[NT:similar to GB:L42023 SP:P44302 PID:1008819] [LE:10600] [RE:11286]
[DI:complement]

| ORF Name | NT ID | AA ID | NT LN | AA LN | Score | P-Value |
|---|---|---|---|---|---|---|
| AI7503000999_15752213_f1_167 | 2950 | 6722 | 270 | 89 | 74 | 0.034 |

Description
gp: [GI:g2645365] [LN:SHU83823] [AC:U83823] [PN:NADH dehydrogenase subunit 4]
[GN:ND4] [OR:Mitochondrion *Sigmodon hispidus*] [SR:*Sigmodon hispidus*]
[DB:genpept-rod] [DE:*Sigmodon hispidus* NADH dehydrogenase subunit 3 (ND3)
and NADHdehydrogenase subunit 4L (ND4L) genes, complete cds,
NADHdehydrogenase subunit 4 (ND4) gene, partial cds, and tRNA-Arg
gene,complete sequence, mitochondrial genes encoding mitochondrialproducts.]
[LE:709] [RE:>1332] [DI:direct]

| ORF Name | NT ID | AA ID | NT LN | AA LN | Score | P-Value |
|---|---|---|---|---|---|---|
| AI7503000999_15788276_f3_494 | 2951 | 6723 | 198 | 65 | 56 | 0.028 |

Description
gp: [GI:g452394] [LN:BMFLC3] [AC:Z26886] [PN:Nd-sD mutant fibroin light
chain] [OR:*Bombyx mori*] [SR:domestic silkworm] [DB:genpept-inv1] [DE:*B.mori*
gene for Nd-sD mutant fibroin light chain.] [LE:<1:1275:1732]
[RE:125:1447:2074] [DI:directJoin]

| ORF Name | NT ID | AA ID | NT LN | AA LN | Score | P-Value |
|---|---|---|---|---|---|---|
| AI7503000999_15893843_f2_246 | 2952 | 6724 | 135 | 44 | | |

Description
NO-HIT

| ORF Name | NT ID | AA ID | NT LN | AA LN | Score | P-Value |
|---|---|---|---|---|---|---|
| AI7503000999_161661_f3_507 | 2953 | 6725 | 147 | 48 | | |

Description
NO-HIT

| ORF Name | NT ID | AA ID | NT LN | AA LN | Score | P-Value |
|---|---|---|---|---|---|---|
| AI7503000999_16222092_f1_44 | 2954 | 6726 | 141 | 46 | | |

Description
NO-HIT

| ORF Name | NT ID | AA ID | NT LN | AA LN | Score | P-Value |
|---|---|---|---|---|---|---|
| AI7503000999_162812_c2_1058 | 2955 | 6727 | 147 | 48 | | |

Description
NO-HIT

| ORF Name | NT ID | AA ID | NT LN | AA LN | Score | P-Value |
|---|---|---|---|---|---|---|
| AI7503000999_16432963_c1_709 | 2956 | 6728 | 1116 | 371 | 972 | 7.4e−98 |

Description
pir: [LN:A69847] [AC:A69847] [PN:cystathionine gamma-synthase homolog yjcI]
[GN:yjcI] [CL:O-succinylhomoserine (thiol)-lyase] [OR:*Bacillus subtilis*]
[DB:pir2] >gp: [GI:e1183207:g2633541] [LN:BSUB0007] [AC:Z99110:AL009126]
[GN:yjcI] [FN:unknown] [OR:*Bacillus subtilis*] [DB:genpept-bct1] [DE:*Bacillus
subtilis* complete genome (section 7 of 21): from 1194391to 1411140.]
[NT:similar to cystathionine gamma-synthase] [LE:63573] [RE:64694]
[DI:direct]

-continued

| ORF Name | NT ID | AA ID | NT LN | AA LN | Score | P-Value |
|---|---|---|---|---|---|---|
| AI7503000999_16601512_c1_834 | 2957 | 6729 | 510 | 169 | 98 | 0.0027 |

Description
gp: [GI:e1346924:g3877219] [LN:CEF4GF3] [AC:Z81085] [GN:F46F3.3]
[OR:*Caenorhabditis elegans*] [DB:genpept-inv1] [DE:*Caenorhabditis elegans*
cosmid F46F3, complete sequence.] [LE:12629:13473:14592:14734]
[RE:12740:13771:14687:14877] [DI:directJoin]

| ORF Name | NT ID | AA ID | NT LN | AA LN | Score | P-Value |
|---|---|---|---|---|---|---|
| AI7503000999_16688_c2_1062 | 2958 | 6730 | 216 | 71 | 95 | 6.4e−05 |

Description
gp: [GI:g5230679] [LN:AF036485] [AC:AF036485:AF036486:AF036487:U93364]
[PN:hypothetical protein] [OR:Plasmid pNZ4000] [DB:genpept] [DE:Plasmid
pNZ4000, complete sequence.] [NT:Orf-100] [LE:42675:1] [RE:42810:167]
[DI:complementJoin]

| ORF Name | NT ID | AA ID | NT LN | AA LN | Score | P-Value |
|---|---|---|---|---|---|---|
| AI7503000999_16695311_f2_259 | 2959 | 6731 | 693 | 230 | 1184 | 2.5e−120 |

Description
sp: [LN:TRA2_STAAU] [AC:P19380] [OR:*STAPHYLOCOCCUS AUREUS*] [DE:TRANSPOSASE
FOR INSERTION SEQUENCE-LIKE ELEMENT IS431MEC] [SP:P19380] [DB:swissprot]
>pir: [LN:S12093] [AC:S12093:JU0116] [PN:probable transposase]
[OR:*Staphylococcus aureus*] [DB:pir2] >gp: [GI:g46602] [LN:SAIS431M]
[AC:X53818:M18438] [OR:*Staphylococcus aureus*] [DB:genpept-bct1] [DE:*S.
aureus* IS431mec gene associated with methicillin resistance.] [NT:putative
transposase (AA 1–224)] [SP:P19380] [LE:272] [RE:946] [DI:direct]
>gp: [GI:e1237900:g2791991] [LN:SANECAR1I] [AC:Y14051] [PN:putative
transposase] [OR:*Staphylococcus aureus*] [DB:genpept-bct1] [DE:*Staphylococcus
aureus* mecA, mecR1, med genes and ORF168, ORF142,ORF44, ORF145 and ORF224.]
[NT:ORF224] [LE:8096] [RE:8770] [DI:direct] >gp: [GI:d1046034:g5360858]
[LN:D86934] [AC:D86934] [PN:transposase for insertion sequence-like element]
[OR:*Staphylococcus aureus*] [SR:*Staphylococcus aureus* (strain:N315) DNA,
clone_lib:library of N31] [DB:genpept] [DE:*Staphylococcus aureus* genes, mec
region, partial and complete cds.] [NT:ORF N062] [LE:48054] [RE:48728]
[DI:direct] >gp: [GI:dl046044:g5360868] [LN:D86934] [AC:D86934]
[PN:transposase for insertion sequence-like element] [OR:*Staphylococcus
aureus*] [SR:*Staphylococcus aureus* (strain:N315) DNA, clone_lib:library of
N31] [DB:genpept] [DE:*Staphylococcus aureus* genes, mec region, partial and
complete cds.] [NT:ORF N070] [LE:53400] [RE:54074] [DI:direct]

| ORF Name | NT ID | AA ID | NT LN | AA LN | Score | P-Value |
|---|---|---|---|---|---|---|
| AI7503000999_16695311_f2_282 | 2960 | 6732 | 693 | 230 | 1191 | 4.6e−121 |

Description
sp: [LN:TRA2_STAAU] [AC:P19380] [OR:*STAPHYLOCOCCUS AUREUS*] [DE:TRANSPOSASE
FOR INSERTION SEQUENCE-LIKE ELEMENT IS431MEC] [SP:P19380] [DB:swissprot]
>pir: [LN:S12093] [AC:S12093:JU0116] [PN:probable transposase]
[OR:*Staphylococcus aureus*] [DB:pir2] >gp: [GI:g46602] [LN:SAIS431M]
[AC:X53818:M18438] [OR:*Staphylococcus aureus*] [DB:genpept-bct1] [DE:*S.
aureus* IS431mec gene associated with methicillin resistance.] [NT:putative
transposase (AA 1–224)] [SP:P19380] [LE:272] [RE:946] [DI:direct]
>gp: [GI:e1237900:g2791991] [LN:SANECAR1I] [AC:Y14051] [PN:putative
transposase] [OR:*Staphylococcus aureus*] [DB:genpept-bct1] [DE:*Staphylococcus
aureus* mecA, mecR1, mecI genes and ORF168, ORF142,ORF44, ORF145 and ORF224.]
[NT:ORF224] [LE:8096] [RE:8770] [DI:direct] >gp: [GI:d1046034:g5360858]
[LN:D86934] [AC:D86934] [PN:transposase for insertion sequence-like element]
[OR:*Staphylococcus aureus*] [SR:*Staphylococcus aureus* (strain:N315) DNA,
clone_lib:library of N31] [DB:genpept] [DE:*Staphylococcus aureus* genes, mec
region, partial and complete cds.] [NT:ORF N062] [LE:48054] [RE:48728]
[DI:direct] >gp: [GI:dl046044:g5360868] [LN:D86934] [AC:D86934]
[PN:transposase for insertion sequence-like element] [OR:*Staphylococcus
aureus*] [SR:*Staphylococcus aureus* (strain:N315) DNA, clone_lib:library of
N31] [DB:genpept] [DE:*Staphylococcus aureus* genes, mec region, partial and
complete cds.] [NT:ORF N070] [LE:53400] [RE:54074] [DI:direct]

| ORF Name | NT ID | AA ID | NT LN | AA LN | Score | P-Value |
|---|---|---|---|---|---|---|
| AI7503000999_16975082_c1_860 | 2961 | 6733 | 306 | 101 | | |

Description
NO-HIT

-continued

| ORF Name | NT ID | AA ID | NT LN | AA LN | Score | P-Value |
|---|---|---|---|---|---|---|
| AI7503000999_17004551_f1_11 | 2962 | 6734 | 144 | 47 | | |

Description
NO-HIT

| ORF Name | NT ID | AA ID | NT LN | AA LN | Score | P-Value |
|---|---|---|---|---|---|---|
| AI7503000999_193812_c1_810 | 2963 | 6735 | 129 | 42 | | |

Description
NO-HIT

| ORF Name | NT ID | AA ID | NT LN | AA LN | Score | P-Value |
|---|---|---|---|---|---|---|
| AI7503000999_19531308_c1_778 | 2964 | 6736 | 129 | 42 | | |

Description
NO-HIT

| ORF Name | NT ID | AA ID | NT LN | AA LN | Score | P-Value |
|---|---|---|---|---|---|---|
| AI7503000999_19548192_c3_1120 | 2965 | 6737 | 765 | 254 | 68 | 0.00074 |

Description
pir: [LN:S44477] [AC:S44477:558747] [PN:NADH dehydrogenase (ubiquinone), chain 4L] [GN:ND4L] [CL:NADH dehydrogenase (ubiquinone) chain 4L] [OR:mitochondrion *Hansenula wingei*] [EC:1.6.5.3] [DB:pir2]

| ORF Name | NT ID | AA ID | NT LN | AA LN | Score | P-Value |
|---|---|---|---|---|---|---|
| AI7503000999_1960300_f1_181 | 2966 | 6738 | 201 | 66 | | |

Description
NO-HIT

| ORF Name | NT ID | AA ID | NT LN | AA LN | Score | P-Value |
|---|---|---|---|---|---|---|
| AI7503000999_19613436_f2_338 | 2967 | 6739 | 162 | 53 | | |

Description
NO-HIT

| ORF Name | NT ID | AA ID | NT LN | AA LN | Score | P-Value |
|---|---|---|---|---|---|---|
| AI7503000999_19647213_c3_1213 | 2968 | 6740 | 342 | 113 | 157 | 1.7e−11 |

Description
pir: [LN:C69774] [AC:C69774] [PN:transcription regulator phage-related homolog ydcN] [GN:ydcN] [OR:*Bacillus subtilis*] [DB:pir2]
>gp: [GI:d1020073:g1881293] [LN:AB001488] [AC:AB001488] [GN:ydcN] [OR:*Bacillus subtilis*] [SR:*Bacillus subtilis* (strain:168) DNA] [DB:genpept-bct1] [DE:*Bacillus subtilis* genome sequence, 148 kb sequence of the regionbetween 35 and 47 degree.] [NT:PROBABLE REPRESSOR PROTEIN.] [LE:64366] [RE:64749] [DI:complement] >gp: [GI:e1182448:g2632782] [LN:BSUB0003] [AC:Z99106:AL009126] [GN:ydcN] [FN:unknown][[OR:*Bacillus subtilis*] [DB:genpept-bct1] [DE:*Bacillus subtilis* complete genome (section 3 of 21): from 402751 to611850.] [NT:similar to transcriptional regulator] [LE:128111] [RE:128494] [DI:complement]

| ORF Name | NT ID | AA ID | NT LN | AA LN | Score | P-Value |
|---|---|---|---|---|---|---|
| AI7503000999_19719812_c1_877 | 2969 | 6741 | 474 | 157 | 803 | 6.0e−80 |

Description
sp: [LN:TRA1_STAAU] [AC:P14506] [OR:*STAPHYLOCOCCUS AUREUS*] [DE:TRANSPOSASE FOR INSERTION SEQUENCE ELEMENT IS257 IN TRANSPOSON TN4003] [SP:P14506] [DB:swissprot] >pir: [LN:S04162] [AC:504162] [PN:transposase 1] [OR:*Staphylococcus aureus*] [DB:pir2] >gp: [GI:g46748] [LN:SATN4003] [AC:X13290] [OR:*Staphylococcus aureus*] [DB:genpept-bct1] [DE:*Staphylococcus aureus* multi-resistance plasmid pSK1 DNA containingtransposon Tn4003.] [NT:transposase (AA 1–224)] [SP:P14506] [LE:89] [RE:763] [DI:complement] >gp: [GI:g46753] [LN:SATN4003] [AC:X13290] [OR:*Staphylococcus aureus*] [DB:genpept-bct1] [DE:*Staphylococcus aureus* multi-resistance plasmid pSK1 DNA containingtransposon Tn4003.] [NT:transposase (AA 1–224)] [SP:P14506] [LE:4017] [RE:4691] [DI:complement] >gp: [GI:g1762092] [LN:SEU40381] [AC:U40381] [PN:transposase] [GN:tnp] [OR:*Staphylococcus epidermidis*] [DB:genpept-bct1] [DE:*Staphyloccous epidermidis* plasmid pSK697 insertion -continued sequenceIS257(697A) putative transposase gene, complete cds.] [NT:Tnp;
putative transposase] [LE:57] [RE:731] [DI:direct] >gp: [GI:g1762098]
[LN:SEU40384] [AC:U40384] [PN:transposase] [GN:tnp] [OR:*Staphylococcus epidermidis*] [DB:genpept-bct1] [DE:*Staphyloccus epidermidis* plasmid pSK818
insertion sequenceIS257(818A) putative transposase gene, complete cds.]
[NT:Tnp; putative transposase] [LE:57] [RE:731] [DI:direct]
>gp:[GI:g3676405] [LN:AF051916] [AC:AF051916] [PN:putative transposase TnpC]
[GN:tnpC] [OR:*Staphylococcus aureus*] [DB:genpept-bct2] [DE:*Staphylococcus aureus* plasmid pJE1 remnant of replication proteinRep (rep), trimethoprim
resistance protein DfrA (dfrA), thymidylatesynthetase ThyE (thyE), and
putative transposase Tnp (tnp) genes,complete cds; and unknown gene.]
[LE:65] [RE:739] [DI:direct] >gp: [GI:g3676411] [LN:AF051916] [AC:AF051916]
[PN:putative transposase TnpE] [GN:tnpE] [OR:*Staphylococcus aureus*]
[DB:genpept-bct2] [DE:*Staphylococcus aureus* plasmid pJE1 remnant of
replication proteinRep (rep), trimethoprim resistance protein DfrA (dfrA),
thymidylatesynthetase ThyE (thyE), and putative transposase Tnp (tnp)
genes,complete cds; and unknown gene.] [LE:4409] [RE:5083] [DI:direct]
>gp: [GI:g3676433] [LN:AF051917] [AC:AF051917:L19570] [PN:putative
transposase TnpC] [GN:tnpC] [OR:*Staphylococcus aureus*] [DB:genpept-bct2]
[DE:*Staphylococcus aureus* plasmid pSK41, complete sequence.] [LE:22981]

| ORF Name | NT ID | AA ID | NT LN | AA LN | Score | P-Value |
|---|---|---|---|---|---|---|
| AI7503000999_19720462_f2_314 | 2970 | 6742 | 1203 | 400 | 370 | 4.6e−34 |

Description
sp: [LN:YJIJ_ECOLI] [AC:P39381] [GN:YJIJ] [OR:*ESCHERICHIA COLI*]
[DE:HYPOTHETICAL 41.4 KD PROTEIN IN IADA-MCRD INTERGENIC REGION (F392)]
[SP:P39381] [DB:swissprot] >pir: [LN:S56557] [AC:556557:F65247]
[PN:hypothetical 41.4K protein (iadA-mcrD intergenic region):hypothetical
protein f392] [GN:yjiJ] [OR:*Escherichia coli*] [DB:pir2] >gp: [GI:g537173]
[LN:ECOUW93] [AC:U14003] [OR:*Escherichia coli*] [DB:genpept-bct1]
[DE:*Escherichia coli* K-12 chromosomal region from 92.8 to 00.1 minutes.]
[NT:ORF_f392] [LE:252329] [RE:253507] [DI:complement] >gp: [GI:g1790788]
[LN:AE000503] [AC:AE000503:U00096] [PN:putative transport protein] [GN:yjiJ]
[FN:putative transport; Not classified] [OR:*Escherichia coli*]
[DB:genpept-bct2] [DE:*Escherichia coli* K-12 MG1655 section 393 of 400 of the
completegenome.] [NT:f392; 100 pct identical amino acid sequence and]
[LE:10037] [RE:11215] [DI:complement]

| ORF Name | NT ID | AA ID | NT LN | AA LN | Score | P-Value |
|---|---|---|---|---|---|---|
| AI7503000999_19767150_c3_1177 | 2971 | 6743 | 567 | 188 | 746 | 6.6e−74 |

Description
gp: [GI:d1046049:g5360873] [LN:D86934] [AC:D86934] [PN:orfX]
[OR:*Staphylococcus aureus*] [SR:*Staphylococcus aureus* (strain:N315) DNA,
clone_lib:library of N31] [DB:genpept] [DE:*Staphylococcus aureus* genes, mec
region, partial and complete cds.] [NT:ORF CN051] [LE:56338] [RE:>56817]
[DI:complement] >gp: [GI:d1046058:g5391439] [LN:AB014440] [AC:AB014440]
[PN:orfX] [OR:*Staphylococcus aureus*] [SR:*Staphylococcus aureus*
(strain:NCTC8325) DNA] [DB:genpept] [DE:*Staphylococcus aureus* genes for
orf1, orfX, orf2, orf3, partial andcomplete cds.] [NT:integration site of
mecDNA was predicted to locate] [LE:1396] [RE:1875] [DI:direct]

| ORF Name | NT ID | AA ID | NT LN | AA LN | Score | P-Value |
|---|---|---|---|---|---|---|
| AI7503000999_19803150_f2_421 | 2972 | 6744 | 129 | 42 | | |

Description
NO-HIT

| ORF Name | NT ID | AA ID | NT LN | AA LN | Score | P-Value |
|---|---|---|---|---|---|---|
| AI7503000999_20194532_c1_732 | 2973 | 6745 | 156 | 51 | | |

Description
NO-HIT

| ORF Name | NT ID | AA ID | NT LN | AA LN | Score | P-Value |
|---|---|---|---|---|---|---|
| AI7503000999_20329376_f1_94 | 2974 | 6746 | 174 | 57 | 57 | 0.013 |

Description
pir: [LN:D70158] [AC:D70158] [PN:lipoprotein signal peptidase,] [OR:*Borrelia burgdorferi*] [SR:, Lyme disease spirochete] [EC:3.4.23.36] [DB:pir2]
>gp: [GI:g2688373] [LN:AE001151] [AC:AE001151:AE000783] [PN:signal peptidase
II (1sp)] [GN:BB0469] [OR:*Borrelia burgdorferi*] [SR:Lyme disease spirochete]
[DB:genpept-bct2] [DE:*Borrelia burgdorferi* (section 37 of 70) of the -continued complete genome.] [NT:similar to GB:X78084 PID:459545 SP:Q59835 percent]
[LE:10907] [RE:11419] [DI:direct]

| ORF Name | NT ID | AA ID | NT LN | AA LN | Score | P-Value |
|---|---|---|---|---|---|---|
| AI7503000999_20359682_f1_169 | 2975 | 6747 | 168 | 55 | | |

Description
NO-HIT

| ORF Name | NT ID | AA ID | NT LN | AA LN | Score | P-Value |
|---|---|---|---|---|---|---|
| AI7503000999_20517318_f1_193 | 2976 | 6748 | 1200 | 399 | 1171 | 6.1e−119 |

Description
gp: [GI:e281310:g1667356] [LN:CTZ82038] [AC:Z82038] [PN:acetyl coenzyme A
acetyltransferase (thiolase)] [GN:thlA] [OR:*Thermoanaerobacterium
thermosaccharolyticum*] [DB:genpept-bct1] [EC:2.3.1.9]
[DE:*C.thermosaccharolyticum* etfB, etfA, hbd, thlA and actA genes.] [LE:2642]
[RE:3820] [DI:direct] >gp: [GI:e308220:g1903332] [LN:TTBCSOPRN] [AC:Z92974]
[PN:acetyl coenzyme A acetyltransferase (thiolase)] [GN:thl]
[OR:*Thermoanaerobacterium thermosaccharolyticum*] [DB genpept-bct1]
[EC:2.3.1.9] [DE:*T.thermosaccharolyticum* BCS operon DNA.] [LE:4835]
[RE:6013] [DI:direct]

| ORF Name | NT ID | AA ID | NT LN | AA LN | Score | P-Value |
|---|---|---|---|---|---|---|
| AI7503000999_20523253_c3_1227 | 2977 | 6749 | 252 | 83 | 447 | 3.2e−42 |

Description
sp: [LN:TRA1_STAAU] [AC:P14506] [OR:*STAPHYLOCOCCUS AUREUS*] [DE:TRANSPOSASE
FOR INSERTION SEQUENCE ELEMENT IS257 IN TRANSPOSON TN4003] [SP:P14506]
[DB:swissprot] >pir: [LN:S04162] [AC:504162] [PN:transposase 1]
[OR:*Staphylococcus aureus*] [DB:pir2] >gp: [GI:g46748] [LN:SATN4003]
[AC:X13290] [OR:*Staphylococcus aureus*] [DB:genpept-bct1] [DE:*Staphylococcus
aureus* multi-resistance plasmid pSK1 DNA containingtransposon Tn4003.]
[NT:transposase (AA 1–224)] [SP:P14506] [LE:89] [RE:763] [DI:complement]
>gp: [GI:g46753] [LN:SATN4003] [AC:X13290] [OR:*Staphylococcus aureus*]
[DB:genpept-bct1] [DE:*Staphylococcus aureus* multi-resistance plasmid pSK1
DNA containingtransposon Tn4003.] [NT:transposase (AA 1–224)] [SP:P14506]
[LE:4017] [RE:4691] [DI:complement] >gp: [GI:g1762092] [LN:SEU40381]
[AC:U40381] [PN:transposase] [GN:tnp] [OR:*Staphylococcus epidermidis*]
[DB:genpept-bct1] [DE:*Staphyloccous epidermidis* plasmid pSK697 insertion
sequenceIS257(697A) putative transposase gene, complete cds.] [NT:Tnp;
putative transposase] [LE:57] [RE:731] [DI:direct] >gp: [GI:g1762098]
[LN:5EU40384] [AC:U40384] [PN:transposase] [GN:tnp] [OR:*Staphylococcus
epidermidis*] [DB:genpept-bct1] [DE:*Staphyloccous epidermidis* plasmid pSK818
insertion sequenceIS257(818A) putative transposase gene, complete cds.]
[NT:Tnp; putative transposase] [LE:57] [RE:731] [DI:direct]
>gp: [GI:g3676405] [LN:AF051916] [AC:AF051916] [PN:putative transposase TnpC]
[GN:tnpC] [OR:*Staphylococcus aureus*] [DB:genpept-bct2] [DE:*Staphylococcus
aureus* plasmid pJE1 remnant of replication proteinRep (rep), trimethoprim
resistance protein DfrA (dfrA), thymidylatesynthetase ThyE (thyE), and
putative transposase Tnp (tnp) genes,complete cds; and unknown gene.]
[LE:65] [RE:739] [DI:direct] >gp: [GI:g3676411] [LN:AF051916] [AC:AF051916]
[PN:putative transposase TnpE] [GN:tnpE] [OR:*Staphylococcus aureus*]
[DB:genpept-bct2] [DE:*Staphylococcus aureus* plasmid pJE1 remnant of
replication proteinRep (rep), trimethoprim resistance protein DfrA (dfrA),
thymidylatesynthetase ThyE (thyE), and putative transposase Tnp (tnp)
genes,complete cds; and unknown gene.] [LE:4409] [RE:5083] [DI:direct]
>gp: [GI:g3676433] [LN:AF051917] [AC:AF051917:L19570] [PN:putative
transposase TnpC] [GN:tnpC] [OR:*Staphylococcus aureus*] [DB:genpept-bct2]
[DE:Staphylococcus aureus plasmid pSK41, complete sequence.] [LE:22981]

| ORF Name | NT ID | AA ID | NT LN | AA LN | Score | P-Value |
|---|---|---|---|---|---|---|
| AI7503000999_20585963_c3_1206 | 2978 | 6750 | 348 | 115 | 478 | 1.7e−45 |

Description
gp: [GI:d1045998:g5360822] [LN:D86934] [AC:D86934] [PN:IS150-like
transposase] [OR:*Staphylococcus aureus*] [SR:*Staphylococcus aureus*
(strain:N315) DNA, clone_lib:library of N311 [DB:genpept] [DE:*Staphylococcus
aureus* genes, mec region, partial and complete cds.] [NT:ORF N027; putative]
[LE:19826] [RE:20179] [DI:direct]

| ORF Name | NT ID | AA ID | NT LN | AA LN | Score | P-Value |
|---|---|---|---|---|---|---|
| AI7503000999_20585963_c3_1283 | 2979 | 6751 | 906 | 301 | 647 | 2.0e−63 |

-continued

| Description |
|---|
| gp: [GI:g929972] [LN:BAU30714] [AC:U30714] [OR:*Bacillus anthracis*] [SR:plasmid pXO1] [DB:genpept-bct1] [DE:*Bacillus anthracis* Weybridge A toxin plasmid pXO1 right invertedrepeat element (WeyAR) bordering the toxin-encoding region, ORFAand ORFB genes, complete cds.] [NT:ORFB; similar to *B. anthracis* SterneL element ORFB;] [LE:512] [RE:1336] [DI:direct] >gp: [GI:g929975] [LN:BAU30715] [AC:U30715] [OR:*Bacillus anthracis*] [SR:plasmid pXO1] [DB:genpept-bct1] [DE:*Bacillus anthracis* Sterne toxin plasmid pXO1 left inverted repeatelement (SterneL) bordering the toxin-encoding region, ORFB andtruncated ORFA genes, complete cds.] [NT:ORFB; similar to *B. anthracis* WeyAR element ORFB;] [LE:458] [RE:1282] [DI:direct] >gp: [GI:g4894312] [LN:AF065404] [AC:AF065404] [PN:pXO1–96] [OR:*Bacillus anthracis*] [DB:genpept-bct2] [DE:*Bacillus anthracis* virulence plasmid PXO1, complete sequence.] [LE:116307] [RE:117131] [DI:direct] |

| ORF Name | NT ID | AA ID | NT LN | AA LN | Score | P-Value |
|---|---|---|---|---|---|---|
| AI7503000999__20964212__c3__1232 | 2980 | 6752 | 1692 | 563 | 652 | 6.0e–64 |

| Description |
|---|
| gp: [GI:d1046002:g5360826] [LN:D86934] [AC:D86934] [PN:site-specific recombinase] [GN:ccrB] [OR:*Staphylococcus aureus*] [SR:*Staphylococcus aureus* (strain:N315) DNA, clone__lib:library of N31] [DB:genpept] [DE:*Staphylococcus aureus* genes, mec region, partial and complete cds.] [NT:ORF N037; cassette chromosome recombinase B] [LE:25508] [RE:27136] [DI:direct] |

| ORF Name | NT ID | AA ID | NT LN | AA LN | Score | P-Value |
|---|---|---|---|---|---|---|
| AI7503000999__2116643__f3__472 | 2981 | 6753 | 189 | 62 | 47 | 0.0062 |

| Description |
|---|
| sp: [LN:TYB4__MOUSE] [AC:P20065] [GN:TMSB4:PTMB4] [OR:*MUS MUSCULUS*] [SR:,MOUSE] [DE:THYMOSIN BETA-4] [SP:P20065] [DB:swissprot] >pir: [LN:A37217] [AC:A37217:508074:512884] [PN:thymosin beta-4] [CL:thymosin beta] [OR:*Mus musculus*] [SR:, house mouse] [DB:pir2] >gpKGI:g54794] [LN:MMTHYB4] [AC:X16053:M38039:M54991] [OR:*Mus musculus*] [SR:house mouse] [DB:genpept-rod] [DE:Mouse mRNA for thymosin beta-4.] [NT:thymosin beta-4a (AA 1–50)] [SP:P20065] [LE:140] [RE:292] [DI:direct] |

| ORF Name | NT ID | AA ID | NT LN | AA LN | Score | P-Value |
|---|---|---|---|---|---|---|
| AI7503000999__2120265__c3__1214 | 2982 | 6754 | 870 | 289 | 151 | 6.1e–08 |

| Description |
|---|
| pir: [LN:S76167] [AC:S76167] [PN:hypothetical protein] [OR:*Synechocystis* sp.] [SR:PCC 6803, , PCC 6803] [SR:PCC 6803,] [DB:pir2] >gp: [GI:d1019159:g1653513] [LN:D90914] [AC:D90914:AB001339] [PN:hypothetical protein] [OR:*Synechocystis* sp.] [SR:*Synechocystis* sp. (strain:PCC6803) DNA] [DB:genpept-bct1] [DE:*Synechocystis* sp. PCC6803 complete genome, 16/27, 1991550–2137258.] [NT:ORF__ID:slr0959] [LE:37283] [RE:38872] [DI:direct] |

| ORF Name | NT ID | AA ID | NT LN | AA LN | Score | P-Value |
|---|---|---|---|---|---|---|
| AI7503000999__2128400__f1__188 | 2983 | 6755 | 138 | 45 | | |

| Description |
|---|
| NO-HIT |

| ORF Name | NT ID | AA ID | NT LN | AA LN | Score | P-Value |
|---|---|---|---|---|---|---|
| AI7503000999__2148468__f2__400 | 2984 | 6756 | 2073 | 690 | 1718 | 6.6e–177 |

| Description |
|---|
| gp: [GI:g3789932] [LN:AF090142] [AC:AF090142] [PN:lipase precursor] [GN:gehD] [OR:*Staphylococcus epidermidis*] [DB:genpept-bct2] [EC:3.1.1.3] [DE:*Staphylococcus epidermidis* lipase precursor (gehD) gene, completecds.] [NT:GehD] [LE:293] [RE:2224] [DI:direct] |

| ORF Name | NT ID | AA ID | NT LN | AA LN | Score | P-Value |
|---|---|---|---|---|---|---|
| AI7503000999__21506575__c1__702 | 2985 | 6757 | 897 | 298 | 331 | 6.2e–30 |

| Description |
|---|
| pir: [LN:JC5911] [AC:JC5911] [PN:lysin] [GN:lys] [OR:*Lactobacillus phage* phi-gle] [DB:pir2] |

| ORF Name | NT ID | AA ID | NT LN | AA LN | Score | P-Value |
|---|---|---|---|---|---|---|

| ORF Name | NT ID | AA ID | NT LN | AA LN | Score | P-Value |
|---|---|---|---|---|---|---|
| AI7503000999_21521878_c1_795 | 2986 | 6758 | 354 | 117 | 181 | 1.2e−12 |

Description
pir: [LN:F64114] [AC:F64114] [PN:type I site-specific deoxyribonuclease, chain hsdR] [GN:hsdR] [CL:DEAD/H box helicase homology] [OR:*Haemophilus influenzae*] [EC:3.1.21.3] [DB:pir2] >gp: [GI:g1574743] [LN:U32808] [AC:U32808:L42023] [PN:type I restriction enzyme (hsdR)] [GN:H11285] [OR:*Haemophilus influenzae* Rd] [DB:genpept-bct2] [DE:*Haemophilus influenzae* Rd section 123 of 163 of the completegenome.] [NT:similar to PID:1685100 percent identity: 59.01;] [LE:5702] [RE:8869] [DI:complement]

| ORF Name | NT ID | AA ID | NT LN | AA LN | Score | P-Value |
|---|---|---|---|---|---|---|
| AI7503000999_21532937_f2_349 | 2987 | 6759 | 129 | 42 | | |

Description
NO-HIT

| ORF Name | NT ID | AA ID | NT LN | AA LN | Score | P-Value |
|---|---|---|---|---|---|---|
| AI7503000999_21644175_c3_1179 | 2988 | 6760 | 273 | 90 | 439 | 2.2e−41 |

Description
gp: [GI:d1046045:g5360869] [LN:D86934] [AC:D86934] [OR:*Staphylococcus aureus*] [SR:*Staphylococcus aureus* (strain:N315) DNA, clone_lib:library of N31] [DB:genpept] [DE:*Staphylococcus aureus* genes, mec region, partial and complete cds.] [NT:ORF CN049] [LE:54106] [RE:>54378] [DI:complement]

| ORF Name | NT ID | AA ID | NT LN | AA LN | Score | P-Value |
|---|---|---|---|---|---|---|
| AI7503000999_21660805_f1_145 | 2989 | 6761 | 1017 | 338 | 867 | 9.9e−87 |

Description
gp: [GI:g3044072] [LN:AF055713] [AC:AF055713] [PN:beta-hemolysin] [GN:hlb] [OR:*Staphylococcus schleiferi*] [DB:genpept-bct2] [DE:*Staphylococcus schleiferi* beta-hemolysin (hib) gene, partial cds.] [LE:1] [RE:>987] [DI:direct]

| ORF Name | NT ID | AA ID | NT LN | AA LN | Score | P-Value |
|---|---|---|---|---|---|---|
| AI7503000999_21736277_f2_365 | 2990 | 6762 | 171 | 56 | | |

Description
NO-HIT

| ORF Name | NT ID | AA ID | NT LN | AA LN | Score | P-Value |
|---|---|---|---|---|---|---|
| AI7503000999_22078331_f2_355 | 2991 | 6763 | 180 | 59 | | |

Description
NO-HIT

| ORF Name | NT ID | AA ID | NT LN | AA LN | Score | P-Value |
|---|---|---|---|---|---|---|
| AI7503000999_2209675_f1_61 | 2992 | 6764 | 1470 | 489 | 465 | 3.9e−44 |

Description
sp: [LN:TYD2_PETCR] [AC:Q06086] [GN:TYRDC-2] [OR:*PETROSELINtJM CRISPUM*] [SR:,PARSLEY:*PETROSELINUM HORTENSE*] [EC:4.1.1.25] [DE:TYROSINE DECARBOXYLASE 2,] [SP:Q06086] [DB:swissprot] >pir: [LN:A44405] [AC:A44405] [PN:tyrosine decarboxylase,] [GN:tyrCD] [CL:aromatic-L-amino-acid decarboxylase:animal histidine decarboxylase homology] [OR:*Petroselinum crispum*] [SR:, parsley] [EC:4.1.1.25] [DB:pir2] >gp: [GI:g169671] [LN:PUMTRYDC2X] [AC:M96070] [PN:tyrosine decarboxylase] [GN:TryDC-2] [OR:*Petroselinum crispum*] [SR:*Petroselinum crispum* (library: lambda gt11) cDNA to mRNA] [DB:genpept-pln1] [EC:4.1.1.25] [DE:Parsley tyrosine decarboxylase (TryDC-2) mRNA, complete cds.] [LE:4] [RE:1548] [DI:direct]

| ORF Name | NT ID | AA ID | NT LN | AA LN | Score | P-Value |
|---|---|---|---|---|---|---|
| AI7503000999_2214217_c2_984 | 2993 | 6765 | 1845 | 614 | 2888 | 6.9e−301 |

Description
gp: [GI:g5114231] [LN:AF136709] [AC:AF136709] [PN:histidine kinase YycG] [GN:yycG] [OR:*Staphylococcus aureus*] [DB:genpept] [DE:*Staphylococcus aureus* response regulator YycF (yycF) and histidinekinase YycG (yycG) genes, complete cds.] [LE:1363] [RE:3189] [DI:direct]

| ORF Name | NT ID | AA ID | NT LN | AA LN | Score | P-Value |
|---|---|---|---|---|---|---|
| AI7503000999__22275082__f2__264 | 2994 | 6766 | 135 | 44 | | |

Description
NO-HIT

| ORF Name | NT ID | AA ID | NT LN | AA LN | Score | P-Value |
|---|---|---|---|---|---|---|
| AI7503000999__22291327__c2__908 | 2995 | 6767 | 141 | 46 | | |

Description
NO-HIT

| ORF Name | NT ID | AA ID | NT LN | AA LN | Score | P-Value |
|---|---|---|---|---|---|---|
| AI7503000999__22383437__f2__293 | 2996 | 6768 | 321 | 106 | 80 | 0.0091 |

Description
pir: [LN:529577] [AC:151043:529577] [PN:Ig light chain] [GN:IgL]
[OR:*Oncorhynchus mykiss*] [SR:, rainbow trout] [DB:pir2]

| ORF Name | NT ID | AA ID | NT LN | AA LN | Score | P-Value |
|---|---|---|---|---|---|---|
| AI7503000999__22475037__c3__1209 | 2997 | 6769 | 126 | 41 | 114 | 2.3e−06 |

Description
gp: [GI:g2605928] [LN:AF029727] [AC:AF029727] [OR:*Enterococcus faecium*]
[DB:genpept-bct2] [DE:*Enterococcus faecium* insertion sequence IS1485,
complete sequence.] [NT:putative; orfB] [LE:402] [RE:1238] [DI:direct]

| ORF Name | NT ID | AA ID | NT LN | AA LN | Score | P-Value |
|---|---|---|---|---|---|---|
| AI7503000999__22537563__c1__840 | 2998 | 6770 | 231 | 76 | | |

Description
NO-HIT

| ORF Name | NT ID | AA ID | NT LN | AA LN | Score | P-Value |
|---|---|---|---|---|---|---|
| AI7503000999__22679825__f1__84 | 2999 | 6771 | 168 | 55 | 111 | 7.6e−06 |

Description
pir: [LN:B69978] [AC:B69978] [PN:2-nitropropane dioxygenase homolog yrpB]
[GN:yrpB] [OR:*Bacillus subtilis*] [DB:pir2] >gp:g1934639] [LN:BSU93875]
[AC:U93875] [PN:2-nitropropane dioxygenase] [GN:yrpB] [OR:*Bacillus subtilis*]
[DB:genpept-bct1] [DE:*Bacillus subtilis* alcohol dehydrogenase (adhB) gene,
partial cds,hypothetical spore coat protein (yraF), hypothetical spore
coatprotein (yraG), YraH (yraH), YraI (yraI), YraJ (yraJ), YraK (yraK) ,YraL
(yraL), chitosanase precursor (csn), YraM (yraM), LysR-familytranscription
regulator (yraN), YraO (yraO), YrpG (yrpG), RNApolymerase sigma factor SigZ
(sigZ), YrpE (yrpE), YrpD (yrpD), YrpC(yrpC) and 2-nitropropane dioxygenase
(yrpB) genes, complete cds,and aminoglycoside 6-adenylyltransferase (aadK)
gene, partial cds.] [NT:similar to 2-nitropropane dioxigenase of Williopsis]
[LE:16473] [RE:17516] [DI:complement] >gp: [GI:e1183909:g2635125]
[LN:BSUB0014] [AC:Z99117:AL009126] [GN:yrpB] [FN:unknown] [OR:*Bacillus
subtilis*] [DB:genpept-bct1] [DE:*Bacillus subtilis* complete genome (section
14 of 21): from 2599451to 2812870.] [NT:similar to 2-nitropropane
dioxygenase] [LE:136734] [RE:137777] [DI:direct]

| ORF Name | NT ID | AA ID | NT LN | AA LN | Score | P-Value |
|---|---|---|---|---|---|---|
| AI7503000999__22900337__c2__906 | 3000 | 6772 | 135 | 44 | | |

Description
NO-HIT

| ORF Name | NT ID | AA ID | NT LN | AA LN | Score | P-Value |
|---|---|---|---|---|---|---|
| AI7503000999__22902302__c1__767 | 3001 | 6773 | 1407 | 468 | 2010 | 7.5e−208 |

Description
sp: [LN:SYS_STAAU] [AC:P95689] [GN:SERS] [OR:*STAPHYLOCOCCUS AUREUS*]
[EC:6.1.1.11] [DE:SERYL-TRNA SYNTHETASE, (SERINE--TRNA LIGASE) (SERRS)]
[SP:P95689] [DB:swissprot] >gp: [GI:e291101:g1835218] [LN:SASERS] [AC:Y09924]
[PN:seryl-trna synthetase] [GN:serS] [OR:*Staphylococcus aureus*]
[DB:genpept-bct1] [EC:6.1.1.11] [DE:*S.aureus* serS gene.] [SP:P95689] [LE:1]
[RE:1287] [DI:direct]

-continued

| ORF Name | NT ID | AA ID | NT LN | AA LN | Score | P-Value |
|---|---|---|---|---|---|---|
| AI7503000999__23437803__f3__452 | 3002 | 6774 | 714 | 237 | 129 | 7.7e−07 |

Description
gp: [GI:g4981720] [LN:AE001774] [AC:AE001774:AE000512] [PN:transcriptional regulator, crp family] [GN:TM1171] [OR:*Thermotoga maritima*] [DB:genpept-bct2] [DE:*Thermotoga maritima* section 86 of 136 of the complete genome.] [NT:similar to GB:Z26044 SP:P47200 PID:398391 percent] [LE:5164] [RE:5769] [DI:complement]

| ORF Name | NT ID | AA ID | NT LN | AA LN | Score | P-Value |
|---|---|---|---|---|---|---|
| AI7503000999__23438301__f1__87 | 3003 | 6775 | 255 | 84 | | |

Description
NO-HIT

| ORF Name | NT ID | AA ID | NT LN | AA LN | Score | P-Value |
|---|---|---|---|---|---|---|
| AI7503000999__23438876__f3__528 | 3004 | 6776 | 258 | 85 | | |

Description
NO-HIT

| ORF Name | NT ID | AA ID | NT LN | AA LN | Score | P-Value |
|---|---|---|---|---|---|---|
| AI7503000999__23439193__c3__1263 | 3005 | 6777 | 495 | 164 | 453 | 7.4e−43 |

Description
pir: [LN:G69784] [AC:G69784] [PN:hypothetical protein ydhK] [GN:ydhK] [OR:*Bacillus subtilis*] [DB:pir2] >gp: [GI:e1182558:g2632892] [LN:BSUB0004] [AC:Z99107:AL009126] [GN:ydhK] [FN:unknown] [OR:*Bacillus subtilis*] [DB:genpept-bct1] [DE:*Bacillus subtilis* complete genome (section 4 of 21): from 600701 to813890.] [LE:23509] [RE:24126] [DI:direct]
>gp: [GI:d1020482:g1945095] [LN:D88802] [AC:D88802] [GN:ydhK] [OR:*Bacillus subtilis*] [SR:*Bacillus subtilis* (sub species:Marburg, strain:168, isolate:JH642] [DB:genpept-bct1] [DE:*Bacillus subtilis* DNA for phoB-rrnE-groESL region, complete cds.] [NT:membrane protein] [LE:10511] [RE:11128] [DI:direct]

| ORF Name | NT ID | AA ID | NT LN | AA LN | Score | P-Value |
|---|---|---|---|---|---|---|
| AI7503000999__2345025__c2__913 | 3006 | 6778 | 144 | 47 | | |

Description
NO-HIT

| ORF Name | NT ID | AA ID | NT LN | AA LN | Score | P-Value |
|---|---|---|---|---|---|---|
| AI7503000999__23462762__c3__1097 | 3007 | 6779 | 1527 | 508 | 2298 | 2.3e−238 |

Description
sp: [LN:AHPF__STAAU] [AC:O05204] [GN:AHPF] [OR:*STAPHYLOCOCCUS AUREUS*] [EC:1.6.4.—] [DE:ALKYL HYDROPEROXIDE REDUCTASE SUBUNIT F,] [SP:O05204] [DB:swissprot] >gp: [GI:g1916317] [LN:SAU92441] [AC:U92441:X85029] [PN:alkyl hydroperoxide reductase subunit F] [GN:ahpF] [OR:*Staphylococcus aureus*] [DB:genpept-bct1] [DE:*Staphylococcus aureus* alkyl hydroperoxide reductase subunit C(aphC) and subunit F (aphF) genes, complete cds.] [NT:AhpF] [LE:1376] [RE:2899] [DI:direct]

| ORF Name | NT ID | AA ID | NT LN | AA LN | Score | P-Value |
|---|---|---|---|---|---|---|
| AI7503000999__23468762__f3__521 | 3008 | 6780 | 132 | 43 | | |

Description
NO-HIT

| ORF Name | NT ID | AA ID | NT LN | AA LN | Score | P-Value |
|---|---|---|---|---|---|---|
| AI7503000999__23507__c1__765 | 3009 | 6781 | 2709 | 902 | 3998 | 0.0 |

Description
gp: [GI:d1001842:g540542] [LN:STAGYRABA] [AC:D10489] [PN:DNA gyrase A] [GN:gyrA] [OR:*Staphylococcus aureus*] [SR:*Staphylococcus aureus* (strain:ATCC12600) DNA]. [DB:genpept-bct1] [EC:5.99.1.3] [DE:*Staphylococcus aureus* genes for DNA gyrase A and B, complete cds.] [LE:2152] [RE:4815] [DI:direct]

-continued

| ORF Name | NT ID | AA ID | NT LN | AA LN | Score | P-Value |
|---|---|---|---|---|---|---|
| AI7503000999__23537785_f2__233 | 3010 | 6782 | 138 | 45 | | |

Description
NO-HIT

| ORF Name | NT ID | AA ID | NT LN | AA LN | Score | P-Value |
|---|---|---|---|---|---|---|
| AI7503000999__23538427_c2__887 | 3011 | 6783 | 309 | 102 | 132 | 8.3e−09 |

Description
pir: [N:F71456] [AC:F71456] [PN:hypothetical protein PH0308] [GN:PH0308]
[OR:*Pyrococcus horikoshii*] [DB:pir2] >gp: [GI:d1030324:g3256698]
[LN:AP000001]
[AC:AP000001:AB009465:AB009464:AB009466:AB009467:AB009468:AB009469]
[PN:215aa long hypothetical protein] [GN:PH0308] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1–287000 nt. position (1/7).]
[NT:motif = prokaryotic membrane lipoprotein lipid] [LE:271764] [RE:272411]
[DI:complement]

| ORF Name | NT ID | AA ID | NT LN | AA LN | Score | P-Value |
|---|---|---|---|---|---|---|
| AI7503000999__23556577_f1__99 | 3012 | 6784 | 324 | 107 | | |

Description
NO-HIT

| ORF Name | NT ID | AA ID | NT LN | AA LN | Score | P-Value |
|---|---|---|---|---|---|---|
| AI7503000999__23563500_c1__706 | 3013 | 6785 | 156 | 51 | | |

Description
NO-HIT

| ORF Name | NT ID | AA ID | NT LN | AA LN | Score | P-Value |
|---|---|---|---|---|---|---|
| AI7503000999__235678_f2__239 | 3014 | 6786 | 216 | 71 | 203 | 2.3e−16 |

Description
pir: [LN:F69903] [AC:F69903] [PN:D-alanyl-D-alanine carboxypeptidase homolog
yodJ] [GN:yodJ] [OR:*Bacillus subtilis*] [DB:pir2] >gp: [GI:g2415396]
[LN:AF015775] [AC:AF015775] [PN:carboxypeptidase] [GN:yodJ] [OR:*Bacillus
subtilis*] [DB:genpept-bct1] [DE:*Bacillus subtilis* YodA (yodA), YodB (yodB),
YodC (yodC), YodD(yodD), ABC-transporter (yodE), permease (yodF), proteinase
(ctpA) ,YodH (yodH), YodI (yodI), carboxypeptidase (yodJ), purinenucleoside
phosphorylase (deoD), YodL (yodL), YodM (yodM), YodN(yodN), YodO (yodO),
YodP (yodP), acetylornitine deacetylase(argE), butirate-acetoacetate CoA
transferase (yodR), butyrateacetoacetate-CoA transferase (yodS), YodT
(yodT), CgeE (cgeE), CgeD(cgeD), CgeC (cgeC), CgeA (cgeA), CgeB (cgeB), YzxA
(yzxA),UDP-glucose epimerase (yodU), YodV (yodV), and YodW (yodW)
genes,complete cds; and YodZ (yodZ) gene, partial cds.] [NT:similar to
*Enterococcus faecium* D-alanil-D-alanine] [LE:8510] [RE:9331] [DI:complement]
>gp: [GI:e1185433:g2634354] [LN:BSUB0011] [AC:Z99114:AL009126] [GN:yodJ]
[FN:unknown] [OR:*Bacillus subtilis*] [DB:genpept-bct1] [DE:*Bacillus subtilis*
complete genome (section 11 of 21): from 2000171to 2207900.] [NT:similar to
D-alanyl-D-alanine carboxypeptidase] [LE:133640] [RE:134461] [DI:complement]

| ORF Name | NT ID | AA ID | NT LN | AA LN | Score | P-Value |
|---|---|---|---|---|---|---|
| AI7503000999__23610885_c1__820 | 3015 | 6787 | 126 | 41 | | |

Description
NO-HIT

| ORF Name | NT ID | AA ID | NT LN | AA LN | Score | P-Value |
|---|---|---|---|---|---|---|
| AI7503000999__23610952_c2__1082 | 3016 | 6788 | 855 | 284 | 305 | 3.6e−27 |

Description
pir: [LN:H69468] [AC:H69468] [PN:lysophospholipase homolog]
[OR:*Archaeoglobus fulgidus*] [DB:pir2] >gp: [GI:g2648798] [LN:AE000982]
[AC:AE000982:AE000782] [PN:lysophospholipase] [GN:AF1753] [OR:*Archaeoglobus
fulgidus*] [DB:genpept-bct2] [DE:*Archaeoglobus fulgidus* section 125 of 172 of
the complete genome.] [NT:similar to GP:1763011 percent identity: 33.46;]
[LE:10776] [RE:11576] [DI:complement]

-continued

| ORF Name | NT ID | AA ID | NT LN | AA LN | Score | P-Value |
|---|---|---|---|---|---|---|
| AI7503000999__23612907_c1__696 | 3017 | 6789 | 144 | 47 | | |

Description
NO-HIT

| ORF Name | NT ID | AA ID | NT LN | AA LN | Score | P-Value |
|---|---|---|---|---|---|---|
| AI7503000999__23631512_c3__1178 | 3018 | 6790 | 1323 | 440 | 2289 | 2.0e−237 |

Description
gp: [GI:d1046046:g5360870] [LN:D86934] [AC:D86934] [OR:*Staphylococcus aureus*]
[SR:*Staphylococcus aureus* (strain:N315) DNA, clone_lib:library of N31]
[DB:genpept] [DE:*Staphylococcus aureus* genes, mec region, partial and
complete cds.] [NT:ORF CN050] [LE:54760] [RE:>56082] [DI:complement]

| ORF Name | NT ID | AA ID | NT LN | AA LN | Score | P-Value |
|---|---|---|---|---|---|---|
| AI7503000999__23632883_c1__844 | 3019 | 6791 | 183 | 60 | | |

Description
NO-HIT

| ORF Name | NT ID | AA ID | NT LN | AA LN | Score | P-Value |
|---|---|---|---|---|---|---|
| AI7503000999__23634682_c2__1013 | 3020 | 6792 | 375 | 124 | | |

Description
NO-HIT

| ORF Name | NT ID | AA ID | NT LN | AA LN | Score | P-Value |
|---|---|---|---|---|---|---|
| AI7503000999__23634786_f3__619 | 3021 | 6793 | 1200 | 399 | 692 | 3.5e−68 |

Description
gp: [GI:d1025735:g2879915] [LN:D85752] [AC:D85752] [GN:bacI] [OR:*Enterococcus faecalis*] [SR:*Enterococcus faecalis* plasmid:pPD1 DNA] [DB:genpept-bct1]
[DE:*Enterococcus faecalis* plasmid pPD1 bacA, bacB, bacC, bacD, bacE, bacF,
bacG, bacH and bad genes, complete cds.] [LE:7732] [RE:8931] [DI:direct]

| ORF Name | NT ID | AA ID | NT LN | AA LN | Score | P-Value |
|---|---|---|---|---|---|---|
| AI7503000999__23635302_c1__867 | 3022 | 6794 | 138 | 45 | | |

Description
NO-HIT

| ORF Name | NT ID | AA ID | NT LN | AA LN | Score | P-Value |
|---|---|---|---|---|---|---|
| AI7503000999__23635931_c1__854 | 3023 | 6795 | 375 | 124 | 637 | 2.3e−62 |

Description
sp: [LN:MERT_STAAU] [AC:P08656] [GN:MERT] [OR:*STAPHYLOCOCCUS AUREUS*]
[DE:MERCURIC TRANSPORT PROTEIN (MERCURY ION TRANSPORT PROTEIN)] [SP:P08656]
[DB:swissprot] >pir: [LN:D29504] [AC:D29504] [PN:hypothetical 14K protein
(mer operon)] [OR:*Staphylococcus aureus*] [DB:pir2] >gp: [GI:g459906]
[LN:L29436] [AC:L29436:M15048:N00048] [GN:mert] [OR:Plasmid p1258]
[SR:Plasmid p1258 DNA] [DB:genpept-bct1] [DE:Plasmid p1258 (from *S.aureus*
strain RN23 8325) mercury resistance(mer) operon encoding mercuric reductase
(merA), organomercuriallyase (merB), regulatory protein (merR) and membrane
transportprotein (merT), complete cds.] [LE:2704] [RE:3090] [DI:direct]

| ORF Name | NT ID | AA ID | NT LN | AA LN | Score | P-Value |
|---|---|---|---|---|---|---|
| AI7503000999__23679765_f3__449 | 3024 | 6796 | 1269 | 422 | 1274 | 7.4e−130 |

Description
gp: [GI:e1299582:g3687416] [LN:BLY17554] [AC:Y17554] [PN:arginine deiminase]
[GN:arcA] [OR:*Bacillus licheniformis*] [DB:genpept-bct1] [EC:3.5.3.G]
[DE:*Bacillus licheniformis* arcA, arcB, arcC and arcD genes.] [LE:248]
[RE:1489] [DI:direct]

| ORF Name | NT ID | AA ID | NT LN | AA LN | Score | P-Value |
|---|---|---|---|---|---|---|
| AI7503000999__23703175_c3__1103 | 3025 | 6797 | 135 | 44 | | |

-continued

| Description |
|---|
| NO-HIT |

| ORF Name | NT ID | AA ID | NT LN | AA LN | Score | P-Value |
|---|---|---|---|---|---|---|
| AI7503000999__23704502__f1__158 | 3026 | 6798 | 267 | 88 | | |

| Description |
|---|
| NO-HIT |

| ORF Name | NT ID | AA ID | NT LN | AA LN | Score | P-Value |
|---|---|---|---|---|---|---|
| AI7503000999__23834461__f3__588 | 3027 | 6799 | 162 | 53 | | |

| Description |
|---|
| NO-HIT |

| ORF Name | NT ID | AA ID | NT LN | AA LN | Score | P-Value |
|---|---|---|---|---|---|---|
| AI7503000999__23860812__f2__403 | 3028 | 6800 | 603 | 200 | 540 | 4.5e−52 |

| Description |
|---|
| gp: [GI:g4l85302] [LN:AF089862] [AC:AF089862] [PN:type-I signal peptidase SipB] [GN:sipB] [OR:*Staphylococcus carnosus*] [DB:genpept-bct2] [DE:*Staphylococcus carnosus* type-I signal peptidase SipA (sipA) andtype-I signal peptidase SipB (sipB) genes, complete cds; andunknown gene.] [NT:leader peptidase] [LE:1502] [RE:2071] [DI:direct] |

| ORF Name | NT ID | AA ID | NT LN | AA LN | Score | P-Value |
|---|---|---|---|---|---|---|
| AI7503000999__23866566__c2__1067 | 3029 | 6801 | 159 | 52 | | |

| Description |
|---|
| NO-HIT |

| ORF Name | NT ID | AA ID | NT LN | AA LN | Score | P-Value |
|---|---|---|---|---|---|---|
| AI7503000999__23959802__c1__787 | 3030 | 6802 | 171 | 56 | | |

| Description |
|---|
| NO-HIT |

| ORF Name | NT ID | AA ID | NT LN | AA LN | Score | P-Value |
|---|---|---|---|---|---|---|
| AI7503000999__23959802__c3__1250 | 3031 | 6803 | 153 | 50 | | |

| Description |
|---|
| NO-HIT |

| ORF Name | NT ID | AA ID | NT LN | AA LN | Score | P-Value |
|---|---|---|---|---|---|---|
| AI7503000999__23959802__c3__1261 | 3032 | 6804 | 132 | 43 | | |

| Description |
|---|
| NO-HIT |

| ORF Name | NT ID | AA ID | NT LN | AA LN | Score | P-Value |
|---|---|---|---|---|---|---|
| AI7503000999__23959802__f2__313 | 3033 | 6805 | 210 | 69 | | |

| Description |
|---|
| NO-HIT |

| ORF Name | NT ID | AA ID | NT LN | AA LN | Score | P-Value |
|---|---|---|---|---|---|---|
| AI7503000999__23959802__f3__447 | 3034 | 6806 | 141 | 46 | | |

| Description |
|---|
| NO-HIT |

| ORF Name | NT ID | AA ID | NT LN | AA LN | Score | P-Value |
|---|---|---|---|---|---|---|
| AI7503000999__24016062__f1__168 | 3035 | 6807 | 129 | 42 | | |

| Description |
|---|
| NO-HIT |

| ORF Name | NT ID | AA ID | NT LN | AA LN | Score | P-Value |
|---|---|---|---|---|---|---|

-continued

| | | | | | | |
|---|---|---|---|---|---|---|
| AI7503000999__24023300__c2__964 | 3036 | 6808 | 516 | 171 | 760 | 2.2e−75 |

Description
sp: [LN:DNAA_STAAU] [AC:P49994] [GN:DNAA] [OR:*STAPHYLOCOCCUS AUREUS*]
[DE:CHROMOSOMAL REPLICATION INITIATOR PROTEIN DNAA] [SP:P49994]
[DB:swissprot] >pir: [LN:JC5607] [AC:JC5607] [PN:replication initiation
protein dnaA] [GN:dnaA] [CL:replication initiation protein dnaA]
[OR:*Staphylococcus aureus*] [DB:pir2] >gp: [GI:d1014451:g1694677] [LN:D89066]
[AC:D89066] [PN:DnaA] [GN:dnaA] [OR:*Staphylococcus aureus*]
[SR:*Staphylococcus aureus* DNA] [DB genpept-bct1] [DE:*Staphylococcus aureus*
DNA for DnaA, complete cds.] [LE:456] [RE:1817] [DI:direct]

| ORF Name | NT ID | AA ID | NT LN | AA LN | Score | P-Value |
|---|---|---|---|---|---|---|
| AI7503000999__24101587__f3__455 | 3037 | 6809 | 339 | 112 | 79 | 0.0098 |

Description
pir: [LN:542040] [AC:542040] [PN:hypothetical protein 3] [OR:*Leuconostoc
oenos*] [DB:pir2] >gp: [GI:g515739] [LN:LEUORF15X] [AC:L28806] [FN:unknown]
[OR:*Oenococcus oeni*] [DB:genpept-bct1] [DE:*Leuconostoc oenos* complete
ORF1–ORF5.] [NT:ORF3; putative] [LE:2571] [RE:2975] [DI:direct]
>gp: [GI:g454968] [LN:LOPLORFG] [AC:Z29976] [OR:*Oenococcus oeni*]
[DB:genpept-bct1] [DE:*L.oenos* plasmid p4028 ORF1, ORF2, ORF3, ORF4, ORF5
genes.] [NT:ORF3] [LE:2571] [RE:2975] [DI:direct]

| ORF Name | NT ID | AA ID | NT LN | AA LN | Score | P-Value |
|---|---|---|---|---|---|---|
| AI7503000999__24110635__c3__1231 | 3038 | 6810 | 132 | 43 | | |

Description
NO-HIT

| ORF Name | NT ID | AA ID | NT LN | AA LN | Score | P-Value |
|---|---|---|---|---|---|---|
| AI7503000999__24220062__c3__1104 | 3039 | 6811 | 285 | 94 | 68 | 0.045 |

Description
gp: [GI:g4731269] [LN:AF110706] [AC:AF110706] [PN:cytochrome oxidase I]
[OR:Mitochoridrion *Bemisia tabaci*] [SR:sweet potato whitefly]
[DB:genpept-inv2] [DE:*Bemisia tabaci* cytochrome oxidase I gene, partial
cds;mitochondrial gene for mitochondrial product.] [NT:premature stop
codon.] [LE:<1] [RE:330] [DI:direct]

| ORF Name | NT ID | AA ID | NT LN | AA LN | Score | P-Value |
|---|---|---|---|---|---|---|
| AI7503000999__24234562__c2__890 | 3040 | 6812 | 222 | 73 | 64 | 0.026 |

Description
gp: [GI:g4808591] [LN:AF093829] [AC:AF093829]
[PN:alpha-1,2-fucosyltransferase long form] [OR:*Helicobacter pylori*]
[DB:genpept-bct2] [DE:*Helicobacter pylori* strain UA1182
alpha-1,2-fucosyltransferasegene, alternative products, complete cds.]
[NT:ribosomal slippage] [LE:141:573] [RE:573:1042] [DI:directJoin]

| ORF Name | NT ID | AA ID | NT LN | AA LN | Score | P-Value |
|---|---|---|---|---|---|---|
| AI7503000999__24250010__c3__1271 | 3041 | 6813 | 225 | 74 | | |

Description
NO-HIT

| ORF Name | NT ID | AA ID | NT LN | AA LN | Score | P-Value |
|---|---|---|---|---|---|---|
| AI7503000999__24255312__f1__128 | 3042 | 6814 | 159 | 52 | | |

Description
NO-HIT

| ORF Name | NT ID | AA ID | NT LN | AA LN | Score | P-Value |
|---|---|---|---|---|---|---|
| AI7503000999__24256437__c1__717 | 3043 | 6815 | 141 | 46 | | |

Description
NO-HIT

| ORF Name | NT ID | AA ID | NT LN | AA LN | Score | P-Value |
|---|---|---|---|---|---|---|
| AI7503000999__24273442__f1__22 | 3044 | 6816 | 384 | 127 | 144 | 4.1e−10 |

-continued

Description
pir: [LN:C70043] [AC:C70043] [PN:hypothetical protein yvlA] [GN:yvlA] [OR:*Bacillus subtilis*] [DB:pir2] >gp: [GI:e1186201:g2636026] [LN:BSUB0018] [AC:Z99121:AL009126] [GN:yvlA] [FN:unknown] OR:*Bacillus subtilis*] [DB:genpept-bct1] [DE:*Bacillus subtilis* complete genome (section 18 of 21): from 3399551to 3609060.] [LE:207957] [RE:208283] [DI:complement] >gp: [GI:e1184419:g2636039] [LN:BSUB0019] [AC:Z99122:AL009126] [GN:yvlA] [FN:unknown] [OR:*Bacillus subtilis*] [DB:genpept-bct1] [DE:*Bacillus subtilis* complete genome (section 19 of 21): from 3597091to 3809700.] [LE:10417] [RE:10743] [DI:complement] >gp: [GI:g2618844] [LN:AF017113] [AC:AF017113] [PN:YvlA] [GN:yvlA] [OR:*Bacillus subtilis*] [DB:genpept-bct2] [DE:*Bacillus subtilis* 300–304 degree genomic sequence.] [LE:19550] [RE:19876] [DI:direct] >gp: [GI:e1184419:g2636039] [LN:BSUB0019] [AC:Z99122:AL009126] [GN:yvlA] [FN:unknown] [OR:*Bacillus subtilis*] [DB:genpept] [DE:*Bacillus subtilis* complete genome (section 19 of 21): from 3597091to 3809700.] [LE:10417] [RE:10743] [DI:complement]

| ORF Name | NT ID | AA ID | NT LN | AA LN | Score | P-Value |
|---|---|---|---|---|---|---|
| AI7503000999__24273442__f1__85 | 3045 | 6817 | 384 | 127 | 142 | 6.7e−10 |

Description
pir: [LN:C70043] [AC:C70043] [PN:hypothetical protein yvlA] [GN:yvlA] [OR:*Bacillus subtilis*] [DB:pir2] >gp: [GI:e1186201:g2636026] [LN:BSUB0018] [AC:Z99121:AL009126] [GN:yvlA] [FN:unknown] [OR:*Bacillus subtilis*] [DB:genpept-bct1] [DE:*Bacillus subtilis* complete genome (section 18 of 21): from 3399551to 3609060.] [LE:207957] [RE:208283] [DI:complement] >gp: [GI:e1184419:g2636039] [LN:BSUB0019] [AC:Z99122:AL009126] [GN:yvlA] [FN:unknown] [OR:*Bacillus subtilis*] [DB:genpept-bct1] [DE:*Bacillus subtilis* complete genome (section 19 of 21): from 3597091to 3809700.] [LE:10417] [RE:10743] [DI:complement] >gp: [GI:g2618844] [LN:AF017113] [AC:AF017113] [PN:YvlA] [GN:yvlA] [OR:*Bacillus subtilis*] [DB:genpept-bct2] [DE:*Bacillus* subtilis 300–304 degree genomic sequence.] [LE:19550] [RE:19876] [DI:direct] >gp: [GI:e1184419:g2636039] [LN:BSUB0019] [AC:Z99122:AL009126] [GN:yvlA] [FN:unknown] [OR:*Bacillus subtilis*] [DB:genpept] [DE:*Bacillus subtilis* complete genome (section 19 of 21): from 3597091to 3809700.] [LE:10417] [RE:10743] [DI:complement]

| ORF Name | NT ID | AA ID | NT LN | AA LN | Score | P-Value |
|---|---|---|---|---|---|---|
| AI7503000999__24297050__c2__904 | 3046 | 6818 | 141 | 46 | | |

Description
NO-HIT

| ORF Name | NT ID | AA ID | NT LN | AA LN | Score | P-Value |
|---|---|---|---|---|---|---|
| AI7503000999__24299037__c3__1238 | 3047 | 6819 | 255 | 84 | 68 | 0.045 |

Description
gp: [GI:g4049677] [LN:AF063866] [AC:AF063866] [PN:ORF MSV084 hypothetical protein] [GN:MSVO84] [OR:*Melanoplus sanguinipes* entomopoxvirus] [DB:genpept-vrl] [DE:*Melanoplus sanguinipes* entomopoxvirus, complete genome.] [LE:80206] [RE:80577] [DI:direct]

| ORF Name | NT ID | AA ID | NT LN | AA LN | Score | P-Value |
|---|---|---|---|---|---|---|
| AI7503000999__24329192__c2__986 | 3048 | 6820 | 180 | 59 | | |

Description
NO-HIT

| ORF Name | NT ID | AA ID | NT LN | AA LN | Score | P-Value |
|---|---|---|---|---|---|---|
| AI7503000999__24332641__c1__768 | 3049 | 6821 | 129 | 42 | | |

Description
NO-HIT

| ORF Name | NT ID | AA ID | NT LN | AA LN | Score | P-Value |
|---|---|---|---|---|---|---|
| AI7503000999__24401712__c1__826 | 3050 | 6822 | 1125 | 374 | 117 | 0.0014 |

Description
pir: [LN:C70168] [AC:C70168] [PN:DNA polymerase I (polA) homolog] [OR:*Borrelia burgdorferi*] [SR:, Lyme disease spirochete] [DB:pir2] >gp: [GI:g2688462] [LN:AE001156] [AC:AE00115G:AE000783] [PN:DNA polymerase I (polA)] [GN:BB0548] [OR:*Borrelia burgdorferi*] [SR:Lyme disease spirochete] [DB:genpept-bct2] [DE:*Borrelia burgdorferi* (section 42 of 70) of the complete genome.] [NT:similar to GB:L42023 SP:P43741 PID:1005915] [LE:6171]

-continued

[RE:8897] [DI:complement]

| ORF Name | NT ID | AA ID | NT LN | AA LN | Score | P-Value |
|---|---|---|---|---|---|---|
| AI7503000999__24406311__c3__1111 | 3051 | 6823 | 135 | 44 | | |

Description
NO-HIT

| ORF Name | NT ID | AA ID | NT LN | AA LN | Score | P-Value |
|---|---|---|---|---|---|---|
| AI7503000999__24406338__c3__1122 | 3052 | 6824 | 186 | 61 | | |

Description
NO-HIT

| ORF Name | NT ID | AA ID | NT LN | AA LN | Score | P-Value |
|---|---|---|---|---|---|---|
| AI7503000999__24407313__c2__880 | 3053 | 6825 | 126 | 41 | | |

Description
NO-HIT

| ORF Name | NT ID | AA ID | NT LN | AA LN | Score | P-Value |
|---|---|---|---|---|---|---|
| AI7503000999__24407812__c3__1182 | 3054 | 6826 | 771 | 256 | 1062 | 2.2e−107 |

Description
gp: [GI:d1046030:g5360854] [LN:D86934] [AC:D86934]
[PN:glycerophosphoryldiester phosphodiesterase] [OR:*Staphylococcus aureus*]
[SR:*Staphylococcus aureus* (strain:N315) DNA, clone lib:library of N31]
[DB:genpept] [DE:*Staphylococcus aureus* genes, mec region, partial and
complete cds.] [NT:ORF N039; putative] [LE:46160] [RE:>46792]
[DI:complement]

| ORF Name | NT ID | AA ID | NT LN | AA LN | Score | P-Value |
|---|---|---|---|---|---|---|
| AI7503000999__24407828__c3__1230 | 3055 | 6827 | 2013 | 670 | 157 | 2.1e−07 |

Description
gp: [GI:g4049717] [LN:AF063866] [AC:AF063866] [PN:ORF MSV156 hypothetical
protein] [GN:MSV156] [OR:*Melanoplus sanguinipes* entomopoxvirus]
[DB:genpept-vrl] [DE:*Melanoplus sanguinipes* entomopoxvirus, complete
genome.] [LE:140126] [RE:143509] [DI:direct]

| ORF Name | NT ID | AA ID | NT LN | AA LN | Score | P-Value |
|---|---|---|---|---|---|---|
| AI7503000999__24409452__c3__1294 | 3056 | 6828 | 432 | 143 | 132 | 7.6e−09 |

Description
sp:[LN:Y577_METJA] [AC:Q57997] [GN:MJ0577] [OR:*METHANOCOCCUS JANNASCHII*]
[DE:PROTEIN MJ0577] [SP:Q57997] [DB:swissprot] >pir:[LN:A64372] [AC:A64372]
[PN:hypothetical protein homolog MJ0577] [CL:*Escherichia coli* ybdQ protein]
[OR:*Methanococcus jannaschii*] [DB:pir2] [MP:F0R512975–513463]
>gp:[GI:g1591284] [LN:U67506] [AC:U67506:L77117] [PN:conserved hypothetical
protein] [GN:MJ0577] [OR:*Methanococcus jannaschii*] [DB:genpept-bct2]
[DE:*Methanococcus jannaschii* section 48 of 150 of the complete genome.]
[NT:similar to SP:P42297 PID:603780 PID:849027] [LE:8204] [RE:8692]
[DI direct]

| ORF Name | NT ID | AA ID | NT LN | AA LN | Score | P-Value |
|---|---|---|---|---|---|---|
| AI7503000999__24411262__f1__37 | 3057 | 6829 | 180 | 59 | | |

Description
NO-HIT

| ORF Name | NT ID | AA ID | NT LN | AA LN | Score | P-Value |
|---|---|---|---|---|---|---|
| AI7503000999__24412507__f2__339 | 3058 | 6830 | 135 | 44 | | |

Description
NO-HIT

-continued

| ORF Name | NT ID | AA ID | NT LN | AA LN | Score | P-Value |
|---|---|---|---|---|---|---|
| AI7503000999_24414680_c1_843 | 3059 | 6831 | 1287 | 428 | 141 | 1.3e−05 |

Description
gp:[GI:g1041785] [LN:PYU36927] [AC:U36927] [PN:rhoptry protein]
[FN:erythrocyte invasion and possible binding] [OR:*Plasmodium yoelii*]
[DB:genpept-inv1] [DE:*Plasmodium yoelii* rhoptry protein gene, partial cds.]
[LE:<1] [RE:7206] [DI:direct]

| ORF Name | NT ID | AA ID | NT LN | AA LN | Score | P-Value |
|---|---|---|---|---|---|---|
| AI7503000999_24414818_f3_516 | 3060 | 6832 | 441 | 146 | 94 | 0.00083 |

Description
sp:[LN:PHNB_*ECOLI*] [AC:P16681] [GN:PHNB] [OR:*ESCHERICHIA COLI*] [DE:PHNB
PROTEIN] [SP:P16681] [DB:swissprot] >pir:[LN:C35718]
[AC:C35718:S56335:B65220] [PN:phnB protein] [GN:phnB] [OR:*Escherichia
coli*] [DB:pir2] >gp:[GI:g147195] [LN:ECOPHNAQ] [AC:J05260] [OR:*Escherichia
coli*] [SR:*E.coli* (strain B) DNA] [DB:genpept-bct1] [DE:*E.coli* psiD locus
containing alkylphosphonate uptake (phn) genes Athrough Q, complete cds.]
[NT:phnB protein] [LE:3767] [RE:4210] [DI:direct] >gp:[GI:g536951]
[LN:ECOUW93] [AC:U14003] [GN:phnB] [OR:*Escherichia coli*] [DB:genpept-bct1]
[DE:*Escherichia coli* K-12 chromosomal region from 92.8 to 00.1 minutes.]
[LE:16226] [RE:16669] [DI:complement] >gp:[GI:g1790546] [LN:AE000483]
[AC:AE000483:U00096] [PN:orf, hypothetical protein] [GN:phnB] [FN:orf;
Unknown] [OR:*Escherichia coli*] [DB:genpept-bct2] [DE:*Escherichia coli* K-12
MG1655 section 373 of 400 of the complete genome.] [NT:f147; 100 pct
identical amino acid sequence and] [LE:97] [RE:540] [DI:complement]

| ORF Name | NT ID | AA ID | NT LN | AA LN | Score | P-Value |
|---|---|---|---|---|---|---|
| AI7503000999_24424092_c2_1017 | 3061 | 6833 | 522 | 173 | 104 | 0.00027 |

Description
gp:[GI:e1488089:g5051453] [LN:NME242841] [AC:AJ242841] [PN:hypothetical
protein] [OR:*Neisseria meningitidis*] [DB:genpept-bct1] [DE:*Neisseria
meningitidis* DNA for opcA region, strain Z2491.] [NT:ORFA] [LE:10162]
[RE:10707] [DI:direct] >gp:[GI:e1488089:g5051453] [LN:NME242841]
[AC:AJ242841] [PN:hypothetical protein] [OR:*Neisseria meningitidis*]
[DB:genpept] [DE:*Neisseria meningitidis* DNA for opcA region, strain Z2491.]
[NT:orfA] [LE:10162] [RE:10707] [DI:direct]

| ORF Name | NT ID | AA ID | NT LN | AA LN | Score | P-Value |
|---|---|---|---|---|---|---|
| AI7503000999_24430392_c1_856 | 3062 | 6834 | 681 | 226 | 1116 | 4.1e−113 |

Description
sp:[LN:MERB_STAAU] [AC:P08653] [GN:MERB] [OR:*STAPHYLOCOCCUS AUREUS*]
[EC:4.99.1.2] [DE:ALKYLMERCURY LYASE, (ORGANOMERCURIAL LYASE)] [SP:P08653]
[DB:swissprot] >pir: [LN:F29504] [AC:F29504] [PN:alkylmercury lyase,]
[CL:alkylmercury lyase] [OR:*Staphylococcus aureus*] [EC:4.99.1.2] [DB:pir2]
>gp:[GI:g459908] [LN:L29436] [AC:L29436:M15048:N00048] [PN:organomercurial
lyase] [GN:merB] [OR:Plasmid pI258] [SR:Plasmid pI258 DNA] [DB:genpept-bct1]
[DE:Plasmid pI258 (from *S.aureus* strain RN23 8325) mercury resistance(mer)
operon encoding mercuric reductase (merA), organomercuriallyase (merB),
regulatory protein (merR) and membrane transport protein (merT), complete
cds.] [LE:4873] [RE:5523] [DI:direct]

| ORF Name | NT ID | AA ID | NT LN | AA LN | Score | P-Value |
|---|---|---|---|---|---|---|
| AI7503000999_24431502_c3_1121 | 3063 | 6835 | 846 | 281 | 347 | 1.3e−31 |

Description
gp:[GI:g3818562] [LN:AF076529] [AC:AF076529] [PN:ATP binding protein BviA]
[GN:bviA] [OR:*Butyrivibrio fibrisolvens*] [DB:genpept-bct2] [DE:*Butyrivibrio
fibrisolvens* response regulator homolog gene, partial cds; histidine kinase
homolog, butyrivibriocin AR10 operon, complete sequence; and unknown gene.]
[LE:2342] [RE:3187] [DI:direct]

| ORF Name | NT ID | AA ID | NT LN | AA LN | Score | P-Value |
|---|---|---|---|---|---|---|
| AI7503000999_24432662_c2_1052 | 3064 | 6836 | 969 | 322 | 301 | 2.3e−47 |

Description
sp:[LN:YACK_*ECOLI*] [AC:P36649:P75655] [GN:YACK] [OR:*ESCHERICHIA COLI*]
[DE:PROBABLE 53.4 KD BLUE-COPPER PROTEIN YACQ PRECURSOR] [SP:P36649:P75655]
[DB:swissprot] >pir:[LN:C64735] [AC:C64735:S45200] [PN:probable
copper-binding protein yacK] [GN:yacK] [OR:*Escherichia coli*] [DB:pir2]

-continued

>gp:[GI:g1786314] [LN:AE000121] [AC:AE000121:U00096] [PN:orf, hypothetical
protein] [GN:yacK] [FN:orf; Unknown] [OR:*Escherichia coli*] [DB:genpept-bct2]
[DE:*Escherichia coli* K-12 MG1655 section 11 of 400 of the completegenome.]
[NT:o516; 100 pct identical to 463 residues] [LE:9364] [RE:10914]
[DI:direct]

| ORF Name | NT ID | AA ID | NT LN | AA LN | Score | P-Value |
|---|---|---|---|---|---|---|
| AI7503000999_24475252_f1_1 | 3065 | 6837 | 159 | 52 | | |

Description
NO-HIT

| ORF Name | NT ID | AA ID | NT LN | AA LN | Score | P-Value |
|---|---|---|---|---|---|---|
| AI7503000999_24486008_c2_1059 | 3066 | 6838 | 978 | 325 | 136 | 1.6e−06 |

Description
gp:[GI:g4378164] [LN:AF102543] [AC:AF102543] [PN:unknown] [OR:*Zymomonas
mobilis*] [DB:genpept-bct2] [DE:*Zymomonas mobilis*
5,10-methylenetetrahydrofolate reductase (metF)gene, partial cds;
lipoprotein precursor (vacJ), ferredoxin-NADP+reductase (fpr), succinic
semialdehyde dehydrogenase (gabD), thymidylate synthetase (thyA), gluconate
permease (gntP), UTP-glucose-1-phosphate uridyltransferase,
diaminopimelatedecarboxylase (lysA), arginosuccinate lyase (argH),
NADH-dependent butanol dehydrogenase (yugJ), and morphine 6-dehydrogenase
(mdh)genes, complete cds; tRNA-Ala gene, complete sequence; aminopeptidase N
(pepN) gene, complete cds; and unknown genes.] [NT:zm4orf2] [LE:12502]
[RE:13458] [DI:complement]

| ORF Name | NT ID | AA ID | NT LN | AA LN | Score | P-Value |
|---|---|---|---|---|---|---|
| AI7503000999_24641941_f3_456 | 3067 | 6839 | 510 | 169 | | |

Description
NO-HIT

| ORF Name | NT ID | AA ID | NT LN | AA LN | Score | P-Value |
|---|---|---|---|---|---|---|
| AI7503000999_24645817_c2_979 | 3068 | 6840 | 453 | 150 | 461 | 1.0e−43 |

Description
gp:[GI:g143421] [LN:BACRGC] [AC:M57623:J05723] [PN:ribosomal protein L9]
[GN:ribosomal protein L9] [OR:*Bacillus stearothermophilus*]
[SR:*B. stearothermophilus* DNA] [DB:genpept-bct1] [DE:*B. stearothermophilus*
ribosomal protein L9 gene, complete cds.] [LE:1] [RE:450] [DI:direct]

| ORF Name | NT ID | AA ID | NT LN | AA LN | Score | P-Value |
|---|---|---|---|---|---|---|
| AI7503000999_24647142_c2_930 | 3069 | 6841 | 645 | 214 | 575 | 8.7e−56 |

Description
gp:[GI:e352094:g2462707] [LN:SXLACRPH] [AC:Y14599] [PN:hypothetical protein]
[GN:orf5] [OR:*Staphylococcus xylosus*] [DB:genpept-bct1] [DE:*Staphylococcus
xylosus* lacR, lacP, lacH genes and 2 ORF's.] [LE:6476] [RE:7105]
[DI:complement]

| ORF Name | NT ID | AA ID | NT LN | AA LN | Score | P-Value |
|---|---|---|---|---|---|---|
| AI7503000999_24647292_f3_668 | 3070 | 6842 | 1275 | 424 | 1180 | 6.7e−120 |

Description
sp:[LN:PBUX_BACSU] [AC:P42086] [GN:PBUX] [OR:*BACILLUS SUBTILIS*] [DE:XANTHINE
PERMEASE] [SP:P42086] [DB:swissprot] >pir:[LN:S51310] [AC:S51310:E69673]
[PN:xanthine permease pbuX] [GN:pbuX] [CL:xanthine permease pbuX]
[OR:*Bacillus subtilis*] [DB:pir2] >gp:[GI:g1256618] [LN:BACYACA] [AC:L77246]
[PN:transport protein] [GN:ypaQ] [FN:pyrimidine salvage] [OR:*Bacillus
subtilis*] [DB:genpept-bct1] [DE:*Bacillus subtilis* (YAC10-9 clone) DNA region
between the serA and kdg loci.] [NT:26% of identity to the *Bacillus
caldolyticus* uracil] [LE:2007] [RE:3323] [DI:direct]
>gp:[GI:e1183652:g2634625] [LN:BSUB0012] [AC:Z99115:AL009126] [PN:xanthine
permease] [GN:pbuX] [OR:Bacillus subtilis] [DB:genpept-bct1] [DE:*Bacillus
subtilis* complete genome (section 12 of 21): from 2195541 to 2409220.]
[NT:alternate gene name:ypaQ] [SP:P42086] [LE:121829] [RE:123145]
[DI:complement] >gp:[GI:g633170] [LN:BSXPTPBUX] [AC:X83878] [PN:xanthine
permease] [GN:pbuX] [OR:*Bacillus subtilis*] [DB:genpept-bct1] [DE:*B. subtilis*
xpt and pbuX genes.] [SP:P42086] [LE:938] [RE:2254] [DI:direct]

-continued

| ORF Name | NT ID | AA ID | NT LN | AA LN | Score | P-Value |
|---|---|---|---|---|---|---|
| AI7503000999_24650427_f3_493 | 3071 | 6843 | 3126 | 1041 | 1653 | 2.3e−220 |

Description
pir:[LN:F64114] [AC:F64114] [PN:type I site-specific deoxyribonuclease, chain hsdR] [GN:hsdR] [CL:DEAD/H box helicase homology] [OR:*Haemophilus influenzae*] [EC:3.1.21.3] [DB:pir2] >gp:(GI:g1574743] [LN:U32808] [AC:U32808:L42023] [PN:type I restriction enzyme (hsdR)] [GN:HI1285] [OR:*Haemophilus influenzae* Rd] [DB:genpept-bct2] [DE:*Haemophilus influenzae* Rd section 123 of 163 of the completegenome.] [NT:similar to PID:1685100 percent identity:59.01;] [LE:5702] [RE:8869] [DI:complement]

| ORF Name | NT ID | AA ID | NT LN | AA LN | Score | P-Value |
|---|---|---|---|---|---|---|
| AI7503000999_24783462_c2_1016 | 3072 | 6844 | 339 | 112 | 77 | 0.0086 |

Description
gp:[GI:g2772544] [LN:STREMM40G] [AC:L46817] [PN:M-40 protein] [GN:emm40] [FN:antiphagocytic] [OR:*Streptococcus pyogenes*] [DB:genpept-bct2] [DE:*Streptococcus pyogenes* M-40 protein (emm40) gene, partial cds.] [LE:<1] [RE:>341] [DI:direct]

| ORF Name | NT ID | AA ID | NT LN | AA LN | Score | P-Value |
|---|---|---|---|---|---|---|
| AI7503000999_24797126_f1_88 | 3073 | 6845 | 249 | 82 | 69 | 0.036 |

Description
gp:[GI:g2772603] [LN:DMU85764] [AC:U85764] [PN:accessory gland protein Acp32CD] [GN:Acp32CD] [FN:responsible for physiological and behavioral] [OR:*Drosophila melanogaster*] [SR:fruit fly] [DB:genpept-inv1] [DE:*Drosophila melanogaster* accessory gland protein Acp32CD (Acp32CD) gene, partial cds.] [LE:74] [RE:>377] [DI:direct]

| ORF Name | NT ID | AA ID | NT LN | AA LN | Score | P-Value |
|---|---|---|---|---|---|---|
| AI7503000999_24800412_c2_981 | 3074 | 6846 | 147 | 48 | | |

Description
NO-HIT

| ORF Name | NT ID | AA ID | NT LN | AA LN | Score | P-Value |
|---|---|---|---|---|---|---|
| AI7503000999_24812927_f2_227 | 3075 | 6847 | 183 | 60 | | |

Description
NO-HIT

| ORF Name | NT ID | AA ID | NT LN | AA LN | Score | P-Value |
|---|---|---|---|---|---|---|
| AI7503000999_24817142_c1_764 | 3076 | 6848 | 1947 | 648 | 3147 | 0.0 |

Description
pir:[LN:A40585] [AC:A40585:A35406:S54711:A42295:S36024] [PN:DNA topoisomerase (ATP-hydrolyzing), chain B] [GN:gyrB] [CL:DNA topoisomerase (ATP-hydrolyzing) chain B] [OR:*Staphylococcus aureus*] [EC:5.99.1.3] [DB:pir1] >gp:[GI:g296395] [LN:SAGYRREC] [AC:X71437] [PN:DNA gyrase] [GN:gyrB] [OR:*Staphylococcus aureus*] [DB:genpept-bct1] [DE:*S.aureus* genes gyrB, gyrA and recF (partial).] [SP:P20832] [LE:282] [RE:2216] [DI:direct] >gp:[GI:d1001841:g540541] [LN:STAGYRABA] [AC:D10489] [PN:DNA gyrase B] [GN:gyrB] [OR:*Staphylococcus aureus*] [SR:*Staphylococcus aureus* [strain:ATCC12600) DNA] [DB:genpept-bct1] [EC:5.99.1.3] [DE:*Staphylococcus aureus* genes for DNA gyrase A and B, complete cds.] [LE:181] [RE:2115] [DI:direct]

| ORF Name | NT ID | AA ID | NT LN | AA LN | Score | P-Value |
|---|---|---|---|---|---|---|
| AI7503000999_24847250_f2_320 | 3077 | 6849 | 153 | 50 | | |

Description
NO-HIT

| ORF Name | NT ID | AA ID | NT LN | AA LN | Score | P-Value |
|---|---|---|---|---|---|---|
| AI7503000999_24848452_c3_1175 | 3078 | 6850 | 792 | 263 | 223 | 1.7e−18 |

Description
pir:[LN:H70089] [AC:H70089] [PN:hypothetical protein yycI] [GN:yycI] [OR:*Bacillus subtilis*] [DB:pir2] >gp:[GI:d1011959:g1064811] [LN:BACGNTZA]

-continued

[AC:D78193] [GN:yycI] [OR:*Bacillus subtilis*] [SR:*Bacillus subtilis*
(strain:168) DNA] [DB:genpept-bct1] [DE:*Bacillus subtilis* 36kb sequence
between gntZ and trnY genes encoding 34 ORFs.] [LE:31210] [RE:32052]
[DI:complement] >gp:[GI:e1184764:g2636585] [LN:BSUB0021]
[AC:Z99124:AL009126] [GN:yycI] [FN:unknown] [OR:*Bacillus subtilis*]
[DB:genpept-bct1] [DE:*Bacillus subtilis* complete genome (section 21 of 21):
from 3999281 to 4214814.] [LE:149594] [RE:150436] [DI:complement]

| ORF Name | NT ID | AA ID | NT LN | AA LN | Score | P-Value |
|---|---|---|---|---|---|---|
| AI7503000999__254527__c2__1038 | 3079 | 6851 | 186 | 61 | | |

Description
NO-HIT

| ORF Name | NT ID | AA ID | NT LN | AA LN | Score | P-Value |
|---|---|---|---|---|---|---|
| AI7503000999__25548452__f1__207 | 3080 | 6852 | 915 | 304 | 354 | 2.3e−32 |

Description
pir:[LN:A69867] [AC:A69867] [PN:conserved hypothetical protein ykuT]
[GN:ykuT] [OR:*Bacillus subtilis*] [DB:pir2] >gp:[GI:e1181925:g2632241]
[LN:BS16829KB] [AC:AJ222587] [PN:YkuT protein] [GN:ykuT] [OR:*Bacillus
subtilis*] [DB:genpept-bct1] [DE:*Bacillus subtilis* 29kB DNA fragment from
ykwC gene to cse15 gene.] [LE:25580] [RE:26383] [DI:complement]
>gp:[GI:e1185011:g2633792] [LN:BSUB0008] [AC:Z99111:AL009126] [GN:ykuT]
[FN:unknown] [OR:*Bacillus subtilis*] [DB:genpept-bct1] [DE:*Bacillus subtilis*
complete genome (section 8 of 21): from 1394791 to 1603020.] [NT:similar to
hypothetical proteins] [LE:95836] [RE:96639] [DI:complement]

| ORF Name | NT ID | AA ID | NT LN | AA LN | Score | P-Value |
|---|---|---|---|---|---|---|
| AI7503000999__25554012__c2__912 | 3081 | 6853 | 213 | 70 | | |

Description
NO-HIT

| ORF Name | NT ID | AA ID | NT LN | AA LN | Score | P-Value |
|---|---|---|---|---|---|---|
| AI7503000999__25554675__c3__1094 | 3082 | 6854 | 927 | 308 | 179 | 2.5e−11 |

Description
sp:[LN:SR40__YEAST] [AC:P32583] [GN:SRP40:YKR092C:YKR412A] [OR:*SACCHAROMYCES
CEREVISIAE*] [SR:,BAKER'S YEAST] [DE:SUPPRESSOR PROTEIN SRP40] [SP:P32583]
[DB:swissprot] >pir:[LN:538170] [AC:S38170:S40645:S37702] [PN:SRP40
protein:protein YKR092c:protein YKR412a] [GN:SRP40] [OR:*Saccharomyces
cerevisiae*] [DB:pir2] [MP:11R] >gp:[GI:g450552] [LN:SCDNACHXI] [AC:X73541]
[OR:*Saccharomyces cerevisiae*] [SR:baker's yeast] [DB:genpept-pln1]
[DE:*S.cerevisiae* DNA of chromosome XI, right arm.] [NT:ORF YKR412]
[SP:P32583] [LE:1952] [RE:3172] [DI:complement] >gp:[GI:g486581]
[LN:SCYKR092C] [AC:Z28317:Y13137] [GN:SRP40] [OR:*Saccharomyces cerevisiae*]
[SR:baker's yeast] [DB:genpept-pln1] [DE:*S.cerevisiae* chromosome XI reading
frame ORF YKR092c.] [NT:ORF YKR092c] [SP:P32583] [LE:400] [RE:1620]
[DI:complement]

| ORF Name | NT ID | AA ID | NT LN | AA LN | Score | P-Value |
|---|---|---|---|---|---|---|
| AI7503000999__25565637__f2__257 | 3083 | 6855 | 126 | 41 | | |

Description
NO-HIT

| ORF Name | NT ID | AA ID | NT LN | AA LN | Score | P-Value |
|---|---|---|---|---|---|---|
| AI7503000999__25583568__f1__12 | 3084 | 6856 | 363 | 120 | 71 | 0.022 |

Description
pir:[LN:T03326] [AC:T03326] [PN:gene 119 protein] [GN:119] [OR:*Lactococcus
phage bIL170*] [DB:pir2] >gp:[GI:g3282279] [LN:AF009630] [AC:AF009630]
[PN:119] [GN:119] [OR:bacteriophage bIL170] [DB:genpept-phg]
[DE:Bacteriophage bIL170, complete genome.] [LE:15351] [RE:15644]
[DI:direct]

| ORF Name | NT ID | AA ID | NT LN | AA LN | Score | P-Value |
|---|---|---|---|---|---|---|
| AI7503000999__25587802__c1__809 | 3085 | 6857 | 777 | 258 | 114 | 0.00010 |

Description
sp:[LN:FLIZ__BORBU] [AC:Q44904:Q44764] [GN:FLIZ:BB0276] [OR:*BORRELIA*

-continued

*BURGDORFERI*] [SR:,LYME DISEASE SPIROCHETE] [DE:FLAGELLAR PROTEIN FLIZ]
[SP:Q44904:Q44764] [DB:swissprot] >pir:[LN:D70134] [AC:D70134]
[PN:flagellar biosynthesis protein (fliZ) homolog] [OR:*Borrelia burgdorferi*]
[SR:,Lyme disease spirochete] [DB:pir2] >gp:[GI:g1165261] [LN:BBU43739]
[AC:U43739] [PN:FliZ] [GN:fliZ] [OR:*Borrelia burgdorferi*] [SR:Lyme disease
spirochete strain=B31] [DB:genpept-bct1] [DE:*Borrelia burgdorferi* fesmid
clone 31, complete sequence.] [NT:flagellar protein required for flagella
formation] [LE:9847] [RE:10473] [DI:complement] >gp:[GI:g2688190]
[LN:AE001137] [AC:AE001137:AE000783] [PN:flagellar biosynthesis protein
(fliZ)] [GN:BB0276] [OR:*Borrelia burgdorferi*] [SR:Lyme disease spirochete]
[DB:genpept-bct2] [DE:*Borrelia burgdorferi* (section 23 of 70) of the
complete genome.] [NT:similar to PID:1165261 PID:1185058 SP:Q44904]
[LE:15237] [RE:15863] [DI:complement]

| ORF Name | NT ID | AA ID | NT LN | AA LN | Score | P-Value |
|---|---|---|---|---|---|---|
| AI7503000999_25642038_f3_481 | 3086 | 6858 | 138 | 45 | | |

Description
NO-HIT

| ORF Name | NT ID | AA ID | NT LN | AA LN | Score | P-Value |
|---|---|---|---|---|---|---|
| AI7503000999_25660880_c2_975 | 3087 | 6859 | 177 | 58 | | |

Description
NO-HIT

| ORF Name | NT ID | AA ID | NT LN | AA LN | Score | P-Value |
|---|---|---|---|---|---|---|
| AI7503000999_25667767_c3_1114 | 3088 | 6860 | 1191 | 396 | 907 | 5.7e−91 |

Description
pir:[LN:B69847] [AC:B69847] [PN:cystathionine beta-lyase homolog yjcJ]
[GN:yjcJ] [CL:O-succinylhomoserine (thiol)-lyase] [OR:*Bacillus subtilis*]
[DB:pir2] >gp:[GI:e1183208:g2633542] [LN:BSUB0007] [AC:Z99110:AL009126]
[GN:yjcJ] [FN:unknown] [OR:*Bacillus subtilis*] [DB:genpept-bct1] [DE:*Bacillus
subtilis* complete genome (section 7 of 21): from 1194390 to 1411140.]
[NT:similar to cystathionine beta-lyase] [LE:64687] [RE:65859] [DI:direct]

| ORF Name | NT ID | AA ID | NT LN | AA LN | Score | P-Value |
|---|---|---|---|---|---|---|
| AI7503000999_25679712_f3_626 | 3089 | 6861 | 660 | 219 | 153 | 2.0e−09 |

Description
gp:[GI:e1315386:g3417427] [LN:SPBC30B4] [AC:AL031262] [PN:hypothetical
protein] [GN:SPBC30B4.01c] [OR:*Schizosaccharomyces pombe*] [SR:fission yeast]
[DB:genpept-pln1] [DE:*S. pombe* chromosome II cosmid c30B4.] [NT:SPBC30B4.01c,
len:344aa, similarity, YNL283C,] [LE:<1] [RE:1034] [DI:complement]

| ORF Name | NT ID | AA ID | NT LN | AA LN | Score | P-Value |
|---|---|---|---|---|---|---|
| AI7503000999_25792911_c1_777 | 3090 | 6862 | 129 | 42 | | |

Description
NO-HIT

| ORF Name | NT ID | AA ID | NT LN | AA LN | Score | P-Value |
|---|---|---|---|---|---|---|
| AI7503000999_25831512_c3_1105 | 3091 | 6863 | 129 | 42 | | |

Description
NO-HIT

| ORF Name | NT ID | AA ID | NT LN | AA LN | Score | P-Value |
|---|---|---|---|---|---|---|
| AI7503000999_26172675_f1_124 | 3092 | 6864 | 129 | 42 | | |

Description
NO-HIT

| ORF Name | NT ID | AA ID | NT LN | AA LN | Score | P-Value |
|---|---|---|---|---|---|---|
| AI7503000999_26181512_c2_1003 | 3093 | 6865 | 126 | 41 | | |

Description
NO-HIT

-continued

| ORF Name | NT ID | AA ID | NT LN | AA LN | Score | P-Value |
|---|---|---|---|---|---|---|
| AI7503000999_26198535_c3_1116 | 3094 | 6866 | 765 | 254 | 136 | 5.4e−07 |

Description
pir:[LN:D70817] [AC:D70817] [PN:hypothetical protein Rv1716] [GN:Rv1716]
[OR:*Mycobacterium tuberculosis*] [DB:pir2] >gp:[GI:e1299966:g3261548]
[LN:MTV048] [AC:AL022003:AL123456] [PN:hypothetical protein Rv1716]
[GN:Rv1716] [OR:*Mycobacterium tuberculosis*] [DB:genpept-bct1]
[DE:*Mycobacterium tuberculosis* H37Rv complete genome; segment 77/162.]
[NT:Rv1716, (MTV048.03,MTCY04C12.01) len:276. Unknown] [LE:1750] [RE:2580]
[DI:direct]

| ORF Name | NT ID | AA ID | NT LN | AA LN | Score | P-Value |
|---|---|---|---|---|---|---|
| AI7503000999_26214002_f3_647 | 3095 | 6867 | 870 | 289 | 627 | 2.7e−61 |

Description
sp:[LN:SPOJ_BACSU] [AC:P26497] [GN:SPO0J] [OR:*BACILLUS SUBTILIS*] [DE:STAGE 0
SPORULATION PROTEIN J] [SP:P26497] [DB:swissprot] >pir:[LN:A38536]
[AC:I40445:A38536:S66020:E69710:S18081] [PN:Soj antagonist/chromosome
positioning and transport protein spo0J:spo0J93 protein:stage 0 sporulation
protein J93] [GN:spo0J:spo0J93] [CL:*Bacillus subtilis* transport protein
spo0J] [OR:*Bacillus subtilis*] [DB:pir2] >gp:[GI:d1005768:g467380]
[LN:BAC180K] [AC:D26185] [PN:stage 0 sporultion] [GN:spo0J] [OR:*Bacillus
subtilis*] [SR:*Bacillus subtilis* (sub_species:Marburg, strain:168) DNA]
[DB:genpept-bct1] [DE:*B. subtilis* DNA, 180 kilobase region of replication
origin.] [LE:53552] [RE:54400] [DI:complement] >gp:[GI:g40031] [LN:BSORIGS]
[AC:X62539] [GN:spoOJ93] [OR:*Bacillus subtilis*] [DB:genpept-bct1]
[DE:*B. subtilis* genes rpmH, rnpA, 50kd, gidA and gidB.] [SP:P26497] [LE:9000]
[RE:9848] [DI:direct] >gp:[GI:e1184822:g2636643] [LN:BSUB0021]
[AC:Z99124:AL009126] [PN:antagonist of Soj] [GN:spo0J] [FN:involved in
positionning part of the chromosome] [OR:*Bacillus subtilis*]
[DB:genpept-bct1] [DE:*Bacillus subtilis* complete genome (section 21 of 21):
from 3999281 to 4214814.] [SP:P26497] [LE:205484] [RE:206332] [DI:complement]

| ORF Name | NT ID | AA ID | NT LN | AA LN | Score | P-Value |
|---|---|---|---|---|---|---|
| AI7503000999_26261512_f2_275 | 3096 | 6868 | 162 | 53 | | |

Description
NO-HIT

| ORF Name | NT ID | AA ID | NT LN | AA LN | Score | P-Value |
|---|---|---|---|---|---|---|
| AI7503000999_26351510_f2_375 | 3097 | 6869 | 138 | 45 | | |

Description
NO-HIT

| ORF Name | NT ID | AA ID | NT LN | AA LN | Score | P-Value |
|---|---|---|---|---|---|---|
| AI7503000999_26365911_f1_165 | 3098 | 6870 | 561 | 186 | 203 | 2.3e−16 |

Description
pir:[LN:E69779] [AC:E69779] [PN:transcription regulator TetR/AcrR family
homolog ydeS] [GN:ydeS] [OR:*Bacillus subtilis*] [DB:pir2]
>gp:[GI:d1020119:g1881339] [LN:AB001488] [AC:AB001488] [GN:ydeS]
[OR:*Bacillus subtilis*] [SR:*Bacillus subtilis* (strain:168) DNA]
[DB:genpept-bct1] [DE:*Bacillus subtilis* genome sequence, 148 kb sequence of
the region between 35 and 47 degree.] [NT:PROBABLE TRANSCRIPTIONAL REGULATOR,
SIMILAR TO] [LE:111555] [RE:112151] [DI:direct] >gp:[GI:e1182498:g2632832]
[LN:BSUB0003] [AC:Z99106:AL009126] [GN:ydeS] [FN:unknown] [OR:*Bacillus
subtilis*] [DB:genpept-bct1] [DE:*Bacillus subtilis* complete genome (section 3
of 21): from 402751 to 611850.] [NT:similar to transcriptional regulator
(TetR/AcrR)] [LE:175301] [RE:175897] [DI:direct]

| ORF Name | NT ID | AA ID | NT LN | AA LN | Score | P-Value |
|---|---|---|---|---|---|---|
| AI7503000999_26597010_f3_530 | 3099 | 6871 | 186 | 61 | 103 | 2.9e−05 |

Description
sp:[LN:Y4UH_RHISN] [AC:Q53200] [GN:Y4UH] [OR:*RHIZOBIUM* SP] [SR:NGR234,]
[DE:PUTATIVE INSERTION SEQUENCE ATP-BINDING PROTEIN Y4UH] [SP:Q53200]
[DB:swissprot] >gp:[GI:e213893:g1486429] [LN:RSPNGR234] [AC:Z68203]
[PN:transposase homologue] [GN:orf10] [OR:*Rhizobium* sp.] [SR:*Rhizobium* sp]
[DB:genpept-bct1] [DE:*Rhizobium* sp. plasmid NGR234a DNA.] [NT:putative]
[SP:Q53200] [LE:13370] [RE:14116] [DI:complement] >gp:[GI:g2182658]
[LN:AE000099] [AC:AE000099:U00090] [PN:Y4uH] [GN:y4uH] [OR:*Rhizobium* sp.

-continued

NGR234] [DB:genpept-bct2] [DE:*Rhizobium* sp. NGR234 plasmid pNGR234a, section 36 of 46 of the complete plasmid sequence.] [NT:putative insertion sequence ATP-binding protein] [LE:8181] [RE:8927] [DI:complement]

| ORF Name | NT ID | AA ID | NT LN | AA LN | Score | P-Value |
|---|---|---|---|---|---|---|
| AI7503000999__266000015__f1__162 | 3100 | 6872 | 354 | 117 | 280 | 1.6e−24 |

Description
sp:[LN:RNPA_BACSU] [AC:P25814] [GN:RNPA] [OR:*BACILLUS SUBTILIS*]
[EC:3.1.26.5] [DE:RIBONUCLEASE P PROTEIN COMPONENT, (PROTEIN C5) (RNASE P)]
[SP:P25814] [DB:swissprot] >pir:[LN:S66029] [AC:S66029:D69693]
[PN:ribonuclease P protein component rnpA] [GN:rnpA] [CL:ribonuclease P, protein component] [OR:*Bacillus subtilis*] [DB:pir2]
>gp:[GI:d1005777:g467389] [LN:BAC180K] [AC:D26185] [PN:protein component of ribonuclease P] [GN:rnpA] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:62749] [RE:63099]
[DI:complement] >gp:[GI:e1184831:g2636652] [LN:BSUB0021]
[AC:Z99124:AL009126] [PN:ribonuclease P (protein component)] [GN:rnpA]
[OR:*Bacillus subtilis*] [DB:genpept-bct1] [EC:3.1.26.5] [DE:*Bacillus subtilis* complete genome (section 21 of 21): from 3999281 to 4214814.] [SP:P25814]
[LE:214681] [RE:215031] [DI:complement]

| ORF Name | NT ID | AA ID | NT LN | AA LN | Score | P-Value |
|---|---|---|---|---|---|---|
| AI7503000999__26604502__f2__390 | 3101 | 6873 | 159 | 52 | 205 | 1.4e−16 |

Description
sp:[LN:RL34_BACST] [AC:P23376] [GN:RPMH] [OR:*BACILLUS STEAROTHERMOPHILUS*]
[DE:50S RIBOSOMAL PROTEIN L34] [SP:P23376] [DB:swissprot] >pir:[LN:C48396]
[AC:C48396] [PN:ribosomal protein L34] [CL:*Escherichia coli* ribosomal protein L34] [OR:*Bacillus stearothermophilus*] [DB:pir2]

| ORF Name | NT ID | AA ID | NT LN | AA LN | Score | P-Value |
|---|---|---|---|---|---|---|
| AI7503000999__26615636__f1__194 | 3102 | 6874 | 144 | 47 | | |

Description
NO-HIT

| ORF Name | NT ID | AA ID | NT LN | AA LN | Score | P-Value |
|---|---|---|---|---|---|---|
| AI7503000999__26756660__c2__950 | 3103 | 6875 | 651 | 216 | 19 | 0.00035 |

Description
pir:[LN:B69858] [AC:B69858] [PN:hypothetical protein yknW] [GN:yknW]
[OR:*Bacillus subtilis*] [DB:pir2] >gp:[GI:e1185024:g2633805] [LN:BSUB0008]
[AC:Z99111:AL009126] [GN:yknW] [FN:unknown] [OR:*Bacillus subtilis*]
[DB:genpept-bct1] [DE:*Bacillus subtilis* complete genome (section 8 of 21): from 1394791 to 1603020.] [LE:108197] [RE:108892] [DI:direct]
>gp:[GI:g3282118] [LN:AF012285] [AC:AF012285:AF012284:U51911] [PN:YknW]
[GN:yknW] [OR:*Bacillus subtilis*] [DB:genpept-bct2] [DE:*Bacillus subtilis* mobA-nprE gene region.] [LE:8685] [RE:9380] [DI:direct]

| ORF Name | NT ID | AA ID | NT LN | AA LN | Score | P-Value |
|---|---|---|---|---|---|---|
| AI7503000999__26759707__c1__830 | 3104 | 6876 | 450 | 149 | 504 | 2.9e−48 |

Description
gp:[GI:d1046006:g5360830] [LN:D86934] [AC:D86934] [OR:*Staphylococcus aureus*]
[SR:*Staphylococcus aureus* (strain:N315) DNA, clone_lib:library of N31]
[DB:genpept] [DE:*Staphylococcus aureus* genes, mec region, partial and complete cds.] [NT:ORF N044] [LE:28947] [RE:29264] [DI:direct]

| ORF Name | NT ID | AA ID | NT LN | AA LN | Score | P-Value |
|---|---|---|---|---|---|---|
| AI7503000999__270890__c3__1162 | 3105 | 6877 | 186 | 61 | | |

Description
NO-HIT

| ORF Name | NT ID | AA ID | NT LN | AA LN | Score | P-Value |
|---|---|---|---|---|---|---|
| AI7503000999__2745462__c1__691 | 3106 | 6878 | 642 | 213 | 116 | 0.00066 |

Description
gp:[GI:e1407824:g4493894] [LN:PFMAL3P2] [AC:AL034558] [GN:MAL3P2.16]
[OR:*Plasmodium falciparum*] [SR:malaria parasite *P. falciparum*]

-continued

[DB:genpept-inv1] [DE:*Plasmodium falciparum* MAL3P2, complete sequence.]
[NT:predicted using hexExon; MAL3P2.16 (PF0235w),] [LE:73132:73647]
[RE:73149:77270] [DI:directJoin]

| ORF Name | NT ID | AA ID | NT LN | AA LN | Score | P-Value |
|---|---|---|---|---|---|---|
| AI7503000999__2782563__c3__1129 | 3107 | 6879 | 153 | 50 | | |

Description
NO-HIT

| ORF Name | NT ID | AA ID | NT LN | AA LN | Score | P-Value |
|---|---|---|---|---|---|---|
| AI7503000999__2819632__f1__105 | 3108 | 6880 | 387 | 128 | | |

Description
NO-HIT

| ORF Name | NT ID | AA ID | NT LN | AA LN | Score | P-Value |
|---|---|---|---|---|---|---|
| AI7503000999__2867812__c2__1060 | 3109 | 6881 | 213 | 70 | | |

Description
NO-HIT

| ORF Name | NT ID | AA ID | NT LN | AA LN | Score | P-Value |
|---|---|---|---|---|---|---|
| AI7503000999__2921941__c1__680 | 3110 | 6882 | 159 | 52 | | |

Description
NO-HIT

| ORF Name | NT ID | AA ID | NT LN | AA LN | Score | P-Value |
|---|---|---|---|---|---|---|
| AI7503000999__2925292__f2__325 | 3111 | 6883 | 123 | 40 | | |

Description
NO-HIT

| ORF Name | NT ID | AA ID | NT LN | AA LN | Score | P-Value |
|---|---|---|---|---|---|---|
| AI7503000999__2931557__c3__1158 | 3112 | 6884 | 1119 | 372 | 1692 | 3.7e−174 |

Description
sp:[LN:RECF__STAAU] [AC:P29232] [GN:RECF] [OR:*STAPHYLOCOCCUS AUREUS*] [DE:RECF
PROTEIN] [SP:P29232] [DB:swissprot] >pir:[LN:C40585]
[AC:S54710:C40585:C42295:S36023] [PN:recF protein] [CL:recF protein]
[OR:*Staphylococcus aureus*] [DB:pir2]

| ORF Name | NT ID | AA ID | NT LN | AA LN | Score | P-Value |
|---|---|---|---|---|---|---|
| AI7503000999__29320127__c3__1181 | 3113 | 6885 | 390 | 129 | 677 | 1.4e−66 |

Description
gp:[GI:d1046033:g5360857] [LN:D86934] [AC:D86934] [OR:*Staphylococcus aureus*]
[SR:*Staphylococcus aureus* (strain:N315) DNA, clone__lib:library of N31]
[DB:genpept] [DE:*Staphylococcus aureus* genes, mec region, partial and
complete cds.] [NT:ORF CN041] [LE:47629] [RE:>48018] [DI:complement]

| ORF Name | NT ID | AA ID | NT LN | AA LN | Score | P-Value |
|---|---|---|---|---|---|---|
| AI7503000999__2946092__c2__1006 | 3114 | 6886 | 435 | 144 | 97 | 0.00051 |

Description
pir:[LN:F71224] [AC:F71224] [PN:hypothetical protein PH0057] [GN:PH0057]
[CL:protein kinase C inhibitor:histidine triad homology] [OR:*Pyrococcus
horikoshii*] [DB:pir2] >gp:[GI:d1030068:g3256442] [LN:AP000001]
[AC:AP000001:AB009465:AB009464:AB009466:AB009467:AB009468:AB009469]
[PN:168aa long hypothetical protein] [GN:PH0057] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 1-287000 nt. position (1/7).] [NT:similar to
owl:HPAE00058613 percent identity:] [LE:49752] [RE:50258] [DI:complement]

| ORF Name | NT ID | AA ID | NT LN | AA LN | Score | P-Value |
|---|---|---|---|---|---|---|
| AI7503000999__29532926__c3__1128 | 3115 | 6887 | 156 | 51 | | |

-continued

| Description | | | | | | |
|---|---|---|---|---|---|---|
| NO-HIT | | | | | | |
| ORF Name | NT ID | AA ID | NT LN | AA LN | Score | P-Value |
| AI7503000999__29860902__c3__1115 | 3116 | 6888 | 2277 | 758 | 1816 | 2.7e−187 |

Description
pir:[LN:C69657] [AC:C69657] [PN:cobalamin-independent methionine synthase metC] [GN:metC] [CL:cobalamin-independent methionine synthase] [OR:*Bacillus subtilis*] [DB:pir2] >gp:[GI:e1181518:g2632038] [LN:BSAJ2571] [AC:AJ002571] [PN:MetC] [GN:metC] [FN:involved in methionine metabolism] [OR:*Bacillus subtilis*] [DB:genpept-bct1] [DE:*Bacillus subtilis* 168 56 kb DNA fragment between xlyA and ykoR.] [SP:P80877] [LE:35445] [RE:37733] [DI:complement] >gp:[GI:e1183338:g2633672] [LN:BSUB0007] [AC:Z99110:AL009126] [PN:cobalamin-independent methionine synthase] [GN:metC] [FN:methionine biosynthesis] [OR:*Bacillus subtilis*] [DB:genpept-bct1] [DE:*Bacillus subtilis* complete genome (section 7 of 21): from 1194391 to 1411140.] [SP:P80877] [LE:188394] [RE:190682] [DI:complement]

| ORF Name | NT ID | AA ID | NT LN | AA LN | Score | P-Value |
|---|---|---|---|---|---|---|
| AI7503000999__3007887__f1__113 | 3117 | 6889 | 129 | 42 | | |

| Description | | | | | | |
|---|---|---|---|---|---|---|
| NO-HIT | | | | | | |
| ORF Name | NT ID | AA ID | NT LN | AA LN | Score | P-Value |
| AI7503000999__30080255__f1__172 | 3118 | 6890 | 384 | 127 | | |

| Description | | | | | | |
|---|---|---|---|---|---|---|
| NO-HIT | | | | | | |
| ORF Name | NT ID | AA ID | NT LN | AA LN | Score | P-Value |
| AI7503000999__30084637__f3__567 | 3119 | 6891 | 156 | 51 | | |

| Description | | | | | | |
|---|---|---|---|---|---|---|
| NO-HIT | | | | | | |
| ORF Name | NT ID | AA ID | NT LN | AA LN | Score | P-Value |
| AI7503000999__30086682__c2__1041 | 3120 | 6892 | 732 | 243 | 1134 | 5.1e−115 |

Description
pir:[LN:C29504] [AC:C29504] [PN:hypothetical 24K protein (mer operon)] [OR:*Staphylococcus aureus*] [DB:pir2] >gp:[GI:g459905] [LN:L29436] [AC:L29436:M15048:N00048] [OR:Plasmid pI258] [SR:Plasmid pI258 DNA] [DB:genpept-bct1] [DE:Plasmid pI258 (from *S.aureus* strain RN23 8325) mercury resistance(mer) operon encoding mercuric reductase (merA), organomercuriallyase (merB), regulatory protein (merR) and membrane transport protein (merT), complete cds.] [NT:ORF4] [LE:1936] [RE:2616] [DI direct]

| ORF Name | NT ID | AA ID | NT LN | AA LN | Score | P-Value |
|---|---|---|---|---|---|---|
| AI7503000999__30111718__c2__1051 | 3121 | 6893 | 2124 | 707 | 1980 | 7.5e−211 |

Description
sp:[LN:COPB_ENTHR] [AC:P05425] [GN:COPB] [OR:*ENTEROCOCCUS HIRAE*] [EC:3.6.1.36] [DE:COPPER/POTASSIUM-TRANSPORTING ATPASE B,] [SP:P05425] [DB:swissprot] >pir:[LN:B45995] [AC:B45995] [PN:copper-transporting ATPase, copB] [GN:copB] [CL:*Enterococcus* copper-transporting ATPase copB: ATPase nucleotide-binding domain homology:ATPase transduction domain homology] [OR:*Enterococcus hirae*] [EC:3.6.1.-] [DB:pir1] >gp:(GI:g290643] [LN:ENECOPPUMP] [AC:L13292:J02729] [PN:ATPase] [GN:copB] [FN:copper pump] [OR:*Enterococcus hirae*] [SR:*Enterococcus hirae* DNA] [DB:genpept-bct1] [DE:*Enterococcus hirae* ATPase (copA) gene, complete cds; ATPase (copB)gene, complete cds.] [NT:putative] [LE:2273] [RE:4510] [DI:direct]

| ORF Name | NT ID | AA ID | NT LN | AA LN | Score | P-Value |
|---|---|---|---|---|---|---|
| AI7503000999__30516552__f1__160 | 3122 | 6894 | 144 | 47 | | |

| Description |
|---|
| NO-HIT |

-continued

| ORF Name | NT ID | AA ID | NT LN | AA LN | Score | P-Value |
|---|---|---|---|---|---|---|
| AI7503000999_31267125_c3_1216 | 3123 | 6895 | 132 | 43 | | |

Description
NO-HIT

| ORF Name | NT ID | AA ID | NT LN | AA LN | Score | P-Value |
|---|---|---|---|---|---|---|
| AI7503000999_31443827_f2_419 | 3124 | 6896 | 510 | 169 | 563 | 1.6e−54 |

Description
sp:[LN:SSB_BACSU] [AC:P37455] [GN:SSB] [OR:*BACILLUS SUBTILIS*]
[DE:SINGLE-STRAND BINDING PROTEIN (SSB) (HELIX-DESTABILIZING PROTEIN)]
[SP:P37455] [DB:swissprot] >pir:[LN:S66014] [AC:S66014:F69718] [PN:single
strand DNA binding protein ssb] [GN:ssb] [CL:single-stranded DNA-binding
protein: single-stranded DNA-binding protein homology] [OR:*Bacillus
subtilis*] [DB:pir2] >gp:[GI:d1005762:g467374] [LN:BAC180K] [AC:D26185]
[PN:single strand DNA binding protein] [GN:ssb] [OR:*Bacillus subtilis*]
[SR:*Bacillus subtilis* (sub_species:Marburg, strain:168) DNA]
[DB:genpept-bct1] [DE:*B. subtilis* DNA, 180 kilobase region of replication
origin.] [LE:46882] [RE:47400] [DI:complement] >gp:[GI:e1184816:g2636637]
[LN:BSUB0021] [AC:Z99124:AL009126] [PN:single-strand DNA-binding protein]
[GN:ssb] [OR:*Bacillus subtilis*] [DB:genpept-bct1] [DE:*Bacillus subtilis*
complete genome (section 21 of 21): from 3999281 to 4214814.] [SP:P37455]
[LE:198814] [RE:199332] [DI:complement]

| ORF Name | NT ID | AA ID | NT LN | AA LN | Score | P-Value |
|---|---|---|---|---|---|---|
| AI7503000999_31535626_f3_569 | 3125 | 6897 | 153 | 50 | | |

Description
NO-HIT

| ORF Name | NT ID | AA ID | NT LN | AA LN | Score | P-Value |
|---|---|---|---|---|---|---|
| AI7503000999_3158177_f2_232 | 3126 | 6898 | 123 | 40 | | |

Description
NO-HIT

| ORF Name | NT ID | AA ID | NT LN | AA LN | Score | P-Value |
|---|---|---|---|---|---|---|
| AI7503000999_32062762_c2_954 | 3127 | 6899 | 183 | 60 | | |

Description
NO-HIT

| ORF Name | NT ID | AA ID | NT LN | AA LN | Score | P-Value |
|---|---|---|---|---|---|---|
| AI7503000999_32226577_c3_1254 | 3128 | 6900 | 354 | 117 | 596 | 5.2e−58 |

Description
pir:[LN:B29504] [AC:B29504] [PN:hypothetical 18K protein (mer operon)]
[OR:*Staphylococcus aureus*] [DB:pir2] >gp:[GI:g459904] [LN:L29436]
[AC:L29436:M15048:N00048] [OR:Plasmid pI258] [SR:Plasmid pI258 DNA]
[DB:genpept-bct1] [DE:Plasmid pI258 (from *S.aureus* strain RN23 8325) mercury
resistance(mer) operon encoding mercuric reductase (merA),
organomercuriallyase (merB), regulatory protein (merR) and membrane
transport protein (merT), complete cds.] [NT:ORF3] [LE:1454] [RE:1939]
[DI:direct]

| ORF Name | NT ID | AA ID | NT LN | AA LN | Score | P-Value |
|---|---|---|---|---|---|---|
| AI7503000999_32423410_c1_718 | 3129 | 6901 | 210 | 69 | 167 | 1.5e−12 |

Description
sp:[LN:YG27_ARCFU] [AC:O28646] [GN:AF1627] [OR:*ARCHAEOGLOBUS FULGIDUS*]
[DE:HYPOTHETICAL TRANSCRIPTIONAL REGULATOR AF1627] [SP:O28646]
[DB:swissprot] >pir:[LN:B69453] [AC:B69453] [PN:repressor protein homolog]
[OR:*Archaeoglobus fulgidus*] [DB:pir2] >gp:[GI:g2648932] [LN:AE000990]
[AC:AE000990:AE000782] [PN:repressor protein] [GN:AF1627] [OR:*Archaeoglobus
fulgidus*] [DB:genpept-bct2] [DE:*Archaeoglobus fulgidus* section 117 of 172 of
the complete genome.] [NT:similar to GB:L77117 PID:1590997 percent
identity:] [LE:7667] [RE:7882] [DI:direct]

| ORF Name | NT ID | AA ID | NT LN | AA LN | Score | P-Value |
|---|---|---|---|---|---|---|
| AI7503000999_32577_f3_495 | 3130 | 6902 | 138 | 45 | | |

| Description | | | | | | |
|---|---|---|---|---|---|---|
| NO-HIT | | | | | | |

| ORF Name | NT ID | AA ID | NT LN | AA LN | Score | P-Value |
|---|---|---|---|---|---|---|
| AI7503000999_3320317_f3_648 | 3131 | 6903 | 237 | 78 | 150 | 9.5e−11 |

Description
gp:[GI:g2109447] [LN:SPDNAARG] [AC:AF000658] [FN:unknown] [OR:*Streptococcus pneumoniae*] [DB:genpept-bct2] [DE:*Streptococcus pneumoniae* R801 tRNA-Arg gene, partial sequence, and putative serine protease (sphtra), SPSpoJ (spspoJ), initiator protein (spdnaa) and beta subunit of DNA polymerase III (spdnan)genes, complete cds.] [NT:ORFX] [LE:5708] [RE:5902] [DI:direct]

| ORF Name | NT ID | AA ID | NT LN | AA LN | Score | P-Value |
|---|---|---|---|---|---|---|
| AI7503000999_33228180_f1_192 | 3132 | 6904 | 243 | 80 | | |

| Description | | | | | | |
|---|---|---|---|---|---|---|
| NO-HIT | | | | | | |

| ORF Name | NT ID | AA ID | NT LN | AA LN | Score | P-Value |
|---|---|---|---|---|---|---|
| AI7503000999_33244187_c3_1168 | 3133 | 6905 | 1989 | 662 | 1592 | 1.5e−163 |

Description
sp:[LN:YYBT_BACSU] [AC:P37484] [GN:YYBT] [OR:*BACILLUS SUBTILIS*] [DE:HYPOTHETICAL 74.3 KD PROTEIN IN RPLI-COTF INTERGENIC REGION] [SP:P37484] [DB:swissprot] >pir:[LN:S65976] [AC:S65976:G70088] [PN:hypothetical protein yybT] [GN:yybT] [OR:*Bacillus subtilis*] [DB:pir2] >gp:[GI:d1005724:g467336] [LN:BAC180K] [AC:D26185] [PN:unknown] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:11639] [RE:13618] [DI:complement] >gp:[GI:e1184777:g2636598] [LN:BSUB0021] [AC:Z99124:AL009126] [GN:yybT] [FN:unknown] [OR:*Bacillus subtilis*] [DB:genpept-bct1] [DE:*Bacillus subtilis* complete genome (section 21 of 21): from 3999281 to 4214814.] [SP:P37484] [LE:163571] [RE:165550] [DI:complement]

| ORF Name | NT ID | AA ID | NT LN | AA LN | Score | P-Value |
|---|---|---|---|---|---|---|
| AI7503000999_33261588_c2_1004 | 3134 | 6906 | 690 | 229 | | |

| Description | | | | | | |
|---|---|---|---|---|---|---|
| NO-HIT | | | | | | |

| ORF Name | NT ID | AA ID | NT LN | AA LN | Score | P-Value |
|---|---|---|---|---|---|---|
| AI7503000999_33261637_c3_1237 | 3135 | 6907 | 543 | 180 | 79 | 0.0068 |

Description
gp:[GI:g765070] [LN:STAATL] [AC:L41499] [OR:*Staphylococcus aureus*] [SR:*Staphylococcus aureus* (strain 8325/4) DNA] [DB:genpept-bct1] [DE:*Staphylococcus aureus* ORF1, partial cds, ORF2, ORF3, autolysin(at1) genes, complete cds.] [NT:ORF1] [LE:<1] [RE:249] [DI:direct]

| ORF Name | NT ID | AA ID | NT LN | AA LN | Score | P-Value |
|---|---|---|---|---|---|---|
| AI7503000999_33337760_c2_983 | 3136 | 6908 | 705 | 234 | 1191 | 4.6e−121 |

Description
gp:[GI:g5114230] [LN:AF136709] [AC:AF136709] [PN:response regulator YycF] [GN:yycF] [OR:*Staphylococcus aureus*] [DB:genpept] [DE:*Staphylococcus aureus* response regulator YycF (yycF) and histidinekinase YycG (yycG) genes, complete cds.] [LE:649] [RE:1350] [DI:direct]

| ORF Name | NT ID | AA ID | NT LN | AA LN | Score | P-Value |
|---|---|---|---|---|---|---|
| AI7503000999_33720053_c1_808 | 3137 | 6908 | 126 | 41 | | |

| Description | | | | | | |
|---|---|---|---|---|---|---|
| NO-HIT | | | | | | |

| ORF Name | NT ID | AA ID | NT LN | AA LN | Score | P-Value |
|---|---|---|---|---|---|---|
| AI7503000999_33790702_f3_612 | 3138 | 6910 | 150 | 49 | | |

| Description | | | | | | |
|---|---|---|---|---|---|---|
| NO-HIT | | | | | | |

-continued

| ORF Name | NT ID | AA ID | NT LN | AA LN | Score | P-Value |
|---|---|---|---|---|---|---|
| AI7503000999_33867212_f3_548 | 3139 | 6911 | 339 | 112 | | |

Description
NO-HIT

| ORF Name | NT ID | AA ID | NT LN | AA LN | Score | P-Value |
|---|---|---|---|---|---|---|
| AI7503000999_33994126_f3_633 | 3140 | 6912 | 144 | 47 | 47 | 0.045 |

Description
gp:[GI:g1204027] [LN:UREUREASEA] [AC:L40489] [OR:*Ureaplasma urealyticum*]
[SR:*Ureaplasma urealyticum* (strain 7) DNA] [B:genpept-bct1] [DE:*Ureaplasma urealyticum* strain 7 urease operon encoding ORF1, ureA, ureB, ureC, ureE, ureF, and ureG, complete cds, and ureD genes, 5' end of cds.] [NT:ORF1; Protein sequence is in conflict with the] [LE:136] [RE:468] [DI:direct]

| ORF Name | NT ID | AA ID | NT LN | AA LN | Score | P-Value |
|---|---|---|---|---|---|---|
| AI7503000999_34016880_f2_333 | 3141 | 6913 | 2028 | 675 | 3474 | 0.0 |

Description
pir:[LN:JQ0774] [AC:JQ0774] [PN:penicillin-binding protein mecA, low-affinity:penicillin-binding protein 2'] [GN:mecA] [OR:*Staphylococcus epidermidis*] [DB:pir2] >gp:[GI:g46994] [LN:SEMECAPB] [AC:X52592] [OR:*Staphylococcus epidermidis*] [DB:genpept-bct1] [DE:*S. epidermidis* mecA gene for PBP2' (penicillin binding protein 2').] [NT:PBP2' (AA1–668)] [LE:141] [RE:2147] [DI:direct] >gp:[GI:d1046026:g5360850] [LN:D86934] [AC:D86934] [PN:penicillin binding protein 2] [GN:mecA] [OR:*Staphylococcus aureus*] [SR:*Staphylococcus aureus* (strain:N315) DNA, clone_lib:library of N31] [DB:genpept] [DE:*Staphylococcus aureus* genes, mec region, partial and complete cds.] [NT:ORF N058] [LE:43471] [RE:45477] [DI:direct]

| ORF Name | NT ID | AA ID | NT LN | AA LN | Score | P-Value |
|---|---|---|---|---|---|---|
| AI7503000999_3401887_f1_225 | 3142 | 6914 | 1485 | 494 | 1969 | 1.7e−203 |

Description
pir:[LN:DEBSMP] [AC:S66039:S12623:D69638] [PN:IMP dehydrogenase,:inositol-monophosphate dehydrogenase guaB] [GN:guaB] [CL:IMP dehydrogenase:CBS homology] [OR:*Bacillus subtilis*] [EC:1.1.1.205] [DB:pir1] >gp:[GI:d1005787:g467399] [LN:BAC180K] [AC:D26185] [PN:IMP dehydrogenase] [GN:guaB] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:79515] [RE:80981] [DI:direct] >gp:[GI:e1181942:g2632276] [LN:BSUB0001] [AC:Z99104:AL009126] [PN:inositol-monophosphate dehydrogenase] [GN:guaB] [FN:GMP biosynthesis] [OR:*Bacillus subtilis*] [DB:genpept-bct1] [EC:1.1.1.205] [DE:*Bacillus subtilis* complete genome (section 1 of 21): from 1 to 213080.] [NT:alternate gene name:guaA] [SP:P21879] [LE:15913] [RE:17379] [DI:direct]

| ORF Name | NT ID | AA ID | NT LN | AA LN | Score | P-Value |
|---|---|---|---|---|---|---|
| AI7503000999_34023251_f2_389 | 3143 | 6915 | 198 | 65 | 68 | 0.045 |

Description
gp:[GI:g205733] [(LN:RATNKBNT4] [AC:M21187:J03185:M18622] [OR:*Rattus norvegicus*] [SR:Rat testis DNA, clone rNT19] [DB:genpept-rod] [DE:Rat neurotensin/neuromedin N gene, exon 4.] [NT:prepronerurotensin/neuromedin N] [LE:M21218.1:8:11] [RE:232:163] [DI:directJoin]

| ORF Name | NT ID | AA ID | NT LN | AA LN | Score | P-Value |
|---|---|---|---|---|---|---|
| AI7503000999_34160260_f2_322 | 3144 | 6916 | 138 | 45 | | |

Description
NO-HIT

| ORF Name | NT ID | AA ID | NT LN | AA LN | Score | P-Value |
|---|---|---|---|---|---|---|
| AI7503000999_34178401_f3_462 | 3145 | 6917 | 150 | 49 | | |

Description
NO-HIT

| ORF Name | NT ID | AA ID | NT LN | AA LN | Score | P-Value |
|---|---|---|---|---|---|---|

| | | -continued | | | | |
|---|---|---|---|---|---|---|
| AI7503000999_34179761_c2_903 | 3146 | 6918 | 147 | 48 | | |

Description
NO-HIT

| ORF Name | NT ID | AA ID | NT LN | AA LN | Score | P-Value |
|---|---|---|---|---|---|---|
| AI7503000999_34180340_f2_398 | 3147 | 6919 | 711 | 236 | 609 | 2.2e−59 |

Description
gp:[GI:d1025734:g2879914] [LN:D85752] [AC:D85752] [GN:bacH] [OR:*Enterococcus faecalis*] [SR:*Enterococcus faecalis* plasmid:pPD1 DNA] [DB:genpept-bct1] [DE:*Enterococcus faecalis* plasmid pPD1 bacA, bacB, bacC, bacD, bacE, bacF, bacG, bacH and bacI genes, complete cds.] [LE:7148] [RE:7735] [DI:direct]

| ORF Name | NT ID | AA ID | NT LN | AA LN | Score | P-Value |
|---|---|---|---|---|---|---|
| AI7503000999_34182952_f3_625 | 3148 | 6920 | 402 | 133 | 88 | 0.013 |

Description
pir:[LN:G69850] [AC:G69850] [PN:hypothetical protein yjhA] [GN:yjhA] [OR:*Bacillus subtilis*] [DB:pir2] >gp:[GI:e1183238:g2633572] [LN:BSUB0007] [AC:Z99110:AL009126] [GN:yjhA] [FN:unknown] [OR:*Bacillus subtilis*] [DB:genpept-bct1] [DE:*Bacillus subtilis* complete genome (section 7 of 21): from 1194907 to 1411140.] [LE:94377] [RE:95018] [DI:direct] >gp:[GI:g2612890] [LN:AF015825] [AC:AF015825] [PN:putative lipoprotein] [GN:yjhA] [OR:*Bacillus subtilis*] [DB:genpept-bct2] [DE:*Bacillus subtilis* 168 cotT-rapA region sequence.] [LE:8537] [RE:9178] [DI:direct]

| ORF Name | NT ID | AA ID | NT LN | AA LN | Score | P-Value |
|---|---|---|---|---|---|---|
| AI7503000999_34266582_c2_965 | 3149 | 6921 | 1158 | 385 | 1796 | 3.6e−185 |

Description
sp:[LN:DP3B_STAAU] [AC:P50029] [GN:DNAN] [OR:*STAPHYLOCOCCUS AUREUS*] [EC:2.7.7.7] [DE:DNA POLYMERASE III, BETA CHAIN,] [SP:P50029] [DB:swissprot] >pir:[LN:S54708] [AC:S54708] [PN:DNA-directed DNA polymerase, III beta chain:dnaN] [GN:dnaN] [CL:DNA-directed DNA polymerase III beta chain] [OR:*Staphylococcus aureus*] [EC:2.7.7.7] [DB:pir1]

| ORF Name | NT ID | AA ID | NT LN | AA LN | Score | P-Value |
|---|---|---|---|---|---|---|
| AI7503000999_34414012_f1_211 | 3150 | 6922 | 273 | 90 | 336 | 1.8e−30 |

Description
pir:[LN:S66013] [AC:S66013:S11368:A69701] [PN:ribosomal protein S18 (rpsR):ribosomal protein BS21] [GN:rpsR] [CL:*Escherichia coli* ribosomal protein S18] [OR:*Bacillus subtilis*] [DB:pir2] >gp:[GI:d1005761:g467373] [LN:BAC180K] [AC:D26185] [PN:ribosomal protein S18] [GN:rpsR] [OR:*Bacillus subtilis*] [SR:*Bacillus subtilis* (sub_species:Marburg, strain:168) DNA] [DB:genpept-bct1] [DE:*B. subtilis* DNA, 180 kilobase region of replication origin.] [LE:46599] [RE:46844] [DI:complement] >gp:[GI:e1184815:g2636636] [LN:BSUB0021] [AC:Z99124:AL009126] [PN:ribosomal protein S18] [GN:rpsR] [OR:*Bacillus subtilis*] [DB:genpept-bct1] [DE:*Bacillus subtilis* complete genome (section 21 of 21): from 3999281 to 4214814.] [SP:P21475] [LE:198531] [RE:198776] [DI:complement]

| ORF Name | NT ID | AA ID | NT LN | AA LN | Score | P-Value |
|---|---|---|---|---|---|---|
| AI7503000999_34414187_c1_692 | 3151 | 6923 | 399 | 132 | 152 | 5.8e−11 |

Description
pir:[LN:B69778] [AC:B69778] [PN:hypothetical protein ydeH] [GN:ydeH] [OR:*Bacillus subtilis*] [DB:pir2] >gp:[GI:d1020108:g1881328] [LN:AB001488] [AC:AB001488] [GN:ydeH] [OR:*Bacillus subtilis*] [SR:*Bacillus subtilis* (strain:168) DNA] [DB:genpept-bct1] [DE:*Bacillus subtilis* genome sequence, 148 kb sequence of the region between 35 and 47 degree.] [NT:FUNCTION UNKNOWN.] [LE:100881] [RE:101327] [DI:direct] >gp:[GI:e1182486:g2632820] [LN:BSUB0003] [AC:Z99106:AL009126] [GN:ydeH] [FN:unknown] [OR:*Bacillus subtilis*] [DB:genpept-bct1] [DE:*Bacillus subtilis* complete genome (section 3 of 21): from 402751 to 611850.] [LE:164626] [RE:165072] [DI:direct]

| ORF Name | NT ID | AA ID | NT LN | AA LN | Score | P-Value |
|---|---|---|---|---|---|---|
| AI7503000999_34417552_f3_615 | 3152 | 6924 | 381 | 126 | | |

Description
NO-HIT

-continued

| ORF Name | NT ID | AA ID | NT LN | AA LN | Score | P-Value |
|---|---|---|---|---|---|---|
| AI7503000999_34417813_c2_985 | 3153 | 6925 | 807 | 268 | 851 | 4.9e−85 |

Description
pir:[LN:A70090] [AC:A70090] [PN:hypothetical protein yycJ] [GN:yycJ]
[OR:*Bacillus subtilis*] [DB:pir2] >gp:[GI:d1011958:g1064810] [LN:BACGNTZA]
[AC:D78193] [GN:yycJ] [OR:*Bacillus subtilis*] [SR:*Bacillus subtilis*
(strain:168) DNA] [DB:genpept-bct1] [DE:*Bacillus subtilis* 36kb sequence
between gntZ and trnY genes encoding 34 ORFs.] [LE:30382] [RE:31188]
[DI:complement] >gp:[GI:e1184763:g2636584] [LN:BSUB0021]
[AC:Z99124:AL009126] [GN:yycJ] [FN:unknown] [OR:*Bacillus subtilis*]
[DB:genpept-bct1] [DE:*Bacillus subtilis* complete genome (section 21 of 21):
from 3999281 to 4214814.] [LE:148766] [RE:149572] [DI:complement]

| ORF Name | NT ID | AA ID | NT LN | AA LN | Score | P-Value |
|---|---|---|---|---|---|---|
| AI7503000999_34580342_c1_730 | 3154 | 6926 | 771 | 256 | 802 | 7.7e−80 |

Description
pir:[LN:A70001] [AC:A70001] [PN:ABC transporter (ATP-binding protein)
homolog ytsC] [GN:ytsC] [CL:ATP-binding cassette homology] [OR:*Bacillus
subtilis*] [DB:pir2] >gp:[GI:e1185911:g2635522] [LN:BSUB0016]
[AC:Z99119:AL009126] [GN:ytsC] [FN:unknown] [OR:*Bacillus subtilis*]
[DB:genpept-bct1] [DE:*Bacillus subtilis* complete genome (section 16 of 21):
from 2997771 to 3213410.] [NT:similar to ABC transporter (ATP-binding
protein)] [LE:112638] [RE:113399] [DI:complement] >gp:[GI:g2293177]
[LN:AF008220] [AC:AF008220] [PN:transporter] [GN:ytsC] [OR:*Bacillus
subtilis*] [DB:genpept-bct2] [DE:*Bacillus subtilis* rrnB-dnaB genomic region.]
[LE:67028] [RE:67789] [DI:direct]

| ORF Name | NT ID | AA ID | NT LN | AA LN | Score | P-Value |
|---|---|---|---|---|---|---|
| AI7503000999_34631527_f1_20 | 3155 | 6927 | 834 | 277 | 609 | 2.2e−59 |

Description
gp:[GI:d1045999:g5360823] [LN:D86934] [AC:D86934] [PN:IS150-like
transposase] [OR:*Staphylococcus aureus*] [SR:*Staphylococcus aureus*
(strain:N315) DNA, clone_lib:library of N31] [DB:genpept] [DE:*Staphylococcus
aureus* genes, mec region, partial and complete cds.] [NT:ORF N028; putative]
[LE:<20180] [RE:20578] [DI:direct]

| ORF Name | NT ID | AA ID | NT LN | AA LN | Score | P-Value |
|---|---|---|---|---|---|---|
| AI7503000999_34643751_c1_688 | 3156 | 6928 | 591 | 196 | 910 | 2.8e−91 |

Description
gp:[GI:g1916316] [LN:SAU92441] [AC:U92441:X85029] [PN:alkyl hydroperoxide
reductase subunit C] [GN:ahpC] [OR:*Staphylococcus aureus*] [DB:genpept-bct1]
[DE:*Staphylococcus aureus* alkyl hydroperoxide reductase subunit C(aphC) and
subunit F (aphF) genes, complete cds.] [NT:AhpC] [LE:791] [RE:1360]
[DI direct]

| ORF Name | NT ID | AA ID | NT LN | AA LN | Score | P-Value |
|---|---|---|---|---|---|---|
| AI7503000999_34664700_f2_393 | 3157 | 6929 | 861 | 286 | 617 | 3.1e−60 |

Description
sp:[LN:YYAA_BACSU] [AC:P37524] [GN:YYAA] [OR:*BACILLUS SUBTILIS*]
[DE:HYPOTHETICAL 32.8 KD PROTEIN IN SPO0J-GIDB INTERGENIC REGION]
[SP:P37524] [DB:swissprot] >pir:[LN:I40442] [AC:I40442:S66023:H70083:S18078]
[PN:DNA-binding protein Spo0J-like homolog yyaA:probable DNA binding
protein (replication origin region)] [GN:yyaA] [CL:*Bacillus subtilis*
transport protein spo0J] [OR:*Bacillus subtilis*] [DB:pir2]
>gp:[GI:d1005771:g467383] [LN:BAC180K] [AC:D26185] [PN:DNA binding protein
(probable)] [OR:*Bacillus subtilis*] [SR:*Bacillus subtilis*
(sub_species:Marburg, strain:168) DNA] [DB:genpept-bct1] [DE:*B. subtilis*
DNA, 180 kilobase region of replication origin.] [LE:55893] [RE:56744]
[DI:complement] >gp:[GI:g40028] [LN:BSORIGS] [AC:X62539] [OR:*Bacillus
subtilis*] [DB:genpept-bct1] [DE:*B. subtilis* genes rpmH, rnpA, 50kd, gidA and
gidB.] [NT:unnamed protein product] [SP:P37524] [LE:6656] [RE:7507]
[DI:direct] >gp:[GI:e1184825:g2636646] [LN:BSUB0021] [AC:Z99124:AL009126]
[GN:yyaA] [FN:unknown] [OR:*Bacillus subtilis*] [DB:genpept-bct1] [DE:*Bacillus
subtilis* complete genome (section 21 of 21): from 3999281 to 4214814.]
[NT:similar to DNA-binding protein Spo0J-like] [SP:P37524] [LE:207825]
[RE:208676] [DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503000999_35157813_f2_244 | 3158 | 6930 | 519 | 172 | 473 | 5.6e−45 |

Description
sp:[LN:ATDA_*ECOLI*] [AC:P37354] [GN:SPEG] [OR:*ESCHERICHIA COLI*] [EC:2.3.1.57] [DE:ACETYLTRANSFERASE) (SAT)] [SP:P37354] [DB:swissprot] >gp:[GI:d1016007:g1742583] [LN:D90799] [AC:D90799:AB001340] [PN:Spermidine N1-acetyltransferase (EC 2.3.1.57)] [GN:speG] [OR:*Escherichia coli*] [SR:*Escherichia coli* (strain:K12) DNA, clone_lib:Kohara lambda minise] [DB:genpept-bct1] [DE:*E.coli* genomic DNA, Kohara clone #308(35.3–35.7 min).] [NT:ORF_ID:o309#16; similar to [SwissProt Accession] [LE:<18154] [RE:18711] [DI:direct] >gp:[GI:d1016029:g1742606] [LN:D90800] [AC:D90800:AB001340] [PN:Spermidine N1-acetyltransferase (EC 2.3.1.57)] [GN:speG] [OR:*Escherichia coli*] [SR:*Escherichia coli* (strain:K12) DNA, clone_lib:Kohara lambda minise] [DB:genpept-bct1] [DE:*E.coli* genomic DNA, Kohara clone #309(35.4–35.7 min.).] [ENT:ORF_ID:o309#16; similar to [SwissProt Accession] [LE:<14930] [RE:15487] [DI:direct] >gp:[GI:d1016031:g1742609] [LN:D90801] [AC:D90801:AB001340] [PN:Spermidine N1-acetyltransferase (EC 2.3.1.57)] [GN:speG] [OR:*Escherichia coli*] [SR:*Escherichia coli* (strain:K12) DNA, clone_lib:Kohara lambda minise] [DB:genpept-bct1] [DE:*E.coli* genomic DNA, Kohara clone #310(35.7–36.0 min.).] [NT:ORF_ID:o309#16; similar to [SwissProt Accession] [LE:<814] [RE:1371] [DI:direct]

| ORF Name | NT ID | AA ID | NT LN | AA LN | Score | P-Value |
|---|---|---|---|---|---|---|
| AI7503000999_35324092_c1_772 | 3159 | 6931 | 987 | 328 | 219 | 9.3e−28 |

Description
sp:[LN:MET2_YEAST] [AC:P08465] [GN:MET2:YNL277W:N0615] [OR:*SACCHAROMYCES CEREVISIAE*] [SR:,BAKER'S YEAST] [EC:2.3.1.31] [DE:ACETYLASE)] [SP:P08465] [DB:swissprot] >pir:[LN:S63251] [AC:S63251:A27163] [PN:homoserine O-acetyltransferase,:protein N0615:protein YNL277w] [GN:MET2] [CL:homoserine acetyltransferase] [OR:*Saccharomyces cerevisiae*] [EC:2.3.1.31] [DB:pir2] [MP:14L] >gp:[GI:e239735:g1302344] [LN:SCYNL277W] [AC:Z71553:Y13139] [GN:MET2] [OR:*Saccharomyces cerevisiae*] [SR:baker's yeast] [DB:genpept-pln1] [DE:*S.cerevisiae* chromosome XIV reading frame ORF YNL277w.] [NT:ORF YNL277w] [SP:P08465] [LE:896] [RE:2356] [DI:direct]

| ORF Name | NT ID | AA ID | NT LN | AA LN | Score | P-Value |
|---|---|---|---|---|---|---|
| AI7503000999_35334686_f2_331 | 3160 | 6932 | 1659 | 552 | 1253 | 1.2e−127 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503000999_35343807_f1_220 | 3161 | 6933 | 237 | 78 | | |

Description
NO-HIT

| ORF Name | NT ID | AA ID | NT LN | AA LN | Score | P-Value |
|---|---|---|---|---|---|---|
| AI7503000999_35369052_c1_774 | 3162 | 6934 | 1404 | 467 | 1261 | 1.8e−128 |

Description
gp:[GI:g4416322] [LN:AF106032] [AC:AF106032] [PN:replicative helicase] [GN:dnaB] [OR:*Bacillus stearothermophilus*] [DB:genpept-bct2] [DE:*Bacillus stearothermophilus* replicative helicase (dnaB) gene, complete cds.] [NT:5'- 3' helicase; similar to *Bacillus subtilis* DnaC;] [LE:1] [RE:1365] [DI:direct]

| ORF Name | NT ID | AA ID | NT LN | AA LN | Score | P-Value |
|---|---|---|---|---|---|---|
| AI7503000999_35554635_c2_1001 | 3163 | 6935 | 132 | 43 | | |

Description
NO-HIT

| ORF Name | NT ID | AA ID | NT LN | AA LN | Score | P-Value |
|---|---|---|---|---|---|---|
| AI7503000999_35944052_c1_682 | 3164 | 6936 | 690 | 229 | | |

-continued

| Description |
|---|
| NO-HIT |

| ORF Name | NT ID | AA ID | NT LN | AA LN | Score | P-Value |
|---|---|---|---|---|---|---|
| AI7503000999_35978127_f3_661 | 3165 | 6937 | 777 | 258 | 559 | 4.3e−54 |

| Description |
|---|
| sp:[LN:YWCG_BACSU] [AC:P39605] [GN:YWCG:IPA-43D] [OR:*BACILLUS SUBTILIS*] [DE:HYPOTHETICAL 28.3 KD PROTEIN IN QOXD-VPR INTERGENIC REGION] [SP:P39605] [DB:swissprot] >pir:[LN:S39698] [AC:S39698:B70053] [PN:NADPH-flavin oxidoreductase homolog ywcG:protein ipa-43d] [GN:ywcG] [CL:NADPH-flavin oxidoreductase homolog] [OR:*Bacillus subtilis*] [DB:pir2] >gp:[GI:g413967] [LN:BSGENR] [AC:X73124] [GN:ipa-43d] [OR:*Bacillus subtilis*] [DB:genpept-bct1] [DE:*B. subtilis* genomic region (325 to 333).] [SP:P39605] [LE:45340] [RE:46089] [DI:direct] >gp:[GI:e1186310:g2636346] [LN:BSUB0020] [AC:Z99123:AL009126] [GN:ywcG] [FN:unknown] [OR:*Bacillus subtilis*] [DB:genpept-bct1] [DE:*Bacillus subtilis* complete genome (section 20 of 21): from 3798401 to 4010550.] [NT:alternate gene name:ipa-43d; similar to] [SP:P39605] [LE:111873] [RE:112622] [DI:complement] |

| ORF Name | NT ID | AA ID | NT LN | AA LN | Score | P-Value |
|---|---|---|---|---|---|---|
| AI7503000999_35984430_f2_444 | 3166 | 6938 | 126 | 41 | | |

| Description |
|---|
| NO-HIT |

| ORF Name | NT ID | AA ID | NT LN | AA LN | Score | P-Value |
|---|---|---|---|---|---|---|
| AI7503000999_35991677_c2_973 | 3167 | 6939 | 177 | 58 | | |

| Description |
|---|
| NO-HIT |

| ORF Name | NT ID | AA ID | NT LN | AA LN | Score | P-Value |
|---|---|---|---|---|---|---|
| AI7503000999_36135952_f2_327 | 3168 | 6940 | 1650 | 549 | 2777 | 4.0e−289 |

| Description |
|---|
| gp:[GI:d1046002:g5360826] [LN:D86934] [AC:D86934] [PN:site-specific recombinase] [GN:ccrB] [OR:*Staphylococcus aureus*] [SR:*Staphylococcus aureus* (strain:N315) DNA, clone_lib:library of N31] [DB:genpept] [DE:*Staphylococcus aureus* genes, mec region, partial and complete cds.] [NT:ORF N037; cassette chromosome recombinase B] [LE:25508] [RE:27136] [DI:direct] |

| ORF Name | NT ID | AA ID | NT LN | AA LN | Score | P-Value |
|---|---|---|---|---|---|---|
| AI7503000999_36147301_f3_670 | 3169 | 6941 | 237 | 78 | 78 | 0.0090 |

| Description |
|---|
| sp:[LN:COTE_BACSU] [AC:P14016] [GN:COTE] [OR:*BACILLUS SUBTILIS*] [DE:SPORE COAT PROTEIN E] [SP:P14016] [DB:swissprot] >pir:[LN:A31245] [AC:A31245:B69605] [PN:outer spore coat protein cotE] [GN:cotE] [OR:*Bacillus subtilis*] [DB:pir2] >gp:[GI:g1200225] [LN:BSCOTE] [AC:X13009] [PN:coat protein] [GN:cotE] [OR:*Bacillus subtilis*] [DB:genpept-bct1] [DE:*Bacillus subtilis* cotE gene for 21kD coat protein.] [SP:P14016] [LE:390] [RE:935] [DI:direct] >gp:[GI:e1185294:g2634075] [LN:BSUB0009] [AC:Z99112:AL009126] [PN:morphogenic protein] [GN:cotE] [FN:outer coat assembly] [OR:*Bacillus subtilis*] [DB:genpept-bct1] [DE:*Bacillus subtilis* complete genome (section 9 of 21): from 1598421 to 1807200.] [SP:P14016] [LE:176015] [RE:176560] [DI:direct] |

| ORF Name | NT ID | AA ID | NT LN | AA LN | Score | P-Value |
|---|---|---|---|---|---|---|
| AI7503000999_36211052_c1_855 | 3170 | 6942 | 1662 | 553 | 2755 | 8.5e−287 |

| Description |
|---|
| sp:[LN:MERA_STAAU] [AC:P08663] [GN:MERA] [OR:*STAPHYLOCOCCUS AUREUS*] [EC:1.16.1.1] [DE:MERCURIC REDUCTASE, (HG(II) REDUCTASE)] [SP:P08663] [DB:swissprot] >pir:[LN:E29504] [AC:E29504] [PN:mercury(II) reductase,:Hg(II) reductase:mercuric reductase] [GN:merA] [CL:*Bacillus* mercury(II) reductase:dihydrolipoamide dehydrogenase homology:heavy-metal-associated homology] [OR:*Staphylococcus aureus*] [EC:1.16.1.1] [DB:pir2] >gp:[GI:g459907] [LN:L29436] [AC:L29436:M15048:N00048] [PN:mercuric reductase] [GN:merA] [OR:Plasmid pI258] [SR:Plasmid pI258 DNA] [DB:genpept-bct1] [DE:Plasmid pI258 (from *S.aureus* strain RN23 8325) mercury resistance(mer) operon encoding mercuric reductase (merA), organomercuriallyase (merB), regulatory protein (merR) and |

-continued membrane transport protein (merT), complete cds.] [LE:3148] [RE:4791]
[DI:direct]

| ORF Name | NT ID | AA ID | NT LN | AA LN | Score | P-Value |
|---|---|---|---|---|---|---|
| AI7503000999_36225427_f2_319 | 3171 | 6943 | 615 | 204 | | |

Description
NO-HIT

| ORF Name | NT ID | AA ID | NT LN | AA LN | Score | P-Value |
|---|---|---|---|---|---|---|
| AI7503000999_36226501_c2_1018 | 3172 | 6944 | 891 | 296 | | |

Description
NO-HIT

| ORF Name | NT ID | AA ID | NT LN | AA LN | Score | P-Value |
|---|---|---|---|---|---|---|
| AI7503000999_36228126_f2_392 | 3173 | 6945 | 1896 | 631 | 2407 | 6.42−250 |

Description
sp:[LN:GIDA_BACSU] [AC:P25812] [GN:GIDA] [OR:*BACILLUS SUBTILIS*] [DE:GLUCOSE
INHIBITED DIVISION PROTEIN A] [SP:P25812] [DB:swissprot] >pir:[LN:BWBSGA]
[AC:I40440:S66025:G69631:JQ1216:S18076] [PN:glucose-inhibited division
protein gidA] [GN:gidA] [CL:gidA protein] [OR:*Bacillus subtilis*] [DB:pir1]
>gp:[GI:d1005773:g467385] [LN:BAC180K] [AC:D26185] [PN:unknown] [GN:gidA]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:57599] [RE:59485] [DI:complement]
>gp:[GI:g40026] [LN:BSORIGS] [AC:X62539] [OR:*Bacillus subtilis*]
[DB:genpept-bct1] [DE:*B. subtilis* genes rpmH, rnpA, 50kd, gidA and gidB.]
[NT:homologous to *E.coli* gidA] [SP:P25812] [LE:3915] [RE:5801] [DI:direct]
>gp:[GI:e1184827:g2636648] [LN:BSUB0021] [AC:Z99124:AL009126]
[PN:glucose-inhibited division protein] [GN:gidA] [OR:*Bacillus subtilis*]
[DB:genpept-bct1] [DE:*Bacillus subtilis* complete genome (section 21 of 21):
from 3999281 to 4214814.] [SP:P25812] [LE:209531] [RE:211417] [DI:complement]

| ORF Name | NT ID | AA ID | NT LN | AA LN | Score | P-Value |
|---|---|---|---|---|---|---|
| AI7503000999_36359761_f3_604 | 3174 | 6946 | 840 | 279 | 581 | 2.0e−56 |

Description
sp:[LN:YFOL_STRTR] [AC:P96051] [OR:*STREPTOCOCCUS THERMOPHILUS*]
[DE:(ORF1091)] [SP:P96051] [DB:swissprot] >gp:[GI:g1685111] [LN:STU58210]
[AC:U58210] [OR:*Streptococcus thermophilus*] [SR:*Streptococcus thermophilus*
strain=Sfi6] [DB:genpept-bct2] [DE:*Streptococcus thermophilus*
tetrahydrofolate dehydrogenase/cyclohydrolase (folD), penicillin-binding
protein 2b(pbp2b) and DNA repair and recombination protein (recM)
genes, complete cds.] [NT:orf1091] [LE:1091] [RE:1927] [DI:direct]

| ORF Name | NT ID | AA ID | NT LN | AA LN | Score | P-Value |
|---|---|---|---|---|---|---|
| AI7503000999_36522507_f1_163 | 3175 | 6947 | 741 | 246 | 740 | 2.9e−73 |

Description
sp:[LN:GIDB_BACSU] [AC:P25813] [GN:GIDB] [OR:*BACILLUS SUBTILIS*] [DE:GLUCOSE
INHIBITED DIVISION PROTEIN B] [SP:P25813] [DB:swissprot] >pir:[LN:BWBSGB]
[AC:I40441:S66024:H69631:JQ1217:S18077] [PN:glucose-inhibited division
protein gidB] [GN:gidB] [CL:gidB protein] [OR:*Bacillus subtilis*] [DB:pir1]
>gp:[GI:d1005772:g467384] [LN:BAC180K] [AC:D26185] [PN:unknown] [GN:gidB]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:56866] [RE:57585] [DI:complement]
>gp:[GI:g40027] [LN:BSORIGS] [AC:X62539] [OR:*Bacillus subtilis*]
[DB:genpept-bct1] [DE:*B. subtilis* genes rpmH, rnpA, 50kd, gidA and gidB.]
[NT:homologous to *E.coli* gidB] [SP:P25813] [LE:5815] [RE:6534] [DI:direct]
>gp:[GI:e1184826:g2636647] [LN:BSUB0021] [AC:Z99124:AL009126]
[PN:glucose-inhibited division protein] [GN:gidB] [OR:*Bacillus subtilis*]
[DB:genpept-bct1] [DE:*Bacillus subtilis* complete genome (section 21 of 21):
from 3999281 to 4214814.] [SP:P25813] [LE:208798] [RE:209517] [DI:complement]

| ORF Name | NT ID | AA ID | NT LN | AA LN | Score | P-Value |
|---|---|---|---|---|---|---|
| AI7503000999_36584652_c1_805 | 3176 | 6948 | 339 | 112 | 380 | 4.0e−35 |

Description
gp:[GI:d1045996:g5360820] [LN:D86934] [AC:D86934] [PN:transposase]
[OR:*Staphylococcus aureus*] [SR:*Staphylococcus aureus* (strain:N315) DNA, -continued clone_lib:library of N31] [DB:genpept] [DE:*Staphylococcus aureus* genes, mec region, partial and complete cds.] [NT:ORF N026; putative] [LE:19527] [RE:19751] [DI:direct]

| ORF Name | NT ID | AA ID | NT LN | AA LN | Score | P-Value |
|---|---|---|---|---|---|---|
| AI7503000999_37892_f1_217 | 3177 | 6949 | 162 | 53 | | |

Description
NO-HIT

| ORF Name | NT ID | AA ID | NT LN | AA LN | Score | P-Value |
|---|---|---|---|---|---|---|
| AI7503000999_3906578_f1_8 | 3178 | 6950 | 123 | 40 | | |

Description
NO-HIT

| ORF Name | NT ID | AA ID | NT LN | AA LN | Score | P-Value |
|---|---|---|---|---|---|---|
| AI7503000999_3913137_f2_262 | 3179 | 6951 | 570 | 189 | 982 | 6.5e−99 |

Description
gp:[GI:g459909] [LN:L29436] [AC:L29436:M15048:N00048] [OR:Plasmid pI258] [SR:Plasmid pI258 DNA] [DB:genpept-bct1] [DE:Plasmid pI258 (from *S.aureus* strain RN23 8325) mercury resistance(mer) operon encoding mercuric reductase (merA), organomercuriallyase (merB), regulatory protein (merR) and membrane transport protein (merT), complete cds.] [NT:ORF1] [LE:5718] [RE:6266] [DI complement]

| ORF Name | NT ID | AA ID | NT LN | AA LN | Score | P-Value |
|---|---|---|---|---|---|---|
| AI7503000999_3937713_c3_1215 | 3180 | 6952 | 174 | 57 | | |

Description
NO-HIT

| ORF Name | NT ID | AA ID | NT LN | AA LN | Score | P-Value |
|---|---|---|---|---|---|---|
| AI7503000999_3938802_f2_326 | 3181 | 6953 | 1383 | 460 | 2306 | 3.2e−239 |

Description
gp:[GI:d1046000:g5360824] [LN:D86934] [AC:D86934] [PN:site-specific recombinase] [GN:ccrA] [OR:*Staphylococcus aureus*] [SR:*Staphylococcus aureus* (strain:N315) DNA, clone_lib:library of N31] [DB:genpept] [DE:*Staphylococcus aureus* genes, mec region, partial and complete cds.] [NT:ORF N034; cassette chromosome recombinase A] [LE:24137] [RE:25486] [DI:direct]

| ORF Name | NT ID | AA ID | NT LN | AA LN | Score | P-Value |
|---|---|---|---|---|---|---|
| AI7503000999_3954450_c3_1101 | 3182 | 6954 | 129 | 42 | | |

Description
NO-HIT

| ORF Name | NT ID | AA ID | NT LN | AA LN | Score | P-Value |
|---|---|---|---|---|---|---|
| AI7503000999_4016887_f1_6 | 3183 | 6955 | 174 | 57 | 157 | 2.6e−10 |

Description
sp:[LN:CADA_LISMO] [AC:Q60048] [GN:CADA] [OR:LISTERIA MONOCYTOGENES] [EC:3.6.1.-] [DE:ATPASE)] [SP:Q60048] [DB:swissprot] >gp:[GI:g495646) [LN:LISCADTNP] [AC:L28104] [PN:ATPase] [GN:cadA] [FN:cadmium resistance] [OR:Transposon Tn5422] [SR:Listeria monocytogenes (individual_isolate Lm74) DNA; Transposo] [DB:genpept-una] [DE:Listeria monocytogenes ATPase (cadA) gene; accessory protein (cadC)gene; resolvase (tnpR) gene and transposase (tnpA) gene.] [LE:158] [RE:2293] [DI:complement]

| ORF Name | NT ID | AA ID | NT LN | AA LN | Score | P-Value |
|---|---|---|---|---|---|---|
| AI7503000999_4022952_f1_64 | 3184 | 6956 | 1515 | 504 | 1186 | 3.9e−140 |

Description
pir:[LN:C70880] [AC:C70880] [PN:probable hsdM protein] [GN:hsdM] [OR:*Mycobacterium tuberculosis*] [DB:pir2] >gp:(GI:e1173886:g2624278] [LN:MTV002] [AC:AL008967:AL123456] [PN:hsdM] [GN:hsdM] [OR:*Mycobacterium tuberculosis*] [DB:genpept-bct1] [DE:*Mycobacterium tuberculosis* H37Rv -continued complete genome; segment 122/162.] [NT:Rv2756c, (MTV002.21c), len:540 aa. hsdM, type I] [LE:19902] [RE:21524] [DI:complement]

| ORF Name | NT ID | AA ID | NT LN | AA LN | Score | P-Value |
|---|---|---|---|---|---|---|
| AI7503000999_4025302_f3_464 | 3185 | 6957 | 1293 | 430 | 1892 | 2.4e−195 |

Description
sp:[LN:ARSB_STAAU] [AC:P30329] [GN:ARSB] [OR:*STAPHYLOCOCCUS AUREUS*]
[DE:ARSENICAL PUMP MEMBRANE PROTEIN] [SP:P30329] [DB:swissprot]
>pir:[LN:C41903] [AC:C41903] [PN:arsenical pump membrane protein] [GN:arsB]
[CL:arsenical pump membrane protein] [OR:*Staphylococcus aureus*] [DB:pir1]
>gp:[GI:g150728] [LN:PI2ARSRBC] [AC:M86824] [PN:arsenic efflux pump protein]
[GN:arsB] [FN:arsenic efflux pump component (membrane) [OR:Plasmid pI258]
[SR:Plasmid pI258 DNA] [DB:genpept-bct1] [DE:Plasmid pI258 arsenic
resistance operon (arsRBC) genes, complete cds.] [LE:587] [RE:1876]
[DI:direct]

| ORF Name | NT ID | AA ID | NT LN | AA LN | Score | P-Value |
|---|---|---|---|---|---|---|
| AI7503000999_4093937_c3_1172 | 3186 | 6958 | 192 | 63 | | |

Description
NO-HIT

| ORF Name | NT ID | AA ID | NT LN | AA LN | Score | P-Value |
|---|---|---|---|---|---|---|
| AI7503000999_4098518_c2_1040 | 3187 | 6959 | 417 | 318 | 682 | 4.0e−67 |

Description
sp:[LN:MERR_STAAU] [AC:P22874] [GN:MERR] [OR:*STAPHYLOCOCCUS AUREUS*]
[DE:MERCURIC RESISTANCE OPERON REGULATORY PROTEIN] [SP:P22874]
[DB:swissprot] >pir:[LN:A29504] [AC:A29504] [PN:hypothetical 16K protein
(mer operon)] [CL:transcription repressor glnR] [OR:*Staphylococcus aureus*]
[DB:pir2] >gp:[GI:g459903] [LN:L29436] [AC:L29436:M15048:N00048] [OR:Plasmid
pI258] [SR:Plasmid pI258 DNA] [DB:genpept-bct1] [DE:Plasmid pI258 (from
*S.aureus* strain RN23 8325) mercury resistance(mer) operon encoding mercuric
reductase (merA), organomercuriallyase (merB), regulatory protein (merR) and
membrane transport protein (merT), complete cds.] [NT:ORF2] [LE:1030]
[RE:1437] [DI:direct]

| ORF Name | NT ID | AA ID | NT LN | AA LN | Score | P-Value |
|---|---|---|---|---|---|---|
| AI7503000999_4120462_f2_235 | 3188 | 6960 | 945 | 314 | 791 | 1.1e−78 |

Description
sp:[LN:ARCL_*ECOLI*] [AC:Q46807] [GN:YQEA] [OR:*ESCHERICHIA COLI*] [DE:CARBAMATE
KINASE-LIKE PROTEIN 1] [SP:Q46807] [DB:swissprot] >pir:[LN:B65071]
[AC:B65071] [PN:hypothetical protein b2874] [CL:carbamate kinase]
[OR:*Escherichia coli*] [DB:pir2] >gp:[GI:g887824] [LN:ECU28375] [AC:U28375]
[OR:*Escherichia coli*] [DB:genpept-bct1] [DE:*Escherichia coli* K-12 genome;
approximately 64 to 65 minutes.] [NT:ORF_o310] [LE:21276] [RE:22208]
[DI:direct] >gp:[GI:g1789238] [LN:AE000370] [AC:AE000370:U00096]
[PN:putative kinase] [GN:yqeA] [FN:putative enzyme; Not classified]
[OR:*Escherichia coli*] [DB:genpept-bct2] [DE:*Escherichia coli* K-12 MG1655
section 260 of 400 of the complete genome.] [NT:o310; This 310 aa ORF is 45
pct identical (21 gaps)] [LE:11360] [RE:12292] [DI:direct]

| ORF Name | NT ID | AA ID | NT LN | AA LN | Score | P-Value |
|---|---|---|---|---|---|---|
| AI7503000999_41265_c3_1170 | 3189 | 6961 | 1365 | 454 | 1593 | 1.2e−163 |

Description
pir:[LN:A42280] [AC:S65968:A42280:H69683] [PN:adenylosuccinate synthase,
purA:IMP--aspartate ligase] [GN:purA] [CL:adenylosuccinate synthase]
[OR:*Bacillus subtilis*] [EC:6.3.4.4] [DB:pir2] >gp:[GI:d1005716:g467328)
[LN:BAC180K] [AC:D26185] [PN:adenylosuccinate synthetase] [GN:purA]
[OR:*Bacillus subtilis*] [SR:*Bacillus subtilis* (sub_species:Marburg,
strain:168) DNA] [DB:genpept-bct1] [DE:*B. subtilis* DNA, 180 kilobase region
of replication origin.] [LE:3429] [RE:4721] [DI:complement]
>gp:[GI:e1184768:g2636589] [LN:BSUB0021] [AC:Z99124:AL009126]
[PN:adenylosuccinate synthetase] [GN:purA] [FN:AMP biosynthesis]
[OR:*Bacillus subtilis*] [DB:genpept-bct1] [EC:6.3.4.4] [DE:*Bacillus subtilis*
complete genome (section 21 of 21): from 3999281 to 4214814.] [SP:P29726]
[LE:155361] [RE:156653] [DI:complement]

-continued

| ORF Name | NT ID | AA ID | NT LN | AA LN | Score | P-Value |
|---|---|---|---|---|---|---|
| AI7503000999_4179680_c2_977 | 3190 | 6962 | 936 | 311 | 214 | 1.7e−16 |

Description
sp:[LN:YYBS_BACSU] [AC:P37485] [GN:YYBS] [OR:*BACILLUS SUBTILIS*]
[DE:HYPOTHETICAL 34.5 KD PROTEIN IN RPLI-COTF INTERGENIC REGION] [SP:P37485]
[DB:swissprot] >pir:[LN:S65977] [AC:S65977:F70088] [PN:hypothetical protein
yybS] [GN:yybS] [OR:*Bacillus subtilis*] [DB:pir2] >gp:[GI:d1005725:g467337]
[LN:BAC180K] [AC:D26185] [PN:unknown] [OR:*Bacillus subtilis*] [SR:*Bacillus
subtilis* (sub_species:Marburg, strain:168) DNA] [DB:genpept-bct1] [DE:*B.
subtilis* DNA, 180 kilobase region of replication origin.] [LE:13655]
[RE:14584] [DI:complement] >gp:[GI:e1184778:g2636599] [LN:BSUB0021]
[AC:Z99124:AL009126] [GN:yybS] [FN:unknown] [OR:*Bacillus subtilis*]
[DB:genpept-bct1] [DE:*Bacillus subtilis* complete genome (section 21 of 21):
from 3999281 to 4214814.] [SP:P37485] [LE:165587] [RE:166516] [DI:complement]

| ORF Name | NT ID | AA ID | NT LN | AA LN | Score | P-Value |
|---|---|---|---|---|---|---|
| AI7503000999_4196051_f1_29 | 3191 | 6963 | 333 | 110 | 424 | 8.7e−40 |

Description
pir:[LN:A41902] [AC:A41902] [PN:arsenical resistance operon repressor]
[GN:arsR] [CL:arsenical resistance operon repressor] [OR:*Staphylococcus
xylosus*] [DB:pir1]

| ORF Name | NT ID | AA ID | NT LN | AA LN | Score | P-Value |
|---|---|---|---|---|---|---|
| AI7503000999_42162_c3_1124 | 3192 | 6964 | 126 | 41 | | |

Description
NO-HIT

| ORF Name | NT ID | AA ID | NT LN | AA LN | Score | P-Value |
|---|---|---|---|---|---|---|
| AI7503000999_4305342_f2_445 | 3193 | 6965 | 1557 | 518 | 2015 | 2.2e−208 |

Description
sp:[LN:GUAA_BACSU] [AC:P29727:O34531] [GN:GUAA] [OR:*BACILLUS SUBTILIS*]
[EC:6.3.5.2] [DE:AMIDOTRANSFERASE [GMP SYNTHETASE)] [SP:P29727:O34531]
[DB:swissprot] >pir:[LN:C69638] [AC:C69638:B42280] [PN:GMP synthase
(glutamine-hydrolyzing), guaA] [GN:guaA] [CL:GMP synthase
(glutamine-hydrolyzing):trpG homology] [OR:*Bacillus subtilis*] [EC:6.3.5.2]
[DB:pir2] >gp:[GI:g2239288] [LN:BSU51115] [AC:U51115] [PN:GMP synthetase]
[GN:guaA] [OR:*Bacillus subtilis*] [DB:genpept-bct1] [DE:*Bacillus subtilis*
CotA (cotA), GabP (gabP), YeaB (yeaB), YeaC(yeaC), YebA (yebA), GMP
synthetase (guaA) genes, complete cds, and AIR carboxylase I (purE) gene,
partial cds.] [LE:9970] [RE:11511] [DI:direct] >gp:[GI:e1182615:g2632949]
[LN:BSUB0004] [AC:Z99107:AL009126] [PN:GMP synthetase] [GN:guaA] [FN:GMP
biosynthesis] [OR:*Bacillus subtilis*] [DB:genpept-bct1] [EC:6.3.5.2]
[DE:*Bacillus subtilis* complete genome (section 4 of 21): from 600701
to 813890.] [NT:alternate gene name: guaB] [SP:P29727] [LE:91559] [RE:93100]
[DI:direct]

| ORF Name | NT ID | AA ID | NT LN | AA LN | Score | P-Value |
|---|---|---|---|---|---|---|
| AI7503000999_4335750_f1_166 | 3194 | 6966 | 600 | 199 | 158 | 2.0e−11 |

Description
pir[LN:I40868] [AC:I40868] [PN:hypothetical protein 3] [OR:*Clostridium
perfringens*] [DB:pir2] >gp:[GI:g853809] [LN:CPNANH] [AC:X87369]
[OR:*Clostridium perfringens*] [DB:genpept-bct1] [DE:*C.perfringens* nanH gene &
ORF1, 2, 3 & 4.] [NT:ORF3] [LE:4957] [RE:5754] [DI:direct]

| ORF Name | NT ID | AA ID | NT LN | AA LN | Score | P-Value |
|---|---|---|---|---|---|---|
| AI7503000999_4453165_c1_862 | 3195 | 6967 | 537 | 178 | 202 | 1.8e−15 |

Description
gp:[GI:d1006123:g473790] [LN:ECO82K] [AC:D26562] [PN:'ORF'] [OR:*Escherichia
coli*] [SR:*Escherichia coli* (sub_strain W3110, strain K-12) (library:
Kohara'] [DB:genpept-bct1] [DE:*Escherichia coli* genome, 2.4–4.1 min region
(110, 917–193, 643 bp from 0 min).] [NT:'copper resistance protein copA
homology'] [LE:25693] [RE:27117] [DI:direct]

| ORF Name | NT ID | AA ID | NT LN | AA LN | Score | P-Value |
|---|---|---|---|---|---|---|
| AI7503000999_446062_c3_1126 | 3196 | 6968 | 159 | 52 | 231 | 2.5e−19 |

-continued

Description
pir:[LN:A60634] [AC:A60634:C30471:S26349] [PN:probable transposase]
[OR:*Staphylococcus aureus*] [DB:pir2] >gp:[GI:g46597] [LN:SAI52571]
[AC:X53952] [PN:transposase] [OR:*Staphylococcus aureus*] [DB:genpept-bct1]
[DE:*S.aureus* plasmid pSH6 DNA for insertion sequences IS257-1 and IS256.]
[LE:188] [RE:862] [DI:direct] >gp:[GI:g3676452] [LN:AF051917]
[AC:AF051917:L19570] [PN:putative transposase TnpE] [GN:tnpE]
[OR:*Staphylococcus aureus*] [DB:genpept-bct2] [DE:*Staphylococcus aureus*
plasmid pSK41, complete sequence.] [LE:40946] [RE:41620] [DI:direct]

| ORF Name | NT ID | AA ID | NT LN | AA LN | Score | P-Value |
|---|---|---|---|---|---|---|
| AI7503000999_4475050_f2_341 | 3197 | 6969 | 162 | 53 | 68 | 0.045 |

Description
pir:[LN:F71007] [AC:F71007] [PN:hypothetical protein PH1356] [GN:PH1356]
[OR:*Pyrococcus horikoshii*] [DB:pir2] >gp:[GI:d1031405:g3257779]
[LN:AP000006]
[AC:AP000006:AB005215:AB009510:AB009511:AB009512:AB009513:AB009514]
[PN:111aa long hypothetical protein] [GN:PH1356] [OR:*Pyrococcus horikoshii*]
[SR:*Pyrococcus horikoshii* (strain:OT3) DNA, clone:*Pyrococcus horikoshi*]
[DB:genpept-bct1] [DE:*Pyrococcus horikoshii* OT3 genomic DNA, 1166001-1485000
nt. position(6/7).] [LE:56557] [RE:56892] [DI:direct]

| ORF Name | NT ID | AA ID | NT LN | AA LN | Score | P-Value |
|---|---|---|---|---|---|---|
| AI7503000999_4485937_f1_10 | 3198 | 6970 | 1044 | 347 | 1060 | 3.5e−107 |

Description
sp:[LN:OTCC_HAEIN] [AC:P44770] [GN:ARCB:HI0596] [OR:*HAEMOPHILUS INFLUENZAE*]
[EC:2.1.3.3] [DE:ORNITHINE CARBAMOYLTRANSFERASE, CATABOLIC, (OTCASE)]
[SP:P44770] [DB:swissprot] >pir:[LN:H64079] [AC:H64079] [PN:ornithine
carbamoyltransferase,] [CL:ornithine carbamoyltransferase:
aspartate/ornithine carbamoyltransferase homology] [OR:*Haemophilus
influenzae*] [EC:2.1.3.3] [DB:pir2] >gp:[GI:g1573585] [LN:U32741]
[AC:U32741:L42023] [PN:ornithine carbamoyltransferase (arcB)] [GN:HI0596]
[OR:*Haemophilus influenzae* Rd] [DB:genpept-bct2] [DE:*Haemophilus influenzae*
Rd section 56 of 163 of the complete genome.] [NT:similar to GB:X05637
SP:P08308 PID:45288 percent] [LE:3467] [RE:4471] [DI:complement]

| ORF Name | NT ID | AA ID | NT LN | AA LN | Score | P-Value |
|---|---|---|---|---|---|---|
| AI7503000999_448785_f3_518 | 3199 | 6971 | 927 | 308 | 408 | 4.3e−38 |

Description
sp:[LN:SOXR_ARTSP] [AC:Q44311] [GN:SOXR] [OR:*ARTHROBACTER* SP] [SR:TE1826,]
[DE:TRANSCRIPTIONAL REGULATOR SOXR] [SP:Q44311] [DB:swissprot]
>gp:[GI:d1026865:g3116220] [LN:AB007122] [AC:AB007122] [PN:negative
regulator] [OR:Arthrobacter sp.] [SR:Arthrobacter sp. (strain:TE1826) DNA]
[DB:genpept-bct1] [DE:*Arthrobacter* sp. gene for negative regulator,
sarcosine oxidase, transporter, creatinase, creatininase and
transporter, complete cds.] [LE:321] [RE:1190] [DI:complement]
>gp:[GI:d1010363:g1333651] [LN:ARGTE1826] [AC:D63413] [PN:regulator]
[GN:soxR] [OR:*Arthrobacter* sp.] [SR:*Arthrobacter* sp. (strain:TE1826) DNA]
[DB:genpept-bct1] [DE:Arthrobacter sp. gene for sarcosine oxidase, complete
cds.] [LE:1539] [RE:2408] [DI:direct]

| ORF Name | NT ID | AA ID | NT LN | AA LN | Score | P-Value |
|---|---|---|---|---|---|---|
| AI7503000999_4694677_c1_832 | 3200 | 6972 | 324 | 107 | | |

Description
NO-HIT

| ORF Name | NT ID | AA ID | NT LN | AA LN | Score | P-Value |
|---|---|---|---|---|---|---|
| AI7503000999_4697337_f3_519 | 3201 | 6972 | 549 | 182 | 255 | 7.1e−22 |

Description
pir:[LN:B69978] [AC:B69978] [PN:2-nitropropane dioxygenase homolog yrpB]
[GN:yrpB] [OR:*Bacillus subtilis*] [DB:pir2] >gp:[GI:g1934639] [LN:BSU93875]
[AC:U93875] [PN:2-nitropropane dioxygenase] [GN:yrpB] [OR:*Bacillus subtilis*]
[DB:genpept-bct1] [DE:*Bacillus subtilis* alcohol dehydrogenase (adhB) gene,
partial cds, hypothetical spore coat protein (yraF), hypothetical spore
coat protein (yraG), YraH (yraH), YraI (yraI), YraJ (yraJ), YraK (yraK), YraL
(yraL), chitosanase precursor (csn), YraM (yraM), LysR-family transcription
regulator (yraN), YraO (yraO), YrpG (yrpG), RNA polymerase sigma factor SigZ
(sigZ), YrpE (yrpE), YrpD (yrpD), YrpC (yrpC) and 2-nitropropane dioxygenase
(yrpB) genes, complete cds, and aminoglycoside 6-adenylyltransferase (aadK)

-continued gene, partial cds.] [NT:similar to 2-nitropropane dioxigenase of Williopsis]
[LE:16473] [RE:17516] [DI:complement] >gp:[GI:e1183909:g2635125]
[LN:BSUB0014] [AC:Z99117:AL009126] [GN:yrpB] [FN:unknown] [OR:*Bacillus
subtilis*] [DB:genpept-bct1] [DE:*Bacillus subtilis* complete genome (section
14 of 21): from 2599451 to 2812870.] [NT:similar to 2-nitropropane
dioxygenase] [LE:136734] [RE:137777] [DI:direct]

| ORF Name | NT ID | AA ID | NT LN | AA LN | Score | P-Value |
|---|---|---|---|---|---|---|
| AI7503000999_4714062_c1_759 | 3202 | 6974 | 135 | 44 | | |

Description
NO-HIT

| ORF Name | NT ID | AA ID | NT LN | AA LN | Score | P-Value |
|---|---|---|---|---|---|---|
| AI7503000999_4722338_c3_1233 | 3203 | 6975 | 234 | 77 | 57 | 0.047 |

Description
gp:[GI:g1354131] [LN:EHU48386] [AC:U48386] [PN:pEhS4] [GN:EhS4]
[OR:*Entamoeba histolytica*] [DB:genpept-inv2] [DE:*Entamoeba histolytica*
putative serine/threonine protein kinase(EhS4) gene, complete cds.]
[NT:putative serine/threonine protein kinase] [LE:243:510] [RE:463:1791]
[DI:directJoin]

| ORF Name | NT ID | AA ID | NT LN | AA LN | Score | P-Value |
|---|---|---|---|---|---|---|
| AI7503000999_4725385_f1_213 | 3204 | 6976 | 675 | 224 | 366 | 1.2e−33 |

Description
sp:[LN:YRHP_BACSU] [AC:O05406] [GN:YRHP] [OR:*BACILLUS SUBTILIS*]
[DE:HYPOTHETICAL 23.4 KD PROTEIN IN AAPA-SIGV INTERGENIC REGION] [SP:O05406]
[DB:swissprot] >pir:[LN:F69975] [AC:F69975] [PN:dihydrodipicolinate
reductase homolog yrhP] [GN:yrhP] [CL:hypothetical protein b1798]
[OR:*Bacillus subtilis*] [DB:pir2] >gp:[GI:e1183940:g2635156] [LN:BSUB0014]
[AC:Z99117:AL009126] [GN:yrhP] [FN:unknown] [OR:*Bacillus subtilis*]
[DB:genpept-bct1] [DE:*Bacillus subtilis* complete genome (section 14 of 21):
from 2599451 to 2812870.] [NT:similar to dihydrodipicolinate reductase]
[SP:O05406] [LE:167862] [RE:168494] [DI:complement]

| ORF Name | NT ID | AA ID | NT LN | AA LN | Score | P-Value |
|---|---|---|---|---|---|---|
| AI7503000999_4726555_f2_234 | 3205 | 6977 | 474 | 157 | 203 | 2.3e−16 |

Description
gp:[GI:g4980875] [LN:AE001717] [AC:AE001717:AE000512] [PN:arginine
repressor] [GN:TM0371] [OR:*Thermotoga maritima*] [DB:genpept-bct2]
[DE:*Thermotoga maritima* section 29 of 136 of the complete genome.]
[NT:similar to GB:M27869 SP:P17893 PID:142450] [LE:2550] [RE:3008]
[DI:direct] >gp:[GI:e1489641:g5102818] [LN:TMA132286] [AC:AJ132286]
[PN:arginine repressor] [GN:argR] [FN:regulation of arginine biosynthesis
genes] [OR:*Thermotoga maritima*] [DB:genpept] [DE:*Thermotoga maritima* argR
gene, strain MSB8.] [LE:1] [RE:459] [DI:direct]

| ORF Name | NT ID | AA ID | NT LN | AA LN | Score | P-Value |
|---|---|---|---|---|---|---|
| AI7503000999_4766933_f3_490 | 3206 | 6978 | 129 | 42 | | |

Description
NO-HIT

| ORF Name | NT ID | AA ID | NT LN | AA LN | Score | P-Value |
|---|---|---|---|---|---|---|
| AI7503000999_4770028_c1_740 | 3207 | 6979 | 174 | 57 | | |

Description
NO-HIT

| ORF Name | NT ID | AA ID | NT LN | AA LN | Score | P-Value |
|---|---|---|---|---|---|---|
| AI7503000999_48412_f2_258 | 3208 | 6980 | 159 | 52 | 124 | 1.8e−07 |

Description
pir:[LN:H65154] [AC:H65154:S47779:S01252] [PN:probable transposase,
33.3K:hypothetical protein o283:probable transposase B] [GN:yi5B]
[OR:*Escherichia coli*] [DB:pir2] >gp:[GI:g1789981] [LN:AE000433]
[AC:AE000433:U00096] [PN:IS150 putative transposase] [GN:tl50] [FN:IS,
phage, Tn; Transposon-related functions] [OR:*Escherichia coli*]
[DB:genpept-bct2] [DE:*Escherichia coli* K-12 MG1655 section 323 of 400 of the -continued complete genome.] [NT:o283; 99 pct identical amino acid sequence and]
[LE:1897] [RE:2748] [DI:direct]

| ORF Name | NT ID | AA ID | NT LN | AA LN | Score | P-Value |
|---|---|---|---|---|---|---|
| AI7503000999_4866425_f2_315 | 3209 | 6981 | 465 | 154 | 305 | 3.6e−27 |

Description
pir:[LN:B69978] [AC:B69978] [PN:2-nitropropane dioxygenase homolog yrpB]
[GN:yrpB] [OR:*Bacillus subtilis*] [DB:pir2] >gp:[GI:g1934639] [LN:BSU93875]
[AC:U93875] [PN:2-nitropropane dioxygenase] [GN:yrpB] [OR:*Bacillus subtilis*]
[DB:genpept-bct1] [DE:*Bacillus subtilis* alcohol dehydrogenase (adhB) gene,
partial cds, hypothetical spore coat protein (yraF), hypothetical spore
coat protein (yraG), YraH (yraH), YraI (yraI), YraJ (yraJ), YraK (yraK), YraL
(yraL), chitosanase precursor (csn), YraM (yraM), LysR-family transcription
regulator (yraN), YraO (yraO), YrpG (yrpG), RNA polymerase sigma factor SigZ
(sigZ), YrpE (yrpE), YrpD (yrpD), YrpC (yrpC) and 2-nitropropane dioxygenase
(yrpB) genes, complete cds, and aminoglycoside 6-adenylyltransferase (aadK)
gene, partial cds.] [NT:similar to 2-nitropropane dioxygenase of Williopsis]
[LE:16473] [RE:17516] [DI:complement] >gp:(GI:e1183909:g2635125]
[LN:BSUB0014] [AC:Z99117:AL009126] [GN:yrpB] [FN:unknown] [OR:*Bacillus
subtilis*] [DB:genpept-bct1] [DE:*Bacillus subtilis* complete genome (section
14 of 21): from 2599451 to 2812870.] [NT:similar to 2-nitropropane
dioxygenase] [LE:136734] [RE:137777] [DI:direct]

| ORF Name | NT ID | AA ID | NT LN | AA LN | Score | P-Value |
|---|---|---|---|---|---|---|
| AI7503000999_4867343_c3_1210 | 3210 | 6982 | 2739 | 912 | 234 | 6.2e−16 |

Description
pir:[LN:G70178] [AC:G70178] [PN:exodeoxyribonuclease V, alpha chain (recD)
homolog] [OR:*Borrelia burgdorferi*] [SR:, Lyme disease spirochete] [DB:pir2]
>gp:[GI:g2688552] [LN:AE001164] [AC:AE001164:AE000783]
[PN:exodeoxyribonuclease V, alpha chain (recD)] [GN:BB0632] [OR:*Borrelia
burgdorferi*] [SR:Lyme disease spirochete] [DB:genpept-bct2] [DE:*Borrelia
burgdorferi* (section 50 of 70) of the complete genome.] [NT:similar to
SP:P04993 GB:X04581 GB:X04582 PID:42683] [LE:9371] [RE:11203]
[DI complement]

| ORF Name | NT ID | AA ID | NT LN | AA LN | Score | P-Value |
|---|---|---|---|---|---|---|
| AI7503000999_4895250_f3_627 | 3211 | 6983 | 180 | 59 | | |

Description
NO-HIT

| ORF Name | NT ID | AA ID | NT LN | AA LN | Score | P-Value |
|---|---|---|---|---|---|---|
| AI7503000999_492086_f3_540 | 3212 | 6984 | 1824 | 607 | | |

Description
NO-HIT

| ORF Name | NT ID | AA ID | NT LN | AA LN | Score | P-Value |
|---|---|---|---|---|---|---|
| AI7503000999_4957943_f3_655 | 3213 | 6985 | 600 | 199 | 205 | 7.3e−16 |

Description
sp:[LN:F26_CAEEL] [AC:Q21122] [GN:K02B2.1] [OR:*CAENORHABDITIS ELEGANS*]
[EC:2.7.1.105:3.1.3.46] [DE:BISPHOSPHATASE,] [SP:Q21122] [DB:swissprot]
>gp:[GI:g1118103] [LN:CELKO2B2] [AC:U41558] [GN:K02B2.1] [OR:*Caenorhabditis
elegans*] [DB:genpept-inv2] [DE:*Caenorhabditis elegans* cosmid K02B2.]
[NT:Contains similarity to Pfam domain:PF00300 (PGAM),]
[LE:5652:5766:6320:6579] [RE:5700:5991:6527:6830] [DI:directJoin]

| ORF Name | NT ID | AA ID | NT LN | AA LN | Score | P-Value |
|---|---|---|---|---|---|---|
| AI7503000999_4971051_c2_1028 | 3214 | 6986 | 825 | 274 | 196 | 1.3e−15 |

Description
gp:[GI:g1405404] [LN:LLU60336] [AC:U60336] [PN:AbiGi] [GN:abiGi] [FN:with
AbiGii, causes abortive infection of phage] [OR:*Lactococcus lactis* subsp.
*cremoris*] [DB:genpept-bct1] [DE:*Lactococcus lactis cremoris* abortive
infection proteins (abiGi and abiGii) genes, complete cds.] [LE:4376]
[RE:5125] [DI:direct]

-continued

| ORF Name | NT ID | AA ID | NT LN | AA LN | Score | P-Value |
|---|---|---|---|---|---|---|
| AI7503000999_5133462_f3_538 | 3215 | 6987 | 1530 | 509 | 146 | 1.2e−06 |

Description
pir:[LN:G71620] [AC:G71620] [PN:hypothetical protein PFB0195c] [GN:PFB0195c]
[OR:*Plasmodium falciparum*] [DB:pir2] >gp:[GI:g3845121] [LN:AE001380]
[AC:AE001380:AE001362] [PN:hypothetical protein] [GN:PFB0195c]
[OR:*Plasmodium falciparum*] [SR:malaria parasite *P. falciparum*]
[DB:genpept-inv2] [DE:*Plasmodium falciparum* chromosome 2, section 17 of 73
of the complete sequence.] [NT:predicted by GlimmerM] [LE:1011] [RE:3101]
[DI:complement]

| ORF Name | NT ID | AA ID | NT LN | AA LN | Score | P-Value |
|---|---|---|---|---|---|---|
| AI7503000999_5190938_c3_1167 | 3216 | 6988 | 471 | 156 | 77 | 0.031 |

Description
sp:[LN:YH37_HAEIN] [AC:P44301] [GN:HI1737] [OR:*HAEMOPHILUS INFLUENZAE*]
[DE:HYPOTHETICAL PROTEIN HI1737] [SP:P44301] [DB:swissprot] >pir:[LN:E64041]
[AC:E64041] [PN:branched-chain amino acid transport protein azlD homolog
HI1737] [CL:branched-chain amino acid transport protein azlD]
[OR:*Haemophilus influenzae*] [DB:pir2] >gp:[GI:g1574595] [LN:U32846]
[AC:U32846:L42023] [PN:conserved hypothetical protein] [GN:HI17371
[OR:*Haemophilus influenzae* Rd] [DB:genpept-bct2] [DE:*Haemophilus influenzae*
Rd section 161 of 163 of the complete genome.] [NT:similar to GB:AL009126
percent identity: 53.70;] [LE:9500] [RE:9829] [DI:complement]

| ORF Name | NT ID | AA ID | NT LN | AA LN | Score | P-Value |
|---|---|---|---|---|---|---|
| AI7503000999_5275393_f1_18 | 3217 | 6989 | 132 | 43 | | |

Description
NO-HIT

| ORF Name | NT ID | AA ID | NT LN | AA LN | Score | P-Value |
|---|---|---|---|---|---|---|
| AI7503000999_5292300_c2_1002 | 3218 | 6990 | 342 | 113 | 83 | 0.029 |

Description
pir:[LN:A71655] [AC:A71655] [PN:hypothetical protein RP5111] [GN:RP511]
[OR:*Rickettsia prowazekii*] [DB:pir2] >gp:[GI:e1342807:g3861063] [LN:RPXX03]
[AC:AJ235272:AJ235269] [PN:unknown] [GN:RP511] [OR:*Rickettsia prowazekii*]
[DB:genpept-bct1] [DE:*Rickettsia prowazekii* strain Madrid E, complete
genome; segment3/4.] [LE:35291] [RE:38143] [DI:complement]

| ORF Name | NT ID | AA ID | NT LN | AA LN | Score | P-Value |
|---|---|---|---|---|---|---|
| AI7503000999_5313316_c2_936 | 3219 | 6991 | 1413 | 470 | 245 | 8.3e−38 |

Description
pir:[LN:S74046] [AC:S74046] [PN:probable sugar transport protein c0110]
[OR:*Sulfolobus solfataricus*] [DB:pir2] >gp:[GI:e283949:g1707740]
[LN:SS100KBFR] [AC:Y08256] [PN:sugar transporter] [GN:orf c01010]
[OR:*Sulfolobus solfataricus*] [DB:genpept-bct1] [DE:*S. solfataricus* 100 kbp
DNA fragment.] [LE:71310] [RE:72581] [DI:complement]

| ORF Name | NT ID | AA ID | NT LN | AA LN | Score | P-Value |
|---|---|---|---|---|---|---|
| AI7503000999_5367337_c3_1274 | 3220 | 6992 | 138 | 45 | | |

Description
NO-HIT

| ORF Name | NT ID | AA ID | NT LN | AA LN | Score | P-Value |
|---|---|---|---|---|---|---|
| AI7503000999_57217_c1_735 | 3221 | 6993 | 207 | 68 | | |

Description
NO-HIT

| ORF Name | NT ID | AA ID | NT LN | AA LN | Score | P-Value |
|---|---|---|---|---|---|---|
| AI7503000999_582777_c2_892 | 3222 | 6994 | 1476 | 491 | 1405 | 9.7e−144 |

Description
sp:[LN:YHCL_BACSU] [AC:P54596] [GN:YHCL] [OR:*BACILLUS SUBTILIS*]
[DE:HYPOTHETICAL 49.0 KD PROTEIN IN CSPB-GLPP INTERGENIC REGION] [SP:P54596]
[DB:swissprot] >pir:[LN:H69822] [AC:H69822] [PN:sodium-glutamate symporter -continued homolog yhcL] [GN:yhcL] [CL:*Bacillus subtilis* sodium-glutamate symporter homolog yhcL] [OR:*Bacillus subtilis*] [DB:pir2] >gp:[GI:e233874:g1239988] [LN:BS75DGREG] [AC:X96983] [PN:hypothetical protein] [GN:yhcL] [OR:*Bacillus subtilis*] [DB:genpept-bct1] [DE:*B. subtilis* chromosomal DNA (region 75 degrees: cspB upstream of glpPFKD operon).] [NT:similarity to the proton/sodium-glutamate symport] [SP:P54596] [LE:7868] [RE:9259] [DI:direct] >gp:(GI:e1182902:g2633236] [LN:BSUB0005] [AC:Z99108:AL009126] [GN:yhcL] [FN:unknown] [OR:*Bacillus subtilis*] [DB:genpept-bct1] [DE:*Bacillus subtilis* complete genome (section 5 of 21): from 802821 to 1011250.] [NT:similar to sodium-glutamate symporter] [SP:P54596] [LE:183674] [RE:185065] [DI:direct]

| ORF Name | NT ID | AA ID | NT LN | AA LN | Score | P-Value |
|---|---|---|---|---|---|---|
| AI7503000999__595937__f2__394 | 3223 | 6995 | 177 | 58 | | |

Description
NO-HIT

| ORF Name | NT ID | AA ID | NT LN | AA LN | Score | P-Value |
|---|---|---|---|---|---|---|
| AI7503000999__6016063__f3__662 | 3224 | 6996 | 123 | 40 | | |

Description
NO-HIT

| ORF Name | NT ID | AA ID | NT LN | AA LN | Score | P-Value |
|---|---|---|---|---|---|---|
| AI7503000999__6054512__f3__600 | 3225 | 6997 | 207 | 68 | | |

Description
NO-HIT

| ORF Name | NT ID | AA ID | NT LN | AA LN | Score | P-Value |
|---|---|---|---|---|---|---|
| AI7503000999__6095000__f2__425 | 3226 | 6998 | 147 | 48 | | |

Description
NO-HIT

| ORF Name | NT ID | AA ID | NT LN | AA LN | Score | P-Value |
|---|---|---|---|---|---|---|
| AI7503000999__649141__f2__330 | 3227 | 6999 | 567 | 188 | | |

Description
NO-HIT

| ORF Name | NT ID | AA ID | NT LN | AA LN | Score | P-Value |
|---|---|---|---|---|---|---|
| AI7503000999__6521882__f1__32 | 3228 | 7000 | 195 | 64 | 81 | 0.0019 |

Description
gp:[GI:g5306165] [LN:AF160864] [AC:AF160864] [PN:orf98] [GN:orf98] [OR:Mitochondrion *Tetrahymena pyriformis*] [SR:*Tetrahymena pyriformis*] [DB:genpept] [DE:*Tetrahymena pyriformis* mitochondrial DNA, complete genome.] [NT:Open reading frame ymf71 (CPGN); ATT initiation] [LE:37598] [RE:37894] [DI:direct]

| ORF Name | NT ID | AA ID | NT LN | AA LN | Score | P-Value |
|---|---|---|---|---|---|---|
| AI7503000999__6643751__c1__859 | 3229 | 7001 | 270 | 89 | | |

Description
NO-HIT

| ORF Name | NT ID | AA ID | NT LN | AA LN | Score | P-Value |
|---|---|---|---|---|---|---|
| AI7503000999__6644537__f1__178 | 3230 | 7002 | 258 | 85 | | |

Description
NO-HIT

| ORF Name | NT ID | AA ID | NT LN | AA LN | Score | P-Value |
|---|---|---|---|---|---|---|
| AI7503000999__6650267__f3__611 | 3231 | 7003 | 123 | 40 | | |

Description
NO-HIT

-continued

| ORF Name | NT ID | AA ID | NT LN | AA LN | Score | P-Value |
|---|---|---|---|---|---|---|
| AI7503000999_6715_c3_1123 | 3232 | 7004 | 510 | 169 | | |

Description
NO-HIT

| ORF Name | NT ID | AA ID | NT LN | AA LN | Score | P-Value |
|---|---|---|---|---|---|---|
| AI7503000999_6728178_f1_176 | 3233 | 7005 | 129 | 42 | | |

Description
NO-HIT

| ORF Name | NT ID | AA ID | NT LN | AA LN | Score | P-Value |
|---|---|---|---|---|---|---|
| AI7503000999_6728578_c2_942 | 3234 | 7006 | 1893 | 630 | 678 | 1.1e−66 |

Description
pir:[LN:B70001] [AC:B70001] [PN:ABC transporter (permease) homolog ytsD]
[GN:ytsD] [OR:*Bacillus subtilis*] [DB:pir2] >gp:(GI:e1185910:g2635521]
[LN:BSUB0016] [AC:Z99119:AL009126] [GN:ytsD] [FN:unknown] [OR:*Bacillus subtilis*] [DB:genpept-bct1] [DE:*Bacillus subtilis* complete genome (section 16 of 21): from 2997771 to 3213410.] [NT:similar to ABC transporter (permease)] [LE:110708] [RE:112648] [DI:complement] >gp:(GI:g2293178]
[LN:AF008220] [AC:AF008220] [PN:YtsD] [GN:ytsD] [OR:*Bacillus subtilis*]
[DB:genpept-bct2] [DE:*Bacillus subtilis* rrnB-dnaB genomic region.]
[NT:similarity to NADH dehydrogenase] [LE:67779] [RE:69719] [DI:direct]

| ORF Name | NT ID | AA ID | NT LN | AA LN | Score | P-Value |
|---|---|---|---|---|---|---|
| AI7503000999_6819462_f1_9 | 3235 | 7007 | 1491 | 496 | 1508 | 1.2e−154 |

Description
gp:[GI:e1299584:g3687418] [LN:BLY17554] [AC:Y17554] [PN:permease] [GN:arcD]
[OR:*Bacillus licheniformis*] [DB:genpept-bct1] [DE:*Bacillus licheniformis*
arcA, arcB, arcC and arcD genes.] [LE:2579] [RE:3985] [DI:direct]

| ORF Name | NT ID | AA ID | NT LN | AA LN | Score | P-Value |
|---|---|---|---|---|---|---|
| AI7503000999_6828125_c1_788 | 3236 | 7008 | 252 | 83 | 398 | 5.0e−37 |

Description
gp:[GI:d1046032:g5360856] [LN:D86934] [AC:D86934] [OR:*Staphylococcus aureus*]
[SR:*Staphylococcus aureus* (strain:N315) DNA, clone_lib:library of N31]
[DB:genpept] [DE:*Staphylococcus aureus* genes, mec region, partial and
complete cds.] [NT:ORF CN040] [LE:47301] [RE:>47552] [DI:complement]

| ORF Name | NT ID | AA ID | NT LN | AA LN | Score | P-Value |
|---|---|---|---|---|---|---|
| AI7503000999_6834501_c1_828 | 3237 | 7009 | 231 | 76 | | |

Description
NO-HIT

| ORF Name | NT ID | AA ID | NT LN | AA LN | Score | P-Value |
|---|---|---|---|---|---|---|
| AI7503000999_6929627_c2_1064 | 3238 | 7010 | 1146 | 381 | 756 | 5.7e−75 |

Description
pir:[LN:F70903] [AC:F70903] [PN:probable adhE protein] [GN:adhE]
[CL:long-chain alcohol dehydrogenase homology] [OR:*Mycobacterium tuberculosis*] [DB:pir2] >gp:[GI:e322878:g2213499] [LN:MTCI28]
[AC:Z97050:AL123456] [PN:adhE] [GN:adhE] [OR:*Mycobacterium tuberculosis*]
[DB:genpept-bct1] [DE:*Mycobacterium tuberculosis* H37Rv complete genome;
segment 10/162.] [NT:Rv0162c, (MTCI28.02c), len:383, adhE, alcohol]
[LE:1482] [RE:2633] [DI:complement]

| ORF Name | NT ID | AA ID | NT LN | AA LN | Score | P-Value |
|---|---|---|---|---|---|---|
| AI7503000999_6929642_f1_14 | 3239 | 7011 | 243 | 80 | | |

Description
NO-HIT

| ORF Name | NT ID | AA ID | NT LN | AA LN | Score | P-Value |
|---|---|---|---|---|---|---|
| AI7503000999_6929686_c1_1081 | 3240 | 7012 | 264 | 87 | 368 | 7.5e−34 |

-continued

Description
pir:[LN:A60634] [AC:A60634:C30471:S26349] [PN:probable transposase]
[OR:*Staphylococcus aureus*] [DB:pir2] >gp:[GI:g46597] [LN:SAIS52571]
[AC:X53952] [PN:transposase] [OR:*Staphylococcus aureus*] [DB:genpept-bct1]
[DE:*S. aureus* plasmid pSH6 DNA for insertion sequences IS257-1 and IS256.]
[LE:188] [RE:862] [DI:direct] >gp:[GI:g3676452] [LN:AF051917]
[AC:AF051917:L19570] [PN:putative transposase TnpE] [GN:tnpE]
[OR:*Staphylococcus aureus*] [DB:genpept-bct2] [DE:*Staphylococcus aureus*
plasmid pSK41, complete sequence.] [LE:40946] [RE:41620] [DI:direct]

| ORF Name | NT ID | AA ID | NT LN | AA LN | Score | P-Value |
|---|---|---|---|---|---|---|
| AI7503000999_6929686_f1_111 | 3241 | 7013 | 693 | 230 | 1195 | 1.7e−121 |

Description
sp:[LN:TRA2_STAAU] [AC:P19380] [OR:*STAPHYLOCOCCUS AUREUS*] [DE:TRANSPOSASE
FOR INSERTION SEQUENCE-LIKE ELEMENT IS431MEC] [SP:P19380] [DB:swissprot]
>pir:[LN:S12093] [AC:S12093:JU0116] [PN:probable transposase]
[OR:*Staphylococcus aureus*] [DB:pir2] >gp:[GI:g46602] [LN:SAIS431M]
[AC:X53818:M18438] [OR:*Staphylococcus aureus*] [DB:genpept-bct1] [DE:*S.
aureus* IS431mec gene associated with methicillin resistance.] [NT:putative
transposase (AA1–224)] [SP:P19380] [LE:272] [RE:946] [DI:direct]
>gp:[GI:e1237900:g2791991] [LN:SAMECAR1I] [AC:Y14051] [PN:putative
transposase] [OR:*Staphylococcus aureus*] [DB:genpept-bct1] [DE:*Staphylococcus
aureus* mecA, mecR1, mecI genes and ORF168, ORF142, ORF44, ORF145 and ORF224.]
[NT:ORF224] [LE:8096] [RE:8770] [DI:direct] >gp:[GI:d1046034:g5360858]
[LN:D86934] [AC:D86934] [PN:transposase for insertion sequence-like element]
[OR:*Staphylococcus aureus*] [SR:*Staphylococcus aureus* (strain:N315) DNA,
clone_lib:library of N31] [DB:genpept] [DE:*Staphylococcus aureus* genes, mec
region, partial and complete cds.] [NT:ORF N062] [LE:48054] [RE:48728]
[DI:direct] >gp:[GI:d1046044:g5360868] [LN:D86934] [AC:D86934]
[PN:transposase for insertion sequence-like element] [OR:*Staphylococcus
aureus*] [SR:*Staphylococcus aureus* (strain:N315) DNA, clone_lib:library of
N31] [DB:genpept] [DE:*Staphylococcus aureus* genes, mec region, partial and
complete cds.] [NT:ORF N070] [LE:53400] [RE:54074] [DI:direct]

| ORF Name | NT ID | AA ID | NT LN | AA LN | Score | P-Value |
|---|---|---|---|---|---|---|
| AI7503000999_7031563_c1_763 | 3242 | 7014 | 243 | 80 | 358 | 8.6e−33 |

Description
pir:[LN:S54709] [AC:S54709] [PN:hypothetical protein 81] [OR:*Staphylococcus
aureus*] [DB:pir2]

| ORF Name | NT ID | AA ID | NT LN | AA LN | Score | P-Value |
|---|---|---|---|---|---|---|
| AI7503000999_7223587_c3_1174 | 3243 | 7015 | 1401 | 466 | 218 | 4.9e−15 |

Description
gp:[GI:d1011960:g1064812] [LN:BACGNTZA] [AC:D78193] [GN:yycH] [OR:*Bacillus
subtilis*] [SR:*Bacillus subtilis* (strain:168) DNA] [DB:genpept-bct1]
[DE:*Bacillus subtilis* 36kb sequence between gntZ and trnY genes encoding 34
ORFs.] [LE:32039] [RE:33415] [DI:complement]

| ORF Name | NT ID | AA ID | NT LN | AA LN | Score | P-Value |
|---|---|---|---|---|---|---|
| AI7503000999_7297338_f1_190 | 3244 | 7016 | 213 | 70 | | |

Description
NO-HIT

| ORF Name | NT ID | AA ID | NT LN | AA LN | Score | P-Value |
|---|---|---|---|---|---|---|
| AI7503000999_791307_c3_1273 | 3245 | 7017 | 156 | 51 | | |

Description
NO-HIT

| ORF Name | NT ID | AA ID | NT LN | AA LN | Score | P-Value |
|---|---|---|---|---|---|---|
| AI7503000999_862927_c3_1289 | 3246 | 7018 | 195 | 64 | | |

Description
NO-HIT

| ORF Name | NT ID | AA ID | NT LN | AA LN | Score | P-Value |
|---|---|---|---|---|---|---|
| AI7503000999_87562_f3_550 | 3247 | 7019 | 162 | 53 | | |

-continued

| Description |  |  |  |  |  |  |
|---|---|---|---|---|---|---|
| NO-HIT |  |  |  |  |  |  |

| ORF Name | NT ID | AA ID | NT LN | AA LN | Score | P-Value |
|---|---|---|---|---|---|---|
| AI7503000999__892142__f2__249 | 3248 | 7020 | 198 | 65 |  |  |

Description
NO-HIT

| ORF Name | NT ID | AA ID | NT LN | AA LN | Score | P-Value |
|---|---|---|---|---|---|---|
| AI7503000999__898550__f3__629 | 3249 | 7021 | 126 | 41 |  |  |

Description
NO-HIT

| ORF Name | NT ID | AA ID | NT LN | AA LN | Score | P-Value |
|---|---|---|---|---|---|---|
| AI7503000999__917550__c1__869 | 3250 | 7022 | 216 | 71 | 143 | 5.2e−10 |

Description
gp:[GI:g929968] [LN:BAU30713] [AC:U30713] [OR:*Bacillus anthracis*] [SR:plasmid pXO1] [DB:genpept-bct1] [DE:*Bacillus anthracis* Sterne toxin plasmid pXO1 right inverted repeat element (SterneR) bordering the toxin-encoding region, ORFA and truncated ORFB genes, complete cds.] [NT:ORFA; similar to *B. anthracis* WeyAR element ORFA;] [LE:171] [RE:491] [DI:direct] >gp:[GI:g929971] [LN:BAU30714] [AC:U30714] [OR:*Bacillus anthracis*] [SR:plasmid pXO1] [DB:genpept-bct1] [DE:*Bacillus anthracis* Weybridge A toxin plasmid pXO1 right inverted repeat element (WeyAR) bordering the toxin-encoding region, ORFA and ORFB genes, complete cds.] [NT:ORFA; similar to *B. anthracis* SterneR element ORFA;] [LE:171] [RE:491] [DI:direct]

| ORF Name | NT ID | AA ID | NT LN | AA LN | Score | P-Value |
|---|---|---|---|---|---|---|
| AI7503000999__969050__c2__1031 | 3251 | 7023 | 162 | 53 |  |  |

Description
NO-HIT

| ORF Name | NT ID | AA ID | NT LN | AA LN | Score | P-Value |
|---|---|---|---|---|---|---|
| AI7503000999__970077__c3__1098 | 3252 | 7024 | 135 | 44 | 52 | 0.040 |

Description
gp:[GI:e264333:g1050454] [LN:CHRFBFPGE] [AC:X91081] [GN:rfbP] [OR:*Campylobacter hyoilei*] [DB:genpept-bct1] [DE:*C.hyoilei* rfbF and rfbP genes.] [LE:1896] [RE:2498] [DI:direct]

| ORF Name | NT ID | AA ID | NT LN | AA LN | Score | P-Value |
|---|---|---|---|---|---|---|
| AI7503000999__970250__c2__1057 | 3253 | 7025 | 912 | 303 | 446 | 4.1e−42 |

Description
pir:[LN:E69219] [AC:E69219] [PN:conserved hypothetical protein MTH894] [GN:MTH894] [OR:*Methanobacterium thermoautotrophicum*] [DB:pir2] >gp:[GI:g2621989] [LN:AE000865] [AC:AE000865:AE000666] [PN:conserved protein] [GN:MTH894] [OR:*Methanobacterium thermoautotrophicum*] [DB:genpept-bct1] [DE:*Methanobacterium thermoautotrophicum* from bases 808939 to 820180 (section 71 of 148) of the complete genome.] [NT:Function Code:14.01 - Unknown, Conserved protein;] [LE:4427] [RE:5410] [DI:direct]

| ORF Name | NT ID | AA ID | NT LN | AA LN | Score | P-Value |
|---|---|---|---|---|---|---|
| AI7503000999__970386__f1__60 | 3254 | 7026 | 333 | 110 | 270 | 5.2e−23 |

Description
pir:[LN:D70073] [AC:D70073] [PN:metabolite transport protein homolog yxcC] [GN:yxcC] [CL:glucose transport protein] [OR:*Bacillus subtilis*] [DB:pir2] >gp:[GI:e1184706:g2636527] [LN:BSUB0021] [AC:Z99124:AL009126] [GN:yxcC] [FN:unknown] [OR:*Bacillus subtilis*] [DB:genpept-bct1] [DE:*Bacillus subtilis* complete genome (section 21 of 21): from 3999281 to 4214814.] [NT:similar to metabolite transport protein] [LE:87516] [RE:88901] [DI:direct]

| ORF Name | NT ID | AA ID | NT LN | AA LN | Score | P-Value |
|---|---|---|---|---|---|---|
| AI7503000999__9765951__c1__816 | 3255 | 7027 | 144 | 47 |  |  |

-continued

| Description |
|---|
| NO-HIT |

| ORF Name | NT ID | AA ID | NT LN | AA LN | Score | P-Value |
|---|---|---|---|---|---|---|
| AI7503000999_9773385_c1_687 | 3256 | 7028 | 816 | 271 | 303 | 5.8e−27 |

| Description |
|---|
| gp:[GI:g757830] [LN:EC4HPADNA] [AC:Z37980] [PN:2-oxo-hept-3-ene-1,7-dioate hydratase] [GN:hpaH] [OR:*Escherichia coli*] [DB:genpept-bct1] [DE:*E.coli* hpa[G, R, E, D, F, H, I, X, A, B, C] genes.] [LE:4957] [RE:5760] [DI:direct] >gp:[GI:g2695682] [LN:AF036583] [AC:AF036583] [PN:2-oxo-hept-4-ene-1,7-dioate hydratase] [GN:hpcG] [OR:*Escherichia coli*] [DB:genpept-bct2] [DE:*Escherichia coli* 2-oxo-hept-4-ene-1,7-dioate hydratase (hpcG) gene, complete cds.] [NT:OHED hydratase] [LE:1] [RE:804] [DI:direct] |

| ORF Name | NT ID | AA ID | NT LN | AA LN | Score | P-Value |
|---|---|---|---|---|---|---|
| AI7503000999_979178_c3_1277 | 3257 | 7029 | 243 | 80 | | |

| Description |
|---|
| NO-HIT |

| ORF Name | NT ID | AA ID | NT LN | AA LN | Score | P-Value |
|---|---|---|---|---|---|---|
| AI7503000999_9792842_c1_711 | 3258 | 7030 | 1851 | 616 | 1480 | 1.1e−151 |

| Description |
|---|
| pir:[LN:C69840] [AC:C69840] [PN:conserved hypothetical protein yitJ] [GN:yitJ] [OR:*Bacillus subtilis*] [DB:pir2] >gp:(GI:e1183103:g2633437] [LN:BSUB0006] [AC:Z99109:AL009126] [GN:yitJ] [FN:unknown] [OR:*Bacillus subtilis*] [DB:genpept-bct1] [DE:*Bacillus subtilis* complete genome (section 6 of 21): from 999501 to 1209940.] [NT:similar to hypothetical proteins] [LE:178731] [RE:180569] [DI:complement] >gp:[GI:e1173535:g2145402] [LN:BSY09476] [AC:Y09476] [PN:YitJ] [OR:*Bacillus subtilis*] [DB:genpept-bct1] [DE:*B. subtilis* 54kb genomic DNA fragment.] [NT:putative - Some homology with MetH2 (*S. cerevisae*)] [LE:35957] [RE:37795] [DI:complement] |

| ORF Name | NT ID | AA ID | NT LN | AA LN | Score | P-Value |
|---|---|---|---|---|---|---|
| AI7503000999_980000_c3_1090 | 3259 | 7031 | 228 | 75 | | |

| Description |
|---|
| NO-HIT |

| ORF Name | NT ID | AA ID | NT LN | AA LN | Score | P-Value |
|---|---|---|---|---|---|---|
| AI7503000999_9806332_f3_491 | 3260 | 7032 | 450 | 149 | 237 | 9.3e−20 |

| Description |
|---|
| pir:[LN:A71175] [AC:A71175] [PN:probable dehydrogenase] [GN:PH0597] [OR:*Pyrococcus horikoshii*] [DB:pir2] >gp:[GI:d1030629:g3257003] [LN:AP000002] [AC:AP000002:AB009475:AB009476:AB009477:AB009478:AB009479:AB009480] [PN:376aa long hypothetical dehydrogenase] [GN:PH0597] [OR:*Pyrococcus horikoshii*] [SR:*Pyrococcus horikoshii* (strain:OT3) DNA] [DB:genpept-bct1] [DE:*Pyrococcus horikoshii* OT3 genomic DNA, 287001–544000 nt. position(2/7).] [NT:similar to owl:BSZ9404317 percent identity: 49.821] [LE:248539] [RE:249669] [DI:complement] |

| ORF Name | NT ID | AA ID | NT LN | AA LN | Score | P-Value |
|---|---|---|---|---|---|---|
| AI7503000999_9806692_c3_1251 | 3261 | 7033 | 1374 | 457 | 907 | 5.7e−91 |

| Description |
|---|
| sp:[LN:YMER_STAAU] [AC:P08655] [OR:*STAPHYLOCOCCUS AUREUS*] [DE:HYPOTHETICAL 19.7 KD PROTEIN IN MERCURIC RESISTANCE OPERON] [SP:P08655] [DB:swissprot] >pir:[LN:G29504] [AC:G29504] [PN:hypothetical 20K protein (mer regulatory region)] [OR:*Staphylococcus aureus*] [DB:pir2] >gp:[GI:g459902] [LN:L29436] [AC:L29436:M15048:N00048] [PN:regulatory protein] [GN:merR] [OR:Plasmid pI258] [SR:Plasmid pI258 DNA] [DB:genpept-bct1] [DE:Plasmid pI258 (from *S. aureus* strain RN23 8325) mercury resistance(mer) operon encoding mercuric reductase (merA), organomercuriallyase (merB), regulatory protein (merR) and membrane transport protein (merT), complete cds.] [LE:188] [RE:730] [DI:direct] |

| ORF Name | NT ID | AA ID | NT LN | AA LN | Score | P-Value |
|---|---|---|---|---|---|---|
| AI7503000999_9847811_c1_698 | 3262 | 7034 | 162 | 53 | | |

-continued

| Description NO-HIT | | | | | | |
|---|---|---|---|---|---|---|
| ORF Name | NT ID | AA ID | NT LN | AA LN | Score | P-Value |
| AI7503000999__991500__f1__182 | 3263 | 7035 | 135 | 44 | | |

| Description NO-HIT | | | | | | |
|---|---|---|---|---|---|---|
| ORF Name | NT ID | AA ID | NT LN | AA LN | Score | P-Value |
| AI7503001000__11955055__c1__45 | 3264 | 7036 | 192 | 64 | | |

| Description NO-HIT | | | | | | |
|---|---|---|---|---|---|---|
| ORF Name | NT ID | AA ID | NT LN | AA LN | Score | P-Value |
| AI7503001000__1214635__c2__48 | 3265 | 7037 | 387 | 128 | 469 | 1.5e−44 |

Description
gp:[GI:d1036080:g4001724] [LN:AB015981] [AC:AB015981] [PN:OrfA] [GN:orfA] [OR:*Staphylococcus aureus*] [SR:*Staphylococcus aureus* (strain:209P) DNA] [DB:genpept-bct1] [DE:*Staphylococcus aureus* genes for OrfA, MnhA, MnhB, MnhC, MnhD, MnhE, MnhF and MnhG, complete cds.] [LE:302] [RE:685] [DI:direct]

| ORF Name | NT ID | AA ID | NT LN | AA LN | Score | P-Value |
|---|---|---|---|---|---|---|
| AI7503001000__13089052__c2__46 | 3266 | 7038 | 123 | 40 | | |

| Description NO-HIT | | | | | | |
|---|---|---|---|---|---|---|
| ORF Name | NT ID | AA ID | NT LN | AA LN | Score | P-Value |
| AI7503001000__1378550__f3__34 | 3267 | 7039 | 144 | 47 | | |

| Description NO-HIT | | | | | | |
|---|---|---|---|---|---|---|
| ORF Name | NT ID | AA ID | NT LN | AA LN | Score | P-Value |
| AI7503001000__14460932__f2__21 | 3268 | 7040 | 294 | 97 | 451 | 1.2e−42 |

Description
gp:[GI:g1022726] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.] [NT:ORF1] [LE:1101] [RE:1922] [DI:complement]

| ORF Name | NT ID | AA ID | NT LN | AA LN | Score | P-Value |
|---|---|---|---|---|---|---|
| AI7503001000__14500036__c3__66 | 3269 | 7041 | 129 | 42 | | |

| Description NO-HIT | | | | | | |
|---|---|---|---|---|---|---|
| ORF Name | NT ID | AA ID | NT LN | AA LN | Score | P-Value |
| AI7503001000__15041078__f2__13 | 3270 | 7042 | 279 | 92 | 319 | 1.2e−28 |

Description
pir:[LN:G70012] [AC:G70012] [PN:conserved hypothetical protein yuiF] [GN:yuiF] [CL:conserved integral membrane protein HP0758] [OR:*Bacillus subtilis*] [DB:pir2] >gp:[GI:e1184283:g2635701] [LN:BSUB0017] [AC:Z99120:AL009126] [GN:yuiF] [FN:unknown] [OR:*Bacillus subtilis*] [DB:genpept-bct1] [DE:*Bacillus subtilis* complete genome (section 17 of 21): from 3197001 to 3414420.] [NT:similar to hypothetical proteins] [LE:96999] [RE:98327] [DI:complement]

| ORF Name | NT ID | AA ID | NT LN | AA LN | Score | P-Value |
|---|---|---|---|---|---|---|
| AI7503001000__21646015__f3__36 | 3271 | 7043 | 201 | 66 | 198 | 7.8e−16 |

Description
gp:[GI:g1022725] [LN:SHU35635] [AC:U35635] [PN:unknown] [OR:*Staphylococcus haemolyticus*] [SR:*Staphylococcus haemolyticus* strain=Y176] [DB:genpept-bct1] [DE:*Staphylococcus haemolyticus* IS1272 ORF1 and ORF2 genes, complete cds.]

-continued

[NT:ORF2] [LE:394] [RE:1083] [DI:complement] >gp:[GI:g295162] [LN:STAMECRA]
[AC:L14017] [OR:*Staphylococcus aureus*] [SR:*Staphylococcus aureus* (strain
COL) DNA] [DB:genpept-bct1] [DE:*Staphylococcus aureus* methicillin-resistance
protein (mecR) gene and unknown ORF, complete cds.] [NT:unknown ORF1;
putative] [LE:1492] [RE:2181] [DI:complement]

| ORF Name | NT ID | AA ID | NT LN | AA LN | Score | P-Value |
|---|---|---|---|---|---|---|
| AI7503001000_22136087_c2_53 | 3272 | 7044 | 1512 | 503 | 2102 | 1.3e−217 |

Description
gp:[GI:d1036084:g4001728] [LN:AB015981] [AC:AB015981] [PN:MnhD] [GN:mnhD]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:3976] [RE:5472]
[DI:direct]

| ORF Name | NT ID | AA ID | NT LN | AA LN | Score | P-Value |
|---|---|---|---|---|---|---|
| AI7503001000_22457312_f1_9 | 3273 | 7045 | 126 | 41 | | |

Description
NO-HIT

| ORF Name | NT ID | AA ID | NT LN | AA LN | Score | P-Value |
|---|---|---|---|---|---|---|
| AI7503001000_23456932_f3_26 | 3274 | 7046 | 153 | 50 | | |

Description
NO-HIT

| ORF Name | NT ID | AA ID | NT LN | AA LN | Score | P-Value |
|---|---|---|---|---|---|---|
| AI7503001000_23859843_f1_10 | 3275 | 7047 | 393 | 130 | 212 | 2.5e−17 |

Description
sp:[LN:GS13_BACSU] [AC:P80870:O05238] [GN:YUGI] [OR:*BACILLUS SUBTILIS*]
[DE:GENERAL STRESS PROTEIN 13 (GSP13)] [SP:P80870:O05238] [DB:swissprot]

| ORF Name | NT ID | AA ID | NT LN | AA LN | Score | P-Value |
|---|---|---|---|---|---|---|
| AI7503001000_23947132_f3_23 | 3276 | 7048 | 378 | 125 | 269 | 2.3e−23 |

Description
gp:[GI:e291128:g1834379] [LN:BLCOMAB] [AC:Y10551] [GN:ComAB] [FN:positive
activator of lichenysin synthetase] [OR:*Bacillus licheniformis*]
[DB:genpept-bct1] [DE:*B. licheniformis* comAB gene.] [LE:617] [RE:>963]
[DI direct]

| ORF Name | NT ID | AA ID | NT LN | AA LN | Score | P-Value |
|---|---|---|---|---|---|---|
| AI7503001000_24644702_c1_41 | 3277 | 7049 | 435 | 144 | 647 | 2.0e−63 |

Description
gp:[GI:d1036082:g4001726] [LN:AB015981] [AC:AB015981] [PN:MnhB] [GN:mnhB]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:3214] [RE:3642]
[DI:direct]

| ORF Name | NT ID | AA ID | NT LN | AA LN | Score | P-Value |
|---|---|---|---|---|---|---|
| AI7503001000_26756252_c3_61 | 3278 | 7050 | 2427 | 808 | 3318 | 0.0 |

Description
gp:[GI:d1036081:g4001725] [LN:AB015981] [AC:AB015981] [PN:MnhA] [GN:mnhA]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:816] [RE:3221]
[DI direct]

| ORF Name | NT ID | AA ID | NT LN | AA LN | Score | P-Value |
|---|---|---|---|---|---|---|
| AI7503001000_29742890_f2_22 | 3279 | 7051 | 189 | 62 | | |

Description
NO-HIT

-continued

| ORF Name | NT ID | AA ID | NT LN | AA LN | Score | P-Value |
|---|---|---|---|---|---|---|
| AI7503001000_32689812_c2_54 | 3280 | 7052 | 312 | 103 | 386 | 9.3e−36 |

Description
gp:[GI:d1036086:g4001730] [LN:AB015981] [AC:AB015981] [PN:MnhF] [GN:mnhF]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:5953] [RE:6246]
[DI:direct]

| ORF Name | NT ID | AA ID | NT LN | AA LN | Score | P-Value |
|---|---|---|---|---|---|---|
| AI7503001000_33397338_c3_64 | 3281 | 7053 | 492 | 163 | 635 | 3.8e−62 |

Description
gp:[GI:d1036085:g4001729] [LN:AB015981] [AC:AB015981] [PN:MnhE] [GN:mnhE]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:5474] [RE:5953]
[DI:direct]

| ORF Name | NT ID | AA ID | NT LN | AA LN | Score | P-Value |
|---|---|---|---|---|---|---|
| AI7503001000_34384380_c1_42 | 3282 | 7054 | 333 | 110 | 468 | 1.9e−44 |

Description
gp:[GI:d1036083:g4001727] [LN:AB015981] [AC:AB015981] [PN:MnhC] [GN:mnhC]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:3642] [RE:3983]
[DI:direct]

| ORF Name | NT ID | AA ID | NT LN | AA LN | Score | P-Value |
|---|---|---|---|---|---|---|
| AI7503001000_34617286_f2_19 | 3283 | 7055 | 612 | 203 | 304 | 3.9e−35 |

Description
sp:[LN:YDJ3_SCHPO] [AC:P87051] [GN:SPAC57A10.03] [OR:*SCHIZOSACCHAROMYCES POMBE*] [SR:,FISSION YEAST] [EC:5.2.1.8] [DE:PROBABLE PEPTIDYL-PROLYL
CIS-TRANS ISOMERASE C57A10.03,] [SP:P87051] [DB:swissprot]
>gp:[GI:e313994:g2058370] [LN:SPAC57A10] [AC:Z94864] [PN:peptidyl-prolyl
cis-trans isomerase] [GN:SPAC57A10.03] [OR:*Schizosaccharomyces pombe*]
[SR:fission yeast] [DB:genpept-pln1] [DE:*S. pombe* chromosome I cosmid
c57A10.] [NT:SPAC57A10.03, len:155, SIMILARITY:*Caenorhabditis] [SP:P87051]*
[LE:5344:5414:5521:5779] [RE:5373:5455:5574:5858] [DI:directJoin]

| ORF Name | NT ID | AA ID | NT LN | AA LN | Score | P-Value |
|---|---|---|---|---|---|---|
| AI7503001000_36604587_c1_44 | 3284 | 7056 | 1173 | 390 | | |

Description
NO-HIT

| ORF Name | NT ID | AA ID | NT LN | AA LN | Score | P-Value |
|---|---|---|---|---|---|---|
| AI7503001000_4017050_c3_59 | 3285 | 7057 | 126 | 41 | | |

Description
NO-HIT

| ORF Name | NT ID | AA ID | NT LN | AA LN | Score | P-Value |
|---|---|---|---|---|---|---|
| AI7503001000_5114680_c3_65 | 3286 | 7058 | 363 | 120 | 463 | 6.4e−44 |

Description
gp:[GI:d1036087:g4001731] [LN:AB015981] [AC:AB015981] [PN:MnhG] [GN:mnhG]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:6224] [RE:6580]
[DI:direct]

| ORF Name | NT ID | AA ID | NT LN | AA LN | Score | P-Value |
|---|---|---|---|---|---|---|
| AI7503001000_6672886_f3_35 | 3287 | 7059 | 1173 | 390 | 914 | 1.0e−91 |

Description
sp:[LN:YQIG_BACSU] [AC:P54524] [GN:YQIG] [OR:*BACILLUS SUBTILIS*] [EC:1.-.-.-]
[DE:PROBABLE NADH-DEPENDENT FLAVIN OXIDOREDUCTASE YQIG,] [SP:P54524]

-continued

[DB:swissprot] >pir:[LN:C69961] [AC:C69961] [PN:NADH-dependent flavin
oxidoreductase homolog yqiG] [GN:yqiG] [OR:*Bacillus subtilis*] [DB:pir2]
>gp:[GI:d1013261:g1303926] [LN:BACJH642] [AC:D84432:D82370] [PN:YqiG]
[OR:*Bacillus subtilis*] [SR:*Bacillus subtilis* (strain:JH642(trpC2 PheA1))
DNA] [DB:genpept-bct1] [DE:*Bacillus subtilis* DNA, 283 Kb region containing
skin element.] [LE:202096] [RE:203214] [DI:complement]
>gp:[GI:e1185689:g2634855] [LN:BSUB0013] [AC:Z99116:AL009126] [GN:yqiG]
[FN:unknown] [OR:*Bacillus subtilis*] [DB:genpept-bct1] [DE:*Bacillus subtilis*
complete genome (section 13 of 21): from 2395261 to 2613730.] [NT:similar to
NADH-dependent flavin oxidoreductase] [SP:P54524] [LE:120407] [RE:121525]
[DI:direct]

| ORF Name | NT ID | AA ID | NT LN | AA LN | Score | P-Value |
|---|---|---|---|---|---|---|
| AI7503001000__783125__c3__56 | 3288 | 7060 | 183 | 60 | | |

Description
NO-HIT

| ORF Name | NT ID | AA ID | NT LN | AA LN | Score | P-Value |
|---|---|---|---|---|---|---|
| AI7503001001__10000312__c3__1340 | 3289 | 7061 | 165 | 54 | | |

Description
NO-HIT

| ORF Name | NT ID | AA ID | NT LN | AA LN | Score | P-Value |
|---|---|---|---|---|---|---|
| AI7503001001__10006340__f2__492 | 3290 | 7062 | 501 | 166 | 85 | 0.0011 |

Description
gp:[GI:g160616] [LN:PFAR45B] [AC:M83791] [PN:trophozoite antigen] [GN:R45]
[OR:*Plasmodium falciparum*] [SR:*Plasmodium falciparum* (strain Tak 9.96)
(library:lambda-gt11] [DB:genpept-inv1] [DE:*Plasmodium falciparum*
trophozoite antigen gene (repeat region), partial cds.] [LE:<1] [RE:>327]
[DI:direct]

| ORF Name | NT ID | AA ID | NT LN | AA LN | Score | P-Value |
|---|---|---|---|---|---|---|
| AI7503001001__10265677__f2__556 | 3291 | 7063 | 150 | 49 | | |

Description
NO-HIT

| ORF Name | NT ID | AA ID | NT LN | AA LN | Score | P-Value |
|---|---|---|---|---|---|---|
| AI7503001001__10267016__c2__1133 | 3292 | 7064 | 789 | 262 | 210 | 4.1e−17 |

Description
sp:[LN:TIPA_STRLI] [AC:P32184] [GN:TIPA] [OR:*STREPTOMYCES LIVIDANS*]
[DE:TRANSCRIPTIONAL ACTIVATOR TIPA] [SP:P32184] [DB:swissprot]
>pir:[LN:S35354] [AC:S35354:A45923] [PN:tipA protein] [GN:tipA] [CL:tipA
protein] [OR:*Streptomyces lividans*] [DB:pir2] >gp:[GI:g408223] [LN:S64314]
[AC:S64314] [PN:TipAL–AS] [GN:tipA] [OR:*Streptomyces lividans*]
[DB:genpept-bct1] [DE:tipAL–AS complex:tipA=TipAL–AS [*Streptomyces
lividans*, Genomic, 1146 nt].] [NT:thiostrepton-specific recognition protein;
Method:] [LE:120] [RE:881] [DI:direct] >gp:[GI:e1453008:g4808352] [LN:SCE9]
[AC:AL049841] [PN:transcriptional regulator] [GN:SCE9.20] [OR:*Streptomyces
coelicolor*] [DB:genpept-bct1] [DE:*Streptomyces coelicolor* cosmid E9.]
[NT:SCE9.20c, tipA, transcriptional regulator, len:253] [LE:21108]
[RE:21869] [DI:complement]

| ORF Name | NT ID | AA ID | NT LN | AA LN | Score | P-Value |
|---|---|---|---|---|---|---|
| AI7503001001__10268818__f3__803 | 3293 | 7065 | 234 | 77 | | |

Description
NO-HIT

| ORF Name | NT ID | AA ID | NT LN | AA LN | Score | P-Value |
|---|---|---|---|---|---|---|
| AI7503001001__10343756__f3__840 | 3294 | 7066 | 174 | 57 | | |

Description
NO-HIT

| ORF Name | NT ID | AA ID | NT LN | AA LN | Score | P-Value |
|---|---|---|---|---|---|---|
| AI7503001001__10439005__f1__44 | 3295 | 7067 | 516 | 171 | 157 | 1.7e−11 |

-continued

Description
gp:[GI:d1044366:g5105267] [LN:AP000062] [AC:AP000062] [PN:114aa long
hypothetical protein] [GN:APE1580] [OR:*Aeropyrum pernix*] [SR:*Aeropyrum
pernix* (strain:K1) DNA] [DB:genpept] [DE:*Aeropyrum pernix* genomic DNA,
section 5/7.] [NT:similar to OWL:AB00946832 percent identity:37.500]
[LE:13911] [RE:14255] [DI:direct]

| ORF Name | NT ID | AA ID | NT LN | AA LN | Score | P-Value |
|---|---|---|---|---|---|---|
| AI7503001001__10548187__f3__766 | 3296 | 7068 | 162 | 53 | | |

Description
NO-HIT

| ORF Name | NT ID | AA ID | NT LN | AA LN | Score | P-Value |
|---|---|---|---|---|---|---|
| AI7503001001__10581693__f2__490 | 3297 | 7069 | 684 | 227 | 842 | 4.4e−84 |

Description
pir:[LN:A69868] [AC:A69868] [PN:ykvJ protein] [GN:ykvJ] [CL:conserved
hypothetical protein HI1191] [OR:*Bacillus subtilis*] [DB:pir2]
>gp:[GI:e1184962:g2633743] [LN:BSUB0008] [AC:Z99111:AL009126] [GN:ykvJ]
[FN:unknown] [OR:*Bacillus subtilis*] [DB:genpept-bct1] [DE:*Bacillus subtilis*
complete genome (section 8 of 21): from 1394791 to 1603020.] [NT:similar to
hypothetical proteins] [LE:44124] [RE:44783] [DI:direct]

| ORF Name | NT ID | AA ID | NT LN | AA LN | Score | P-Value |
|---|---|---|---|---|---|---|
| AI7503001001__10589818__f2__358 | 3298 | 7070 | 201 | 66 | 58 | 0.0051 |

Description
gp:[GI:e321942:g2664263] [LN:EFAS48C] [AC:Y12234] [PN:hypothetical protein]
[OR:*Enterococcus faecalis*] [DB:genpept-bct1] [DE:*E. faecalis* plasmid DNA
containing gene cluster involved in production and immunity to peptide
antibiotic AS-48.] [NT:ORF6] [LE:4556] [RE:5065] [DI:direct]

| ORF Name | NT ID | AA ID | NT LN | AA LN | Score | P-Value |
|---|---|---|---|---|---|---|
| AI7503001001__10667002__c3__1423 | 3299 | 7071 | 201 | 66 | | |

Description
NO-HIT

| ORF Name | NT ID | AA ID | NT LN | AA LN | Score | P-Value |
|---|---|---|---|---|---|---|
| AI7503001001__10667002__c3__1504 | 3300 | 7072 | 168 | 55 | | |

Description
NO-HIT

| ORF Name | NT ID | AA ID | NT LN | AA LN | Score | P-Value |
|---|---|---|---|---|---|---|
| AI7503001001__10737818__f1__230 | 3301 | 7073 | 471 | 156 | 233 | 1.7e−18 |

Description
sp:[LN:YP17__LISMO] [AC:P52309] [OR:*LISTERIA MONOCYTOGENES*] [DE:HYPOTHETICAL
17.1 KD PROTEIN IN DNAG/DNAE 5'REGION (P17)] [SP:P52309] [DB:swissprot]
>gp:[GI:g664754] [LN:LMU13165] [AC:U13165] [PN:P17] [OR:*Listeria
monocytogenes*] [DB:genpept-bct2] [DE:*Listeria monocytogenes* P17 (orfP17),
DNA primase (dnaG) and sigma43 subunit of RNA polymerase (rpoD) genes,
complete cds.] [NT:orfP17] [LE:196] [RE:645] [DI:direct]

| ORF Name | NT ID | AA ID | NT LN | AA LN | Score | P-Value |
|---|---|---|---|---|---|---|
| AI7503001001__10976387__c3__1503 | 3302 | 7074 | 210 | 69 | | |

Description
NO-HIT

| ORF Name | NT ID | AA ID | NT LN | AA LN | Score | P-Value |
|---|---|---|---|---|---|---|
| AI7503001001__11023402__f3__781 | 3303 | 7075 | 273 | 90 | 127 | 2.6e−08 |

Description
pir:[LN:A71007] [AC:A71007] [PN:hypothetical protein PH1351] [GN:PH1351]
[OR:*Pyrococcus horikoshii*] [DB:pir2] >gp:[GI:d1031400:g3257774]
[LN:AP000006]
[AC:AP000006:AB005215:AB009510:AB009511:AB009512:AB009513:AB009514]
[PN:101aa long hypothetical protein] [GN:PH1351] [OR:*Pyrococcus horikoshii*]

-continued

[SR:*Pyrococcus horikoshii* (strain:OT3) DNA, clone:*Pyrococcus horikoshi*]
[DB:genpept-bct1] [DE:*Pyrococcus horikoshii* OT3 genomic DNA, 1166001–1485000
nt. position(6/7).] [LE:50986] [RE:51291] [DI:direct]

| ORF Name | NT ID | AA ID | NT LN | AA LN | Score | P-Value |
|---|---|---|---|---|---|---|
| AI7503001001__110275__f2__577 | 3304 | 7076 | 276 | 91 | 292 | 8.5e−26 |

Description
gp:[GI:e255528:g1617429] [LN:SEABCTS] [AC:X99127] [PN:membrane protein]
[FN:iron repressible ABC transport system] [OR:*Staphylococcus epidermidis*]
[DB:genpept-bct1] [DE:*S. epidermidis* gene encoding ABC transport system.]
[LE:878] [RE:1624] [DI:direct]

| ORF Name | NT ID | AA ID | NT LN | AA LN | Score | P-Value |
|---|---|---|---|---|---|---|
| AI7503001001__11152176__c1__967 | 3305 | 7077 | 1029 | 342 | 1111 | 1.4e−112 |

Description
pir:[LN:A69855] [AC:A69855] [PN:low-affinity inorganic phosphate transport
homolog ykaB] [GN:ykaB] [OR:*Bacillus subtilis*] [DB:pir2]
>gp:[GI:e1181485:g2632005] [LN:BSAJ2571] [AC:AJ002571] [PN:YkaB] [GN:ykaB]
[OR:*Bacillus subtilis*] [DB:genpept-bct1] [DE:*Bacillus subtilis* 168 56 kb DNA
fragment between xlyA and ykoR.] [NT:homologous to low affinity phosphate
transporter] [LE:1614] [RE:2600] [DI:complement] >gp:[GI:e1183304:g2633638]
[LN:BSUB0007] [AC:Z99110:AL009126] [GN:ykaB] [FN:unknown] [OR:*Bacillus
subtilis*] [DB:genpept-bct1] [DE:*Bacillus subtilis* complete genome (section 7
of 21): from 1194391 to 1411140.] [NT:similar to low-affinity inorganic
phosphate] [LE:154563] [RE:155549] [DI:complement]

| ORF Name | NT ID | AA ID | NT LN | AA LN | Score | P-Value |
|---|---|---|---|---|---|---|
| AI7503001001__112561__f1__99 | 3306 | 7078 | 138 | 45 | | |

Description
NO-HIT

| ORF Name | NT ID | AA ID | NT LN | AA LN | Score | P-Value |
|---|---|---|---|---|---|---|
| AI7503001001__116383__f2__590 | 3307 | 7079 | 165 | 54 | | |

Description
NO-HIT

| ORF Name | NT ID | AA ID | NT LN | AA LN | Score | P-Value |
|---|---|---|---|---|---|---|
| AI7503001001__11728376__c2__1327 | 3308 | 7080 | 249 | 82 | 241 | 2.2e−20 |

Description
pir:[LN:A70026] [AC:A70026] [PN:hypothetical protein yuzB] [GN:yuzB]
[OR:*Bacillus subtilis*] [DB:pir2] >gp:[GI:e1184298:g2635716] [LN:BSUB0017]
[AC:Z99120:AL009126] [GN:yuzB] [FN:unknown] [OR:*Bacillus subtilis*]
[DB:genpept-bct1] [DE:*Bacillus subtilis* complete genome (section 17 of 21):
from 3197001 to 3414420.] [LE:110425] [RE:110661] [DI:complement]

| ORF Name | NT ID | AA ID | NT LN | AA LN | Score | P-Value |
|---|---|---|---|---|---|---|
| AI7503001001__11831433__f2__602 | 3309 | 7081 | 159 | 52 | 48 | 0.031 |

Description
gp:[GI:g554799] [LN:HIVB54CH] [AC:M96497] [PN:envelope protein] [GN:env]
[OR:Human immunodeficiency virus type 1] [SR:Human immunodeficiency virus
type 1 (individual__isolate) RNA] [DB:genpept-vr1] [DE:Human
immunodeficiency virus type 1 (clone B5-4) V1 & V2 regions of the envelope
protein (env) gene, partial cds.] [NT:hypervariable regions V1 and V2;
putative] [LE:<1] [RE:>296] [DI:direct]

| ORF Name | NT ID | AA ID | NT LN | AA LN | Score | P-Value |
|---|---|---|---|---|---|---|
| AI7503001001__11883557__f1__292 | 3310 | 7082 | 195 | 64 | | |

Description
NO-HIT

| ORF Name | NT ID | AA ID | NT LN | AA LN | Score | P-Value |
|---|---|---|---|---|---|---|
| AI7503001001__1199063__f1__135 | 3311 | 7083 | 510 | 169 | 165 | 5.3e−12 |

-continued

Description
sp:[LN:YJJP_HAEIN] [AC:P44520] [GN:HI0108] [OR:*HAEMOPHILUS INFLUENZAE*]
[DE:HYPOTHETICAL PROTEIN HI0108] [SP:P44520] [DB:swissprot] >pir:[LN:I64142]
[AC:I64142] [PN:hypothetical protein HI0108] [OR:*Haemophilus influenzae*]
[DB:pir2] >gp:[GI:g1573061] [LN:U32696] [AC:U32696:L42023] [PN:conserved
hypothetical protein] [GN:HI0108] [OR:*Haemophilus influenzae* Rd]
[DB:genpept-bct2] [DE:*Haemophilus influenzae* Rd section 11 of 163 of the
complete genome.] [NT:similar to GB:U14003 SP:P39402 PID:537207 GB:U00096]
[LE:4095] [RE:4988] [DI:direct]

| ORF Name | NT ID | AA ID | NT LN | AA LN | Score | P-Value |
|---|---|---|---|---|---|---|
| AI7503001001_1214688_f1_146 | 3312 | 7084 | 939 | 312 | 526 | 1.4e−50 |

Description
sp:[LN:MURB_BACSU] [AC:P18579:P16669:P37581] [GN:MURB] [OR:*BACILLUS
SUBTILIS*] [EC:1.1.1.158] [DE:ACETYLMURAMATE DEHYDROGENASE)]
[SP:P18579:P16669:P37581] [DB:swissprot] >pir:[LN:A43727]
[AC:S26500:PC1128:A43727:B69662] [PN:UDP-N-acetylenolpyruvoylglucosamine
reductase murB:hypothetical protein (murG 3' region)] [GN:murB]
[OR:*Bacillus subtilis*] [DB:pir2] >gp:[GI:g142833] [LN:BACDDSA] [AC:M31827]
[OR:*Bacillus subtilis*] [SR:*Bacillus subtilis* (clone:lambda-BS1) DNA]
[DB:genpept-bct1] [DE:*Bacillus subtilis* (clone lambda-BS1) cell division and
sporulation protein (dds) gene, complete cds.] [NT:ORF2] [LE:479] [RE:1390]
[DI:direct] >gp:(GI:e1185113:g2633894] [LN:BSUB0008] [AC:Z99111:AL009126]
[PN:UDP-N-acetylenolpyruvoylglucosamine reductase] [GN:murB]
[FN:peptidoglycan biosynthesis] [OR:*Bacillus subtilis*] [DB:genpept-bct1]
[EC:1.1.1.158] [DE:*Bacillus subtilis* complete genome (section 8 of 21): from
1394791 to 1603020.] [NT:alternate gene name: ylxC] [SP:P18579] [LE:197268]
[RE:198179] [DI:direct]

| ORF Name | NT ID | AA ID | NT LN | AA LN | Score | P-Value |
|---|---|---|---|---|---|---|
| AI7503001001_12616018_f2_357 | 3313 | 7085 | 270 | 89 | 84 | 0.0027 |

Description
gp:[GI:g48992] [LN:ECINCI2] [AC:X62169:S47694] [GN:pilU] [OR:*Escherichia
coli*] [DB:genpept-bct1] [DE:*E.coli* IncI2 plasmid R721 pilU, pIV, shf, rci
genes.] [LE:29] [RE:664] [DI:direct]

| ORF Name | NT ID | AA ID | NT LN | AA LN | Score | P-Value |
|---|---|---|---|---|---|---|
| AI7503001001_12617827_c1_1083 | 3314 | 7086 | 762 | 253 | 1160 | 8.9e−118 |

Description
gp:[GI:e1393156:g4490615] [LN:SAU133520] [AC:AJ133520] [PN:triosephosphate
isomerase] [GN:tpi] [OR:*Staphylococcus aureus*] [DB:genpept-bct1]
[DE:*Staphylococcus aureus* gap operon (gapR, gap, pgk and tpi genes).]
[LE:4307] [RE:5068] [DI:direct]

| ORF Name | NT ID | AA ID | NT LN | AA LN | Score | P-Value |
|---|---|---|---|---|---|---|
| AI7503001001_12789077_c3_1469 | 3315 | 7087 | 1107 | 368 | 1311 | 8.9e−134 |

Description
sp:[LN:UVRA_BACSU] [AC:O34863] [GN:UVRA] [OR:*BACILLUS SUBTILIS*]
[DE:EXCINUCLEASE ABC SUBUNIT A] [SP:O34863] [DB:swissprot] >pir:[LN:F69729]
[AC:F69729] [PN:excinuclease ABC chain A:excision endonuclease ABC,, chain
A:uvrA protein] [GN:uvrA] [CL:excinuclease ABC chain A:ATP-binding cassette
homology] [OR:*Bacillus subtilis*] [EC:3.1.-.-] [DB:pir2]
>gp:[GI:e1184422:g2636042] [LN:BSUB0019] [AC:Z99122:AL009126]
[PN:excinuclease ABC (subunit A)] [GN:uvrA] [FN:excision of ultraviolet
light-induced] [OR:*Bacillus subtilis*] [DB:genpept-bct1] [DE:*Bacillus
subtilis* complete genome (section 19 of 21): from 3597091 to 3809700.]
[SP:O34863] [LE:12034] [RE:14907] [DI:complement] >gp:[GI:g2618842]
[LN:AF017113] [AC:AF017113] [PN:excinuclease ABC subunit A] [GN:uvrA]
[OR:*Bacillus subtilis*] [DB:genpept-bct2] [DE:*Bacillus subtilis* 300–304
degree genomic sequence.] [LE:15386] [RE:18259] [DI:direct]
>gp:[GI:e1184422:g2636042] [LN:BSUB0019] [AC:Z99122:AL009126]
[PN:excinuclease ABC (subunit A)] [GN:uvrA] [FN:excision of ultraviolet
light-induced] [OR:*Bacillus subtilis*] [DB:genpept] [DE:*Bacillus subtilis*
complete genome (section 19 of 21): from 3597091 to 3809700.] [SP:O34863]
[LE:12034] [RE:14907] [DI:complement]

| ORF Name | NT ID | AA ID | NT LN | AA LN | Score | P-Value |
|---|---|---|---|---|---|---|
| AI7503001001_12929631_f2_529 | 3316 | 7088 | 156 | 51 | | |

-continued

Description
NO-HIT

| ORF Name | NT ID | AA ID | NT LN | AA LN | Score | P-Value |
|---|---|---|---|---|---|---|
| AI7503001001__12948336__c3__1475 | 3317 | 7089 | 273 | 90 | 316 | 2.4e−28 |

Description
sp:[LN:CLPP_BACSU] [AC:P80244:O08433] [GN:CLPP] [OR:*BACILLUS SUBTILIS*]
[EC:3.4.21.92] [DE:(ENDOPEPTIDASE CLP) (CASEINOLYTIC PROTEASE) (PROTEASE
TI)] [SP:P80244:O08433] [DB:swissprot] >pir:[LN:B69601] [AC:B69601:A47683]
[PN:ATP-dependent clp proteinase, chain P:stress protein G7] [GN:clpP]
[CL:ATP-dependent Clp proteinase chain P] [OR:*Bacillus subtilis*]
[EC:3.4.21.-] [DB:pir2] >gp:[GI:e1186142:g2635967] [LN:BSUB0018]
[AC:Z99121:AL009126] [PN:ATP-dependent Clp protease proteolytic subunit]
[GN:clpP] [OR:*Bacillus subtilis*] [DB:genpept-bct1] [EC:3.4.21.92]
[DE:*Bacillus subtilis* complete genome (section 18 of 21): from 3399551 to
3609060.] [NT:alternate gene name:yvdN] [SP:P80244] [LE:145744] [RE:146337]
[DI:direct] >gp:[GI:e313044:g1945673] [LN:BSZ94043] [AC:Z94043]
[PN:hypothetical protein] [GN:yvdN] [OR:*Bacillus subtilis*] [DB:genpept-bct1]
[DE:*B. subtilis* genomic DNA fragment (88 kb).] [NT:similar to CLPP__ECOLI
ATP-dependent clp protease] [SP:P80244] [LE:35334] [RE:35927]
[DI:complement] >gp:[GI:g2668494] [LN:BSU59754] [AC:U59754] [PN:ClpP]
[GN:clpP] [OR:*Bacillus subtilis*] [DB:genpept-bct2] [DE:*Bacillus subtilis* Clp
protease proteolytic component (clpP) gene, complete cds.] [NT:proteolytic
component of Clp protease] [LE:140] [RE:733] [DI:direct]

| ORF Name | NT ID | AA ID | NT LN | AA LN | Score | P-Value |
|---|---|---|---|---|---|---|
| AI7503001001__1351533__c2__1261 | 3318 | 7090 | 2571 | 856 | 3966 | 0.0 |

Description
sp:[LN:SECA_STAAU] [AC:O06446] [GN:SECA] [OR:*STAPHYLOCOCCUS AUREUS*]
[DE:PREPROTEIN TRANSLOCASE SECA SUBUNIT] [SP:O06446] [DB:swissprot]
>gp:[GI:g2078390] [LN:SAU97062] [AC:U97062] [PN:SecA] [GN:secA]
[FN:secretion] [OR:*Staphylococcus aureus*] [DB:genpept-bct1]
[DE:*Staphylococcus aureus* NCTC 8325 SecA (secA) gene, complete cds.]
[LE:440] [RE:2971] [DI:direct]

| ORF Name | NT ID | AA ID | NT LN | AA LN | Score | P-Value |
|---|---|---|---|---|---|---|
| AI7503001001__1362705__c1__960 | 3319 | 7091 | 123 | 40 | | |

Description
NO-HIT

| ORF Name | NT ID | AA ID | NT LN | AA LN | Score | P-Value |
|---|---|---|---|---|---|---|
| AI7503001001__1366018__f3__723 | 3320 | 7092 | 135 | 44 | | |

Description
NO-HIT

| ORF Name | NT ID | AA ID | NT LN | AA LN | Score | P-Value |
|---|---|---|---|---|---|---|
| AI7503001001__13710887__c2__1298 | 3321 | 7093 | 753 | 250 | 315 | 3.1e−28 |

Description
pir[LN:I39522] [AC:I39522] [PN:3-dehydroquinate dehydratase,, catabolic]
[GN:quiB] [CL:3-dehydroquinate dehydratase:3-dehydroquinate dehydratase
homology] [OR:*Acinetobacter calcoaceticus*] [EC:4.2.1.10] [DB:pir2]
>gp:(GI:g3172120] [LN:ACCPCAOP]
[AC:L05770:U04359:M33798:U20284:U11554:L13114:L03407] [PN:catabolic
dehydroquinate dehydratase] [GN:quiB] [FN:dehydration of dehydroquinate to]
[OR:*Acinetobacter* sp. ADP1] [DB:genpept-bct2] [DE:*Acinetobacter* sp. ADP1
pca-qui-pob supraoperonic cluster, complete sequence.] [LE:10923] [RE:11795]
[DI:direct]

| ORF Name | NT ID | AA ID | NT LN | AA LN | Score | P-Value |
|---|---|---|---|---|---|---|
| AI7503001001__13714193__c3__1456 | 3322 | 7094 | 582 | 193 | 583 | 1.2e−56 |

Description
sp:[LN:YSEA_STACA] [AC:P47995] [OR:*STAPHYLOCOCCUS CARNOSUS*] [DE:HYPOTHETICAL
PROTEIN IN SECA 5'REGION (ORF1) (FRAGMENT)] [SP:P47995] [DB:swissprot]

| ORF Name | NT ID | AA ID | NT LN | AA LN | Score | P-Value |
|---|---|---|---|---|---|---|

-continued

| | | | | | | |
|---|---|---|---|---|---|---|
| AI7503001001__13727318__f1__246 | 3323 | 7095 | 813 | 270 | 348 | 9.9e−32 |

Description
gp:[GI:g2735506] [LN:SCU96107] [AC:U96107] [PN:SceB precursor] [GN:sceB]
[OR:*Staphylococcus carnosus*] [DB:genpept-bct2] [DE:*Staphylococcus carnosus*
N5,N10-methylenetetrahydromethanopterinreductase homolog, SceB precursor
(sceB) and putative transmembrane protein genes, complete cds, and putative
Na+/H+ antiporter NhaC(nhaC) gene, partial cds.] [NT:major secreted protein]
[LE:1894] [RE:2685] [DI:direct]

| ORF Name | NT ID | AA ID | NT LN | AA LN | Score | P-Value |
|---|---|---|---|---|---|---|
| AI7503001001__1376577__f2__374 | 3324 | 7096 | 675 | 224 | 77 | 0.0044 |

Description
pir:[LN:F70141] [AC:F70141] [PN:probable oligopeptide transport ATP-binding
protein oppF] [GN:oppF] [CL:inner membrane protein malK:ATP-binding
cassette homology] [OR:*Borrelia burgdorferi*] [SR:, Lyme disease spirochete]
[DB:pir2] >gp:[GI:g2688242] [LN:AE001140] [AC:AE001140:AE000783]
[PN:oligopeptide ABC transporter, ATP-binding] [GN:BB0335] [OR:*Borrelia
burgdorferi*] [SR:Lyme disease spirochete] [DB:genpept-bct2] [DE:*Borrelia
burgdorferi* (section 26 of 70) of the complete genome.] [NT:similar to
SP:P24137 percent identity: 56.81;] [LE:3216] [RE:4187] [DI:direct]
>gp:[GI:g2281463] [LN:AF000366] [AC:AF000366] [PN:oligopeptide permease
homolog F] [GN:oppF] [OR:*Borrelia burgdorferi*] [SR:Lyme disease spirochete]
[DB:genpept-bct2] [DE:*Borrelia burgdorferi* oligopeptide permease homologs AI
(oppAI), AII(oppAII), AIII (oppAIII), B (oppB), C (oppC), D (oppD), and
F(oppF), P26 (p26) and enolase homolog (eno) genes, complete cds.] [NT:OppF]
[LE:9017] [RE:9988] [DI:direct]

| ORF Name | NT ID | AA ID | NT LN | AA LN | Score | P-Value |
|---|---|---|---|---|---|---|
| AI7503001001__13803167__f2__373 | 3325 | 7097 | 552 | 183 | 157 | 8.0e−11 |

Description
pir:[LN:A69774] [AC:A69774] [PN:integrase homolog ydcL] [GN:ydcL]
[OR:*Bacillus subtilis*] [DB:pir2] >gp:[GI:d1020071:g1881291] [LN:AB001488]
[AC:AB001488] [GN:ydcL] [OR:*Bacillus subtilis*] [SR:*Bacillus subtilis*
(strain:168) DNA] [DB:genpept-bct1] [DE:*Bacillus subtilis* genome sequence,
148 kb sequence of the region between 35 and 47 degree.] [NT:PROBABLE
INTEGRASE.] [LE:62741] [RE:63847] [DI:complement] >gp:[GI:e1182446:g2632780]
[LN:BSUB0003] [AC:Z99106:AL009126] [GN:ydcL] [FN:unknown] [OR:*Bacillus
subtilis*] [DB:genpept-bct1] [DE:*Bacillus subtilis* complete genome (section 3
of 21): from 402751 to 611850.] [NT:similar to integrase] [LE:126486]
[RE:127592] [DI :complement]

| ORF Name | NT ID | AA ID | NT LN | AA LN | Score | P-Value |
|---|---|---|---|---|---|---|
| AI7503001001__13834425__c2__1291 | 3326 | 7098 | 126 | 41 | | |

Description
NO-HIT

| ORF Name | NT ID | AA ID | NT LN | AA LN | Score | P-Value |
|---|---|---|---|---|---|---|
| AI7503001001__13921942__c3__1483 | 3327 | 7099 | 1554 | 517 | 1690 | 6.1e−174 |

Description
pir:[LN:D69675] [AC:D69675:I40024] [PN:phosphoglycerate mutase,, 2,
3-diphosphoglycerate-independent] [GN:pgm] [CL:phosphoglycerate mutase, 2,
3-bisphosphoglycerate-independent] [OR:*Bacillus subtilis*] [EC:5.4.2.1]
[DB:pir2] >gp:[GI:e1186079:g2635904] [LN:BSUB0018] [AC:Z99121:AL009126]
[PN:phosphoglycerate mutase] [GN:pgm] [FN:glycolysis] [OR:*Bacillus subtilis*]
[DB:genpept-bct1] [EC:5.4.2.1] [DE:*Bacillus subtilis* complete genome
(section 18 of 21): from 3399551 to 3609060.] [SP:P39773] [LE:77390]
[RE:78925] [DI:complement]

| ORF Name | NT ID | AA ID | NT LN | AA LN | Score | P-Value |
|---|---|---|---|---|---|---|
| AI7503001001__13931527__c3__1337 | 3328 | 7100 | 723 | 240 | 87 | 0.011 |

Description
pir:[LN:S49604] [AC:S49604] [PN:hypothetical protein 126 (rps12 3' region)]
[OR:plastid Astasia longa] [DB:pir2] >gp:[GI:e156256:g1334340] [LN:ALRPS12]
[AC:X82630] [GN:orf126] [OR:Chloroplast *Astasia longa*] [SR:euglenophycean
alga] [DB:genpept-pln1] [DE:*A. longa* plastid rps12, orf126 and orf288 genes.]
[NT:ata start] [LE:<1424] [RE:1801] [DI:direct]

-continued

| ORF Name | NT ID | AA ID | NT LN | AA LN | Score | P-Value |
|---|---|---|---|---|---|---|
| AI7503001001__1408438_f1__283 | 3329 | 7101 | 948 | 315 | 110 | 8.1e−06 |

Description
sp:[LN:YDCZ_ECOLI] [AC:P76111] [GN:YDCZ] [OR:*ESCHERICHIA COLI*]
[DE:HYPOTHETICAL 15.9 KD PROTEIN IN TEHB-ANSP INTERGENIC REGION] [SP:P76111]
[DB:swissprot] >pir:[LN:B64897] [AC:B64897] [PN:probable membrane protein
b1447] [OR:*Escherichia coli*] [DB:pir2] >gp:[GI:g1787718] [LN:AE000241]
[AC:AE000241:U00096] [PN:orf, hypothetical protein] [GN:b1447] [FN:orf;
Unknown] [OR:*Escherichia coli*] [DB:genpept-bct2] [DE:*Escherichia coli* K-12
MG1655 section 131 of 400 of the complete genome.] [NT:f149; This 149 aa ORF
is 31 pct identical (11 gaps)] [LE:9124] [RE:9573] [DI:complement]

| ORF Name | NT ID | AA ID | NT LN | AA LN | Score | P-Value |
|---|---|---|---|---|---|---|
| AI7503001001__14097163_f1__50 | 3330 | 7102 | 138 | 45 | | |

Description
NO-HIT

| ORF Name | NT ID | AA ID | NT LN | AA LN | Score | P-Value |
|---|---|---|---|---|---|---|
| AI7503001001__14120465_f1__56 | 3331 | 7103 | 513 | 170 | | |

Description
NO-HIT

| ORF Name | NT ID | AA ID | NT LN | AA LN | Score | P-Value |
|---|---|---|---|---|---|---|
| AI7503001001__14454632_f1__194 | 3332 | 7104 | 177 | 58 | 225 | 1.1e−18 |

Description
gp:[GI:g1022726] [LN:SHU35635] [AC:U35635] [PN:unknown] [OR:*Staphylococcus
haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503001001__14460882_c1__1104 | 3333 | 7105 | 177 | 58 | 234 | 1.2e−19 |

Description
gp:[GI:g1022726] [LN:SHU35635] [AC:U35635] [PN:unknown] [OR:*Staphylococcus
haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF] [LE:1101] [RE:1922] [DI:complement]

| ORF Name | NT ID | AA ID | NT LN | AA LN | Score | P-Value |
|---|---|---|---|---|---|---|
| AI7503001001__14460882_f3__776 | 3334 | 7106 | 183 | 60 | 128 | 6.0e−08 |

Description
gp:[GI:g1022726] [LN:SHU35635] [AC:U35635] [PN:unknown] [OR:*Staphylococcus
haemolyticus*] [SR:*Staphylococcus haemolyticus* strain=Y176] [DB:genpept-bct1]
[DE:*Staphylococcus haemolyticus* IS1272 ORF1 and ORF2 genes, complete cds.]
[NT:ORF1] [LE:1101] [RE:1922] [DI:complement]

| ORF Name | NT ID | AA ID | NT LN | AA LN | Score | P-Value |
|---|---|---|---|---|---|---|
| AI7503001001__14478377_c3__1383 | 3335 | 7107 | 1149 | 382 | 637 | 2.3e−62 |

Description
sp:[LN:HMPA_BACSU] [AC:P49852] [GN:HMP:ANE3] [OR:*BACILLUS SUBTILIS*]
[DE:FLAVOHEMOPROTEIN (HAEMOGLOBIN-LIKE PROTEIN) [FLAVOHEMOGLOBIN)]
[SP:P49852] [DB:swissprot] >pir:[LN:B69642] [AC:B69642] [PN:flavohemoglobin
hmp] [GN:hmp] [CL:flavohemoglobin:cytochrome-b5 reductase homology:globin
homology] [OR:*Bacillus subtilis*] [DB:pir2] >gp:[GI:d1011920:g1063247]
[LN:BAC168TRP2] [AC:D781891 [OR:*Bacillus subtilis*] [SR:*Bacillus subtilis*
(strain:168trpC2) DNA] [DB:genpept-bct1] [DE:*Bacillus subtilis* hmp DNA for 7
ORFs, complete cds.] [NT:high homology to flavohemoprotein
(Haemoglobin-like] [LE:999] [RE:2198] [DI:direct] >gp:[GI:e1181505:g2632025]
[LN:BSAJ2571] [AC:AJ002571] [PN:YkiA] [GN:ykiA] [OR:*Bacillus subtilis*]
[DB:genpept-bct1] [DE:*Bacillus subtilis* 168 56 kb DNA fragment between xlyA
and ykoR.] [NT:Flavohemoprotein] [SP:P49852] [LE:24916] [RE:26115]
[DI:direct] >gp:[GI:e1183324:g2633658] [LN:BSUB0007] [AC:Z99110:AL009126]
[PN:flavohemoglobin] [GN:hmp] [OR:*Bacillus subtilis*] [DB:genpept-bct1]
[DE:*Bacillus subtilis* complete genome (section 7 of 21): from 1194391 to
1411140.] [NT:alternate gene name:ykiA] [SP:P49852] [LE:177865] [RE:179064]

-continued

[DI:direct]

| ORF Name | NT ID | AA ID | NT LN | AA LN | Score | P-Value |
|---|---|---|---|---|---|---|
| AI7503001001_14494461_c2_1178 | 3336 | 7108 | 168 | 55 | | |

| Description |
|---|
| NO-HIT |

| ORF Name | NT ID | AA ID | NT LN | AA LN | Score | P-Value |
|---|---|---|---|---|---|---|
| AI7503001001_14500052_f1_64 | 3337 | 7109 | 204 | 67 | | |

| Description |
|---|
| NO-HIT |

| ORF Name | NT ID | AA ID | NT LN | AA LN | Score | P-Value |
|---|---|---|---|---|---|---|
| AI7503001001_14538202_c3_1510 | 3338 | 7110 | 762 | 253 | 1034 | 2.0e−104 |

Description
sp:[LN:V296_BACSU] [AC:P80866] [GN:YURI] [OR:*BACILLUS SUBTILIS*]
[DE:VEGETATIVE PROTEIN 296 (VEG296)] [SP:P80866] [DB:swissprot]

| ORF Name | NT ID | AA ID | NT LN | AA LN | Score | P-Value |
|---|---|---|---|---|---|---|
| AI7503001001_14564005_f2_456 | 3339 | 7111 | 249 | 82 | 87 | 0.0016 |

Description
pir:[LN:B69341] [AC:B69341] [PN:cobalt transport protein (cbiQ-1) homolog]
[OR:*Archaeoglobus fulgidus*] [DB:pir2] >gp:[GI:g2649885] [LN:AE001054]
[AC:AE001054:AE000782] [PN:cobalt transport protein (cbiQ-1)] [GN:AF0730]
[OR:*Archaeoglobus fulgidus*] [DB:genpept-bct2] [DE:*Archaeoglobus fulgidus*
section 53 of 172 of the complete genome.] [NT:similar to GP:1419077 percent
identity:32.61;] [LE:978] [RE:1700] [DI:direct]

| ORF Name | NT ID | AA ID | NT LN | AA LN | Score | P-Value |
|---|---|---|---|---|---|---|
| AI7503001001_14642203_c3_1363 | 3340 | 7112 | 834 | 277 | 772 | 1.2e−76 |

Description
pir:[LN:G70080] [AC:G70080] [PN:conserved hypothetical protein yxkD]
[GN:yxkD] [CL:conserved hypothetical protein yitT] [OR:*Bacillus subtilis*]
[DB:pir2] >gp:[GI:e1186383:g2636419] [LN:BSUB0020] [AC:Z99123:AL009126]
[GN:yxkD] [FN:unknown] [OR:*Bacillus subtilis*] [DB:genpept-bct1] [DE:*Bacillus
subtilis* complete genome (section 20 of 21): from 3798401 to 4010550.]
[NT:similar to hypothetical proteins] [LE:188319] [RE:189155]
[DI:complement] >gp:[GI:d1012387:g1783243] [LN:D83026] [AC:D83026:D45911]
[GN:yxkD] [OR:*Bacillus subtilis*] [SR:*Bacillus subtilis* (strain:BGSC 1A1)
DNA] [DB:genpept-bct1] [DE:*Bacillus subtilis* genome sequence covering
lic-cel region.] [NT:homologous to jojC gene product (*B. subtilis*;]
[LE:35310] [RE:36146] [DI:direct]

| ORF Name | NT ID | AA ID | NT LN | AA LN | Score | P-Value |
|---|---|---|---|---|---|---|
| AI7503001001_14648452_c3_1464 | 3341 | 7113 | 801 | 266 | 346 | 1.6e−31 |

Description
gp:[GI:e244971:g1340128] [LN:SA1234] [AC:X97985] [OR:*Staphylococcus aureus*]
[DB:genpept-bct1] [DE:*S.aureus* orfs 1, 2, 3 & 4.] [NT:ORF1] [LE:537] [RE:1304]
[DI:direct]

| ORF Name | NT ID | AA ID | NT LN | AA LN | Score | P-Value |
|---|---|---|---|---|---|---|
| AI7503001001_14875890_c3_1412 | 3342 | 7114 | 846 | 281 | 734 | 1.2e−72 |

Description
gp:[GI:e1359127:g4007669] [LN:SC4B5] [AC:AL034443] [PN:putative
oxidoreductase] [GN:SC4B5.01c] [OR:*Streptomyces coelicolor*]
[DB:genpept-bct1] [DE:*Streptomyces coelicolor* cosmid 4B5.] [NT:SC4B5.01c,
probable oxidoreductase, len; 277aa,] [LE:52] [RE:885] [DI:complement]

| ORF Name | NT ID | AA ID | NT LN | AA LN | Score | P-Value |
|---|---|---|---|---|---|---|
| AI7503001001_14878807_f2_599 | 3343 | 7115 | 960 | 162 | 2.8e−09 | |

Description
gp:[GI:e321943:g2664264] [LN:EFAS48C] [AC:Y12234] [PN:hypothetical protein]
[OR:*Enterococcus faecalis*] [DB:genpept-bct1] [DE:*E. faecalis* plasmid DNA -continued containing gene cluster involved in production and immunity to peptide
antibiotic AS-48.] [NT:ORF7] [LE:5043] [RE:6266] [DI:direct]

| ORF Name | NT ID | AA ID | NT LN | AA LN | Score | P-Value |
|---|---|---|---|---|---|---|
| AI7503001001__14886052__c3__1386 | 3344 | 7116 | 495 | 164 | 307 | 2.2e−27 |

Description
sp:[LN:YQGC__BACSU] [AC:P54486] [GN:YQGC] [OR:BACILLUS SUBTILIS]
[DE:HYPOTHETICAL 17.3 KD PROTEIN IN CCCA-SODA INTERGENIC REGION] [SP:P54486]
[DB:swissprot] >pir:[LN:G69955] [AC:G69955] [PN:hypothetical protein yqgC]
[GN:yqgC] [OR:*Bacillus subtilis*] [DB:pir2] >gp:[GI:d1013185:g1303850]
[LN:BACJH642] [AC:D84432:D82370] [PN:YqgC] [OR:*Bacillus subtilis*]
[SR:*Bacillus subtilis* (strain:JH642(trpC2 PheA1)) DNA] [DB:genpept-bct1]
[DE:*Bacillus subtilis* DNA, 283 Kb region containing skin element.]
[LE:132903] [RE:133385] [DI:direct] >gp:[GI:e1185770:g2634936] [LN:BSUB0013]
[AC:Z99116:AL009126] [GN:yqgC] [FN:unknown] [OR:*Bacillus subtilis*]
[DB:genpept-bct1] [DE:*Bacillus subtilis* complete genome (section 13 of 21):
from 2395261 to 2613730.] [SP:P54486] [LE:190236] [RE:190718] [DI:complement]

| ORF Name | NT ID | AA ID | NT LN | AA LN | Score | P-Value |
|---|---|---|---|---|---|---|
| AI7503001001__14970251__f3__623 | 3345 | 7117 | 294 | 97 | | |

Description
NO-HIT

| ORF Name | NT ID | AA ID | NT LN | AA LN | Score | P-Value |
|---|---|---|---|---|---|---|
| AI7503001001__15057762__c2__1198 | 3346 | 7118 | 1575 | 524 | 1194 | 2.2e−121 |

Description
sp:[LN:MEMP__ALCEU] [AC:Q07252] [OR:*ALCALIGENES EUTROPHUS*] [DE:MEMBRANE
PROTEIN] [SP:Q07252] [DB:swissprot] >pir:[LN:I39534] [AC:I39534:S33452]
[PN:hypothetical protein] [OR:*Alcaligenes eutrophus*] [DB:pir2]
>gp:[GI:g311309] [LN:AELACDEH] [AC:Z22737] [PN:putative membrane-bound
protein with four times] [OR:*Ralstonia eutropha*] [DB:genpept-bct1]
[DE:*A. eutrophus* genes for lactate dehydrogenase, putative membrane-bound
protein with four times repitition of Pro-Ser-Ala at the N-terminus (function
unknown) and transglycosidase (partial).] [SP:Q07252] [LE:962] [RE:2503]
[DI:direct]

| ORF Name | NT ID | AA ID | NT LN | AA LN | Score | P-Value |
|---|---|---|---|---|---|---|
| AI7503001001__1561__c1__1025 | 3347 | 7119 | 1944 | 647 | 1406 | 7.6e−144 |

Description
pir:[LN:A69814] [AC:A69814] [PN:ABC transporter (ATP-binding protein)
homolog yfmR] [GN:yfmR] [CL:ATP-binding cassette homology] [OR:*Bacillus
subtilis*] [DB:pir2] >gp:[GI:e1182716:g2633050] [LN:BSUB0004]
[AC:Z99107:AL009126] [GN:yfmR] [FN:unknown] [OR:*Bacillus subtilis*]
(DB:genpept-bct1) [DE:*Bacillus subtilis* complete genome (section 4 of 21):
from 600701 to 813890.] [NT:similar to ABC transporter (ATP-binding protein)]
[LE:208365] [RE:210254] [DI:direct] >gp:[GI:e1182727:g2633061] [LN:BSUB0005]
[AC:Z99108:AL009126] [GN:yfmR] [FN:unknown] [OR:*Bacillus subtilis*]
[DB:genpept-bct1] [DE:*Bacillus subtilis complete genome (section 5 of 21):*
from 802821 to 1011250.] [NT:similar to ABC transporter (ATP-binding
protein)] [LE:6245] [RE:8134] [DI:direct] >gp:[GI:d1020922:g2116756]
[LN:D86418] [AC:D86418] [PN:YfmR] [OR:*Bacillus subtilis*] [SR:*Bacillus
subtilis* (strain:AC327) DNA] [DB:genpept-bct1] [DE:*Bacillus subtilis* genomic
DNA 69–70 degree region, partial sequence.] [LE:2937] [RE:4826]
[DI complement]

| ORF Name | NT ID | AA ID | NT LN | AA LN | Score | P-Value |
|---|---|---|---|---|---|---|
| AI7503001001__15661088__c2__1162 | 3348 | 7120 | 513 | 170 | | |

Description
NO-HIT

| ORF Name | NT ID | AA ID | NT LN | AA LN | Score | P-Value |
|---|---|---|---|---|---|---|
| AI7503001001__15751312__f1__164 | 3349 | 7121 | 2136 | 711 | 1980 | 1.1e−204 |

Description
sp:[LN:ADH2__ENTHI] [AC:Q24803:Q27649] [GN:ADH2] [OR:*ENTAMOEBA HISTOLYTICA*]
[EC:1.1.1.1:1.2.1.10] [DE:DEHYDROGENASE, (ACDH)] [SP:Q24803:Q27649]
[DB:swissprot] >gp:[GI:g488430] [LN:EHU04863] [AC:U04863] [PN:alcohol
dehydrogenase 2] [OR:*Entamoeba histolytica*] [DB:genpept-inv1] [DE *Entamoeba*

-continued

*histolytica* HM1:IMSS alcohol dehydrogenase 2 (EhADH2)mRNA, complete cds.]
[NT:The derived amino acid sequence of EhADH2 is] [LE:3] [RE:2615]
[DI:direct]

| ORF Name | NT ID | AA ID | NT LN | AA LN | Score | P-Value |
|---|---|---|---|---|---|---|
| AI7503001001__15752262__f3__666 | 3350 | 7122 | 153 | 50 | | |

| | Description |
|---|---|
| | NO-HIT |

| ORF Name | NT ID | AA ID | NT LN | AA LN | Score | P-Value |
|---|---|---|---|---|---|---|
| AI7503001001__15756542__c2__1195 | 3351 | 7123 | 201 | 66 | | |

| | Description |
|---|---|
| | NO-HIT |

| ORF Name | NT ID | AA ID | NT LN | AA LN | Score | P-Value |
|---|---|---|---|---|---|---|
| AI7503001001__157767__c3__1366 | 3352 | 7124 | 1077 | 358 | 534 | 1.9e−51 |

Description
gp:[GI:d1045428:g5106360] [LN:AB028629] [AC:AB028629] [PN:lipase] [GN:lipA]
[OR:*Clostridium perfringens*] [SR:Clostridium perfringens (strain:13) DNA,
clone:pSB235] [DB:genpept] [DE:*Clostridium perfringens* metB, cysK, ygaG,
lipA genes for cystathionine beta-synthase, cysteine synthase,
hypothetical protein, lipase, partial and complete cds.] [NT:esterase]
[LE:3248] [RE:4183] [DI:direct]

| ORF Name | NT ID | AA ID | NT LN | AA LN | Score | P-Value |
|---|---|---|---|---|---|---|
| AI7503001001__15781336__c2__1131 | 3353 | 7125 | 471 | 156 | 150 | 9.5e−11 |

Description
pir:[LN:C70059] [AC:C70059] [PN:hypothetical protein ywiB] [GN:ywiB]
[OR:*Bacillus subtilis*] [DB:pir2] >gp:[GI:e1186235:g2636271] [LN:BSUB0020]
[AC:Z99123:AL009126] [GN:ywiB] [FN:unknown] [OR:*Bacillus subtilis*]
[DB:genpept-bct1] [DE:*Bacillus subtilis* complete genome (section 20 of 21):
from 3798401 to 4010550.] [LE:35970] [RE:36398] [DI:complement]
>gp:[GI:e324352:g2224755] [LN:BSZ97024] [AC:Z97024] [GN:ywiB] [OR:*Bacillus
subtilis*] [DB:genpept-bct1] [DE:*Bacillus subtilis* ywiA, sbo, ywiB, argS and
narK genes.] [LE:1255] [RE:1683] [DI:direct]

| ORF Name | NT ID | AA ID | NT LN | AA LN | Score | P-Value |
|---|---|---|---|---|---|---|
| AI7503001001__16522890__f1__189 | 3354 | 7126 | 171 | 56 | | |

| | Description |
|---|---|
| | NO-HIT |

| ORF Name | NT ID | AA ID | NT LN | AA LN | Score | P-Value |
|---|---|---|---|---|---|---|
| AI7503001001__16603207__f3__710 | 3355 | 7127 | 378 | 125 | 217 | 7.5e−18 |

Description
pir:[LN:S72776] [AC:S72776] [PN:B1496_F1_41 protein] [OR:*Mycobacterium
leprae*] [DB:pir2] >gp:[GI:g466873] [LN:U00013] [AC:U00013] [PN:B1496_F1_41]
[OR:*Mycobacterium leprae*] [DB:genpept-bct1] [DE:*Mycobacterium leprae* cosmid
B1496.] [LE:29815] [RE:30312] [DI:direct]

| ORF Name | NT ID | AA ID | NT LN | AA LN | Score | P-Value |
|---|---|---|---|---|---|---|
| AI7503001001__166062__c2__1287 | 3356 | 7128 | 123 | 40 | 50 | 0.030 |

Description
pir:[LN:573871] [AC:S73871] [PN:type I restriction enzyme ecokI specificity
protein homolog:hypothetical protein H10_orf145L:hypothetical protein
H10_orf145L] [OR:*Mycoplasma pneumoniae*] [SR:ATCC 29342, , ATCC 29342]
[SR:ATCC 29342,] [DB:pir2] >gp:[GI:g1674242] [LN:MPAE000053]
[AC:AE000053:U00089] [GN:H10_orf145L] [OR:*Mycoplasma pneumoniae*]
[DB:genpept-bct2] [DE:*Mycoplasma pneumoniae* section 53 of 63 of the complete
genome.] [NT:type I restriction enzyme ecokI specificity protein] [LE:3554]
[RE:3991] [DI:complement]

| ORF Name | NT ID | AA ID | NT LN | AA LN | Score | P-Value |
|---|---|---|---|---|---|---|
| AI7503001001__166713__c2__1263 | 3357 | 7129 | 2001 | 666 | 2697 | 1.2e−280 |

-continued

Description
sp:[LN:UVRB_BACSU] [AC:P37954:O34455] [GN:UVRB:DINA:UVR] [OR:*BACILLUS SUBTILIS*] [DE:EXCINUCLEASE ABC SUBUNIT B (DINA PROTEIN)] [SP:P37954:O34455] [DB:swissprot] >pir:(LN:G69729] [AC:G69729:I39817:B37317] [PN:excinuclease ABC chain B:DNA repair protein DinA:excision endonuclease ABC,, chain B:hypothetical protein (DNA damage-inducible A76 promoter 3' region):UrvB homolog DinA] [GN:uvrB:uvr:dinA] [CL:excinuclease ABC chain B:DEAD/H box helicase homology] [OR:*Bacillus subtilis*] [EC:3.1.-.-] [DB:pir2] >gp:[GI:e1184423:g2636043] [LN:BSUB0019] [AC:Z99122:AL009126] [PN:excinuclease ABC (subunit B)] [GN:uvrB] [FN:excision of ultraviolet light-induced] [OR:*Bacillus subtilis*] [DB:genpept-bct1] [DE:*Bacillus subtilis* complete genome (section 19 of 21): from 3597091 to 3809700.] [NT:alternate gene name: dinA, uvrA] [SP:P37954] [LE:14915] [RE:16900] [DI:complement] >gp:[GI:g2618841] [LN:AF017113] [AC:AF017113] [PN:excinuclease ABC subunit B] [GN:uvrB] [OR:*Bacillus subtilis*] [DB:genpept-bct2] [DE:*Bacillus subtilis* 300–304 degree genomic sequence.] [LE:13393] [RE:15378] [DI:direct] >gp:[GI:e1184423:g2636043] [LN:BSUB0019] [AC:Z99122:AL009126] [PN:excinuclease ABC (subunit B)] [GN:uvrB] [FN:excision of ultraviolet light-induced] [OR:*Bacillus subtilis*] [DB:genpept] [DE:*Bacillus subtilis* complete genome (section 19 of 21): from 3597091 to 3809700.] [NT:alternate gene name:dinA, uvrA] [SP:P37954] [LE:14915] [RE:16900] [DI:complement]

| ORF Name | NT ID | AA ID | NT LN | AA LN | Score | P-Value |
|---|---|---|---|---|---|---|
| AI7503001001_16677343_c1_925 | 3358 | 7130 | 447 | 148 | 107 | 3.4e−06 |

Description
sp:[LN:Y357_METJA] [AC:Q57803] [GN:MJ0357] [OR:*METHANOCOCCUS JANNASCHII*] [DE:HYPOTHETICAL PROTEIN MJ0357] [SP:Q57803] [DB:swissprot] >pir:[LN:E64344] [AC:E64344] [PN:hypothetical protein MJ0357] [OR:*Methanococcus jannaschii*] [DB:pir2] [MP:REV326407–325940] >gp:[GI:g1591066] [LN:U67489] [AC:U67489:L77117] [PN:*M. jannaschii* predicted coding region MJ0357] [GN:MJ0357] [OR:*Methanococcus jannaschii*] [DB:genpept-bct2] [DE:*Methanococcus jannaschii* section 31 of 150 of the complete genome.] [NT:hypothetical protein; identified by GeneMark;] [LE:1632] [RE:2099] [DI:complement]

| ORF Name | NT ID | AA ID | NT LN | AA LN | Score | P-Value |
|---|---|---|---|---|---|---|
| AI7503001001_16834512_c3_1401 | 3359 | 7131 | 1380 | 459 | 661 | 6.7e−65 |

Description
sp:[LN:PHR_BACFI] [AC:Q04449] [GN:PHR] [OR:*BACILLUS FIRMUS*] [EC:4.1.99.3] [DE:(PHOTOREACTIVATING ENZYME) (FRAGMENT)] [SP:Q04449] [DB:swissprot] >gp:[GI:g142783] [LN:BACCTA] [AC:M94110] [PN:DNA photolyase] [GN:phr] [OR:*Bacillus firmus*] [SR:*Bacillus firmus* (strain OF4) DNA] [DB:genpept-bct1] [EC:4.1.99.3] [DE:*Bacillus firmus* DNA photolyase (phr) gene, 3' end, and cytochromeoxidase (cta) operon.] [NT:putative] [LE:1] [RE:1020] [DI:direct]

| ORF Name | NT ID | AA ID | NT LN | AA LN | Score | P-Value |
|---|---|---|---|---|---|---|
| AI7503001001_16850303_c1_1090 | 3360 | 7132 | 477 | 158 | 510 | 6.7e−49 |

Description
sp:[LN:SMPB_BACSU] [AC:O32230] [GN:SMPB] [OR:*BACILLUS SUBTILIS*] [DE:SMALL PROTEIN B HOMOLOG] [SP:O32230] [DB:swissprot] >pir:[LN:F70027] [AC:F70027] [PN:conserved hypothetical protein yvaI] [GN:yvaI] [CL:small protein smpB] [OR:*Bacillus subtilis*] [DB:pir2] >gp:[GI:e1186048:g2635873] [LN:BSUB0018] [AC:Z99121:AL009126] [GN:yvaI] [FN:unknown] [OR:*Bacillus subtilis*] [DB:genpept-bct1] [DE:*Bacillus subtilis* complete genome (section 18 of 21): from 3399551 to 3609060.] [NT:similar to hypothetical proteins] [SP:O32230] [LE:50760] [RE:51230] [DI:complement]

| ORF Name | NT ID | AA ID | NT LN | AA LN | Score | P-Value |
|---|---|---|---|---|---|---|
| AI7503001001_17011562_c3_1354 | 3361 | 7133 | 168 | 55 | | |

Description
NO-HIT

| ORF Name | NT ID | AA ID | NT LN | AA LN | Score | P-Value |
|---|---|---|---|---|---|---|
| AI7503001001_181500_c3_1353 | 3362 | 7134 | 798 | 265 | 415 | 7.8e−39 |

Description
sp:[LN:TAGA_BACSU] [AC:P27620] [GN:TAGA] [OR:*BACILLUS SUBTILIS*] [DE:TEICHOIC ACID BIOSYNTHESIS PROTEIN A] [SP:P27620] [DB:swissprot] >pir:[LN:B49757] [AC:B49757:B69720] [PN:polyglycerol phosphate techoic acid biosynthesis -continued protein tagA] [GN:tagA] [OR:*Bacillus subtilis*] [DB:pir2] >gp:[GI:g143724]
[LN:BACTAGABCD] [AC:M57497] [GN:tagA] [OR:*Bacillus subtilis*] [SR:*B. subtilis*
(strain 168) DNA] [DB:genpept-bct1] [DE:*B. subtilis* tagA, tagB, tagC and tagD
genes, complete cds.] [NT:putative] [LE:800] [RE:1570] [DI:direct]
>gp:[GI:e1184481:g2636101] [LN:BSUB0019] [AC:Z99122:AL009126] [GN:tagA]
[FN:polyglycerol phosphate assembly and export] [OR:*Bacillus subtilis*]
[DB:genpept-bct1] [DE:*Bacillus subtilis* complete genome (section 19 of 21):
from 3597091 to 3809700.] [SP:P27620] [LE:83340] [RE:84110] [DI:direct]
>gp:[GI:e1184481:g2636101] [LN:BSUB0019] [AC:Z99122:AL009126] [GN:tagA]
[FN:polyglycerol phosphate assembly and export] [OR:*Bacillus subtilis*]
[DB:genpept] [DE:*Bacillus subtilis* complete genome (section 19 of 21): from
3597091 to 3809700.] [SP:P27620] [LE:83340] [RE:84110] [DI:direct]

| ORF Name | NT ID | AA ID | NT LN | AA LN | Score | P-Value |
|---|---|---|---|---|---|---|
| AI7503001001__187568_c2__1149 | 3363 | 7135 | 327 | 108 | 178 | 1.0e−13 |

Description
pir:[LN:F70008] [AC:F70008] [PN:hypothetical protein yufC] [GN:yufC]
[OR:*Bacillus subtilis*] [DB:pir2] >gp:[GI:e1184242:g2635660] [LN:BSUB0017]
[AC:Z99120:AL009126] [GN:yufC] [FN:unknown] [OR:*Bacillus subtilis*]
[DB:genpept-bct1] [DE:*Bacillus subtilis* complete genome (section 17 of 21):
from 3197001 to 3414420.] [LE:53800] [RE:54084] [DI:direct]
>gp:[GI:e311513:g1934775] [LN:BSZ93932] [AC:Z93932] [PN:unknown] [GN:yufC]
[OR:*Bacillus subtilis*] [DB:genpept-bct1] [DE:*B. subtilis* genomic DNA fragment
from yufA to yufE.] [LE:7444] [RE:7728] [DI:complement]

| ORF Name | NT ID | AA ID | NT LN | AA LN | Score | P-Value |
|---|---|---|---|---|---|---|
| AI7503001001__187916_c2__1189 | 3364 | 7136 | 612 | 203 | 344 | 2.6e−31 |

Description
gp:[GI:e1314177:g3395518] [LN:PMAJ84] [AC:AJ000084] [PN:putative acetyl
transferase] [GN:pat] [OR:*Proteus mirabilis*] [DB:genpept-bct1] [DE:*Proteus
mirabilis* ccm and pat genes and partial ygbA gene.] [LE:949] [RE:1506]
[DI direct]

| ORF Name | NT ID | AA ID | NT LN | AA LN | Score | P-Value |
|---|---|---|---|---|---|---|
| AI7503001001__189187_c1__1040 | 3365 | 7137 | 132 | 43 | | |

Description
NO-HIT

| ORF Name | NT ID | AA ID | NT LN | AA LN | Score | P-Value |
|---|---|---|---|---|---|---|
| AI7503001001__19532277_c1__1120 | 3366 | 7138 | 126 | 41 | | |

Description
NO-HIT

| ORF Name | NT ID | AA ID | NT LN | AA LN | Score | P-Value |
|---|---|---|---|---|---|---|
| AI7503001001__19537812_c2__1293 | 3367 | 7139 | 150 | 49 | 39 | 0.0042 |

Description
pir:[LN:A70221] [AC:A70221] [PN:conserved hypothetical protein BBC08]
[OR:*Borrelia burgdorferi*] [SR:, Lyme disease spirochete] [DB:pir2]
>gp:[GI:g2689920] [LN:AE000791] [AC:AE000791] [PN:conserved hypothetical
protein] [GN:BBC08] [OR:*Borrelia burgdorferi*] [SR:Lyme disease spirochete]
[DB:genpept-bct2] [DE:*Borrelia burgdorferi* plasmid cp9, complete plasmid
sequence.] [NT:similar to GB:U03641 PID:458212 percent identity:] [LE:5534]
[RE:5980] [DI:direct]

| ORF Name | NT ID | AA ID | NT LN | AA LN | Score | P-Value |
|---|---|---|---|---|---|---|
| AI7503001001__19547783_f2__493 | 3368 | 7140 | 771 | 256 | 448 | 2.5e−42 |

Description
gp:[GI:g4481749] [LN:AF007865] [AC:AF007865] [PN:BacR] [GN:bacR]
[OR:*Bacillus licheniformis*] [DB:genpept-bct2] [DE:*Bacillus licheniformis*
bacitracin synthetase operon, complete sequence; BacS (bacS), BcrA (bcrA),
BcrB (bcrB), and BcrC (bcrC) genes, complete cds.] [NT:44488] [LE:44497]
[RE:45213] [DI:direct]

| ORF Name | NT ID | AA ID | NT LN | AA LN | Score | P-Value |
|---|---|---|---|---|---|---|
| AI7503001001__195885_f2__436 | 3369 | 7141 | 165 | 54 | | |

-continued

| | Description<br>NO-HIT | | | | | |
|---|---|---|---|---|---|---|
| ORF Name | NT ID | AA ID | NT LN | AA LN | Score | P-Value |
| AI7503001001__19589187__f3__689 | 3370 | 7142 | 207 | 68 | 57 | 0.019 |

Description
pir:[LN:F71027] [AC:F71027] [PN:hypothetical protein PH1514] [GN:PH1514]
[OR:*Pyrococcus horikoshii*] [DB:pir2] >gp:[GI:d1031565:g3257939]
[LN:AP000006]
[AC:AP000006:AB005215:AB009510:AB009511:AB009512:AB009513:AB009514]
[PN:310aa long hypothetical protein] [GN:PH1514] [OR:*Pyrococcus horikoshii*]
[SR:*Pyrococcus horikoshii* (strain:OT3) DNA, clone:*Pyrococcus horikoshi*]
[DB:genpept-bct1] [DE:*Pyrococcus horikoshii* OT3 genomic DNA, 1166001–1485000
nt. position(6/7).] [LE:183119] [RE:184051] [DI:complement]

| ORF Name | NT ID | AA ID | NT LN | AA LN | Score | P-Value |
|---|---|---|---|---|---|---|
| AI7503001001__19696951__c3__1486 | 3371 | 7143 | 183 | 60 | 193 | 2.6e−15 |

Description
pir:[LN:A70028] [AC:A70028] [PN:hypothetical protein yvaL] [GN:yvaL]
[CL:protein-export protein secG] [OR:*Bacillus subtilis*] [DB:pir2]
>gp:[GI:e1186051:g2635876] [LN:BSUB0018] [AC:Z99121:AL009126] [GN:yvaL]
[FN:unknown] [OR:*Bacillus subtilis*] [DB:genpept-bct1] [DE:*Bacillus subtilis*
complete genome (section 18 of 21): from 3399551 to 3609060.] [LE:54605]
[RE:54835] [DI:complement]

| ORF Name | NT ID | AA ID | NT LN | AA LN | Score | P-Value |
|---|---|---|---|---|---|---|
| AI7503001001__19704062__f2__528 | 3372 | 7144 | 183 | 60 | | |

| | Description<br>NO-HIT | | | | | |
|---|---|---|---|---|---|---|
| ORF Name | NT ID | AA ID | NT LN | AA LN | Score | P-Value |
| AI7503001001__197127__c3__1411 | 3373 | 7145 | 132 | 43 | | |

| | Description<br>NO-HIT | | | | | |
|---|---|---|---|---|---|---|
| ORF Name | NT ID | AA ID | NT LN | AA LN | Score | P-Value |
| AI7503001001__19714012__c1__939 | 3374 | 7146 | 144 | 47 | | |

| | Description<br>NO-HIT | | | | | |
|---|---|---|---|---|---|---|
| ORF Name | NT ID | AA ID | NT LN | AA LN | Score | P-Value |
| AI7503001001__197152__c3__1343 | 3375 | 7147 | 348 | 115 | 257 | 4.3e−22 |

Description
gp:[GI:d1036083:g4001727] [LN:AB015981] [AC:AB015981] [PN:MnhC] [GN:mnhC]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:3642] [RE:3983]
[DI direct]

| ORF Name | NT ID | AA ID | NT LN | AA LN | Score | P-Value |
|---|---|---|---|---|---|---|
| AI7503001001__19726575__c1__942 | 3376 | 7148 | 155 | 47 | | |

| | Description<br>NO-HIT | | | | | |
|---|---|---|---|---|---|---|
| ORF Name | NT ID | AA ID | NT LN | AA LN | Score | P-Value |
| AI7503001001__19765965__c1__1098 | 3377 | 7149 | 249 | 82 | 323 | 4.4e−29 |

Description
gp:[GI:g2226349] [LN:AF003593] [AC:AF003593] [PN:CspC] [GN:cspC]
[OR:*Staphylococcus aureus*] [DB:genpept-bct1] [DE:*Staphylococcus aureus* CspC
(cspC) gene, complete cds.] [NT:similar to major cold-shock protein]
[LE:444] [RE:644] [DI:direct]

-continued

| ORF Name | NT ID | AA ID | NT LN | AA LN | Score | P-Value |
|---|---|---|---|---|---|---|
| AI7503001001_19766886_f1_59 | 3378 | 7150 | 435 | 144 | 167 | 1.9e−12 |

Description
gp:[GI:e1294701:g3171734] [LN:BTPGI2XX] [AC:X13481] [OR:*Bacillus thuringiensis*] [DB:genpept-bct1] [DE:*Bacillus thuringiensis* plasmid pGI2 with transposon Tn4430.] [NT:ORF 2] [LE:6037] [RE:6849] [DI:direct]

| ORF Name | NT ID | AA ID | NT LN | AA LN | Score | P-Value |
|---|---|---|---|---|---|---|
| AI7503001001_19804502_f2_364 | 3379 | 7151 | 144 | 47 | | |

Description
NO-HIT

| ORF Name | NT ID | AA ID | NT LN | AA LN | Score | P-Value |
|---|---|---|---|---|---|---|
| AI7503001001_19814387_c1_966 | 3380 | 7152 | 135 | 44 | | |

Description
NO-HIT

| ORF Name | NT ID | AA ID | NT LN | AA LN | Score | P-Value |
|---|---|---|---|---|---|---|
| AI7503001001_19929556_f2_545 | 3381 | 7153 | 129 | 42 | | |

Description
NO-HIT

| ORF Name | NT ID | AA ID | NT LN | AA LN | Score | P-Value |
|---|---|---|---|---|---|---|
| AI7503001001_2007677_f2_513 | 3382 | 7154 | 144 | 47 | | |

Description
NO-HIT

| ORF Name | NT ID | AA ID | NT LN | AA LN | Score | P-Value |
|---|---|---|---|---|---|---|
| AI7503001001_2007767_c2_1199 | 3383 | 7155 | 126 | 41 | | |

Description
NO-HIT

| ORF Name | NT ID | AA ID | NT LN | AA LN | Score | P-Value |
|---|---|---|---|---|---|---|
| AI7503001001_20110186_f3_688 | 3384 | 7156 | 153 | 50 | | |

Description
NO-HIT

| ORF Name | NT ID | AA ID | NT LN | AA LN | Score | P-Value |
|---|---|---|---|---|---|---|
| AI7503001001_20322153_c2_1212 | 3385 | 7157 | 219 | 72 | | |

Description
NO-HIT

| ORF Name | NT ID | AA ID | NT LN | AA LN | Score | P-Value |
|---|---|---|---|---|---|---|
| AI7503001001_20350875_c3_1515 | 3386 | 7158 | 123 | 40 | | |

Description
NO-HIT

| ORF Name | NT ID | AA ID | NT LN | AA LN | Score | P-Value |
|---|---|---|---|---|---|---|
| AI7503001001_20485663_f2_563 | 3387 | 7159 | 210 | 69 | | |

Description
NO-HIT

| ORF Name | NT ID | AA ID | NT LN | AA LN | Score | P-Value |
|---|---|---|---|---|---|---|
| AI7503001001_20491385_f1_252 | 3388 | 7160 | 144 | 47 | | |

Description
NO-HIT

-continued

| ORF Name | NT ID | AA ID | NT LN | AA LN | Score | P-Value |
|---|---|---|---|---|---|---|
| AI7503001001__20604832__f3__692 | 3389 | 7161 | 558 | 185 | 106 | 0.012 |

Description
gp:[GI:g552163] [LN:PFA10B] [AC:J03986] [OR:*Plasmodium falciparum*]
[SR:*P. falciparum* (strain IMTM22) asexual erythrocytic form DNA, clon]
[DB:genpept-inv1] [DE:*P. falciparum* 10b antigen gene, partial cds.] [NT:10b
antigen] [LE:<1] [RE:>1124] [DI:direct]

| ORF Name | NT ID | AA ID | NT LN | AA LN | Score | P-Value |
|---|---|---|---|---|---|---|
| AI7503001001__20707877__c3__1457 | 3390 | 7162 | 123 | 40 | | |

Description
NO-HIT

| ORF Name | NT ID | AA ID | NT LN | AA LN | Score | P-Value |
|---|---|---|---|---|---|---|
| AI7503001001__20734387__f3__640 | 3391 | 7163 | 159 | 52 | | |

Description
NO-HIT

| ORF Name | NT ID | AA ID | NT LN | AA LN | Score | P-Value |
|---|---|---|---|---|---|---|
| AI7503001001__20830417__c3__1332 | 3392 | 7164 | 147 | 48 | | |

Description
NO-HIT

| ORF Name | NT ID | AA ID | NT LN | AA LN | Score | P-Value |
|---|---|---|---|---|---|---|
| AI7503001001__20893828__c1__974 | 3393 | 7165 | 219 | 72 | | |

Description
NO-HIT

| ORF Name | NT ID | AA ID | NT LN | AA LN | Score | P-Value |
|---|---|---|---|---|---|---|
| AI7503001001__20900017__c2__1239 | 3394 | 7166 | 2169 | 722 | 3396 | 0.0 |

Description
gp:[GI:e1393150:g4490609] [LN:SAU133495] [AC:AJ133495] [PN:ribonucelotide
reductase major subunit] [GN:rir1] [OR:*Staphylococcus aureus*]
[DB:genpept-bct1] [DE:*Staphylococcus aureus* ribonucleotide reductase
operon.] [LE:4481] [RE:2604] [DI:direct]

| ORF Name | NT ID | AA ID | NT LN | AA LN | Score | P-Value |
|---|---|---|---|---|---|---|
| AI7503001001__209452__f1__276 | 3395 | 7167 | 648 | 215 | 754 | 9.4e−75 |

Description
gp:[GI:e255528:g1617429] [LN:SEABCTS] [AC:X99127] [PN:membrane protein]
[FN:iron repressible ABC transport system] [OR:*Staphylococcus epidermidis*]
[DB:genpept-bct1] [DE:*S. epidermidis* gene encoding ABC transport system.]
[LE:878] [RE:1624] [DI:direct]

| ORF Name | NT ID | AA ID | NT LN | AA LN | Score | P-Value |
|---|---|---|---|---|---|---|
| AI7503001001__209627__c3__1444 | 3396 | 7168 | 1032 | 343 | 1571 | 2.5e−161 |

Description
gp:[GI:e1393151:g4490610] [LN:SAU133495] [AC:AJ133495] [PN:ribonucleotide
reductase minor subunit] [GN:rir2] [OR:*Staphylococcus aureus*]
[DB:genpept-bct1] [DE:*Staphylococcus aureus* ribonucleotide reductase
operon.] [LE:2722] [RE:3693] [DI:direct]

| ORF Name | NT ID | AA ID | NT LN | AA LN | Score | P-Value |
|---|---|---|---|---|---|---|
| AI7503001001__21490925__c1__1005 | 3397 | 7169 | 126 | 41 | | |

Description
NO-HIT

| ORF Name | NT ID | AA ID | NT LN | AA LN | Score | P-Value |
|---|---|---|---|---|---|---|
| AI7503001001__21509430__c1__962 | 3398 | 7170 | 132 | 43 | | |

Description

-continued

NO-HIT

| ORF Name | NT ID | AA ID | NT LN | AA LN | Score | P-Value |
|---|---|---|---|---|---|---|
| AI7503001001__21525061__c1__1016 | 3399 | 7171 | 681 | 226 | 110 | 0.00014 |

Description
sp:[LN:YB69__HAEIN] [AC:P44118] [GN:HI1169] [OR:*HAEMOPHILUS INFLUENZAE*]
[DE:HYPOTHETICAL PROTEIN HI1169] [SP:P44118] [DB:swissprot] >pir:[LN:A64021]
[AC:A64021] [PN:hypothetical protein HI1169] [OR:*Haemophilus influenzae*]
[DB:pir2] >gp:[GI:g1574096] [LN:U32797] [AC:U32797:L42023] [PN:*H. influenzae*
predicted coding region HI1169] [GN:HI1169] [OR:*Haemophilus influenzae* Rd]
[DB:genpept-bct2] [DE:*Haemophilus influenzae* Rd section 112 of 163 of the
complete genome.] [NT:hypothetical protein; identified by GeneMark;] [LE:511]
[RE:1077] [DI:complement]

| ORF Name | NT ID | AA ID | NT LN | AA LN | Score | P-Value |
|---|---|---|---|---|---|---|
| AI7503001001__21537811__c1__1007 | 3400 | 7172 | 1137 | 378 | 925 | 7.1e−93 |

Description
sp:[LN:CSBB__BACSU] [AC:Q45539] [GN:CSBB] [OR:*BACILLUS SUBTILIS*] [DE:CSBB
PROTEIN] [SP:Q45539] [DB:swissprot] >pir:[LN:JC5173] [AC:JC5173:G69607]
[PN:stress response protein csbB] [GN:csbB] [CL:stress response protein
csbB] [OR:*Bacillus subtilis*] [DB:pir2] >gp:[GI:g1387979] [LN:BACCSBB]
[AC:L77099] [GN:csbB] [OR:*Bacillus subtilis*] [DB:genpept-bct1] [DE:*Bacillus
subtilis* csbB gene, complete cds.] [NT:similar to hypothetical protein from
Synechocystis] [LE:310] [RE:1299] [DI:direct] >gp:[GI:e1182849:g2633183]
[LN:BSUB0005] [AC:Z99108:AL009126] [PN:stress response protein] [GN:csbB]
[OR:*Bacillus subtilis*] [DB:genpept-bct1] [DE:*Bacillus subtilis* complete
genome (section 5 of 21): from 802821 to 1011250.] [NT:alternate gene name:
yfhN] [SP:Q45539] [LE:127505] [RE:128494] [DI:direct]
>gp:[GI:d1025396:g2804544] [LN:D85082] [AC:D85082] [PN:YfhN] [OR:*Bacillus
subtilis*] [SR:*Bacillus subtilis* DNA] [DB:genpept-bct1] [DE:*Bacillus subtilis*
DNA, genome sequence, 79 to 81 degree region.] [LE:20396] [RE:21385]
[DI:direct]

| ORF Name | NT ID | AA ID | NT LN | AA LN | Score | P-Value |
|---|---|---|---|---|---|---|
| AI7503001001__21617215__f1__36 | 3401 | 7173 | 150 | 49 | | |

Description
NO-HIT

| ORF Name | NT ID | AA ID | NT LN | AA LN | Score | P-Value |
|---|---|---|---|---|---|---|
| AI7503001001__21726510__f2__612 | 3402 | 7174 | 126 | 41 | | |

Description
NO-HIT

| ORF Name | NT ID | AA ID | NT LN | AA LN | Score | P-Value |
|---|---|---|---|---|---|---|
| AI7503001001__21751287__f3__684 | 3403 | 7175 | 123 | 40 | | |

Description
NO-HIT

| ORF Name | NT ID | AA ID | NT LN | AA LN | Score | P-Value |
|---|---|---|---|---|---|---|
| AI7503001001__21883512__c3__1512 | 3404 | 7176 | 225 | 74 | | |

Description
NO-HIT

| ORF Name | NT ID | AA ID | NT LN | AA LN | Score | P-Value |
|---|---|---|---|---|---|---|
| AI7503001001__21897308__f2__541 | 3405 | 7177 | 261 | 86 | | |

Description
NO-HIT

| ORF Name | NT ID | AA ID | NT LN | AA LN | Score | P-Value |
|---|---|---|---|---|---|---|
| AI7503001001__21963877__c2__1273 | 3406 | 7178 | 123 | 40 | | |

Description
NO-HIT

-continued

| ORF Name | NT ID | AA ID | NT LN | AA LN | Score | P-Value |
|---|---|---|---|---|---|---|
| AI7503001001__22265936__c3__1452 | 3407 | 7179 | 1128 | 375 | 1557 | 7.6e−160 |

Description
pir:[LN:A55856] [AC:A55856] [PN:11m protein] [GN:11m] [CL:lipophilic
protein lim] [OR:*Staphylococcus aureus*] [DB:pir2] >gp:[GI:d1023388:g4433370]
[LN:STASRM551A] [AC:D21131] [PN:lipophilic protein which affects bacterial
lysis] [GN:11m] [OR:*Staphylococcus aureus*] [SR:*Staphylococcus aureus*
(strain:SRM551) DNA, clone__lib:lambda ZapII] [DB:genpept-bct1]
[DE:*Staphylococcus aureus* gene for a participant in homogeneous expression of
high-level methicillin resistance, complete cds.] [LE:148] [RE:1203]
[DI direct]

| ORF Name | NT ID | AA ID | NT LN | AA LN | Score | P-Value |
|---|---|---|---|---|---|---|
| AI7503001001__22381693__c3__1472 | 3408 | 7180 | 852 | 283 | 1187 | 1.2e−120 |

Description
sp:[LN:LGT__STAAU] [AC:P52282] [GN:LGT] [OR:*STAPHYLOCOCCUS AUREUS*]
[EC:2.4.99.-] [DE:PROLIPOPROTEIN DIACYLGLYCERYL TRANSFERASE,] [SP:P52282]
[DB:swissprot] >gp:[GI:g1016770] [LN:SAU35773] [AC:U35773]
[PN:prolipoprotein diacylglyceryl transferase] [GN:lgt] [FN:transfer of
diglyceride moiety to SH Group of] [OR:*Staphylococcus aureus*]
[DB genpept-bct1] [DE:*Staphylococcus aureus* prolipoprotein diacylglyceryl
transferase(lgt) gene, complete cds.] [LE:297] [RE:1136] [DI:direct]

| ORF Name | NT ID | AA ID | NT LN | AA LN | Score | P-Value |
|---|---|---|---|---|---|---|
| AI7503001001__22391068__c1__1046 | 3409 | 7181 | 1056 | 351 | 1284 | 6.4e−131 |

Description
gp:[GI:e1330455:g3724158] [LN:SAA005352] [AC:AJ005352] [PN:lipoprotein]
[GN:sstD] [FN:iron transporter] [OR:*Staphylococcus aureus*] [DB:genpept-bct1]
[DE:*Staphylococcus aureus*, Sst putative iron transport operon.] [LE:3066]
[RE:4095] [DI:direct]

| ORF Name | NT ID | AA ID | NT LN | AA LN | Score | P-Value |
|---|---|---|---|---|---|---|
| AI7503001001__22446053__c2__1132 | 3410 | 7182 | 726 | 241 | 335 | 2.4e−30 |

Description
pir[LN:A64479] [AC:A64479] [PN:DNA-(apurinic or apyrimidinic site)
lyase,:endonuclease III] [CL:*Methanococcus jannaschii* conserved
DNA-(apurinic or apyrimidinic site) lyase] [OR:*Methanococcus jannaschii*]
[EC:4.2.99.18] [DB:pir2] [MP:F0R1403656−1404318] >gp:[GI:g1592082]
[LN:U67584] [AC:U67584:L77117] [PN:endonuclease III, putative (nth2)]
[GN:MJ1434] [OR:*Methanococcus jannaschii*] [DB:genpept-bct2]
[DE:*Methanococcus jannaschii* section 126 of 150 of the complete genome.]
[NT:similar to GB:U11289 SP:P39788 PID:533099] [LE:7078] [RE:7740]
[DI:direct]

| ORF Name | NT ID | AA ID | NT LN | AA LN | Score | P-Value |
|---|---|---|---|---|---|---|
| AI7503001001__22462926__c1__1122 | 3411 | 7183 | 783 | 260 | 669 | 9.5e−66 |

Description
pir:[LN:H70023] [AC:H70023] [PN:N-acetyl-glucosamine catabolism homolog
yutF] [GN:yutF] [CL:nagD protein] [OR:*Bacillus subtilis*] [DB:pir2]
>gp:[GI:e1184308:g2635726] [LN:BSUB0017] [AC:Z99120:AL009126] [GN:yutF]
[FN:unknown] [OR:*Bacillus subtilis*] [DB:genpept-bct1] [DE:*Bacillus subtilis*
complete genome (section 17 of 21): from 3197001 to 3414420.] [NT:similar to
N-acetyl-glucosamine catabolism] [LE:120087] [RE:120857] [DI:complement]

| ORF Name | NT ID | AA ID | NT LN | AA LN | Score | P-Value |
|---|---|---|---|---|---|---|
| AI7503001001__22687900__c3__1369 | 3412 | 7184 | 681 | 226 | 685 | 1.9e−67 |

Description
pir:[LN:G70000] [AC:G70000] [PN:two-component response regulator [YtsB]
homolog ytsA] [GN:ytsA] [CL:ompR protein:response regulator homology]
[OR:*Bacillus subtilis*] [DB:pir2] >gp:[GI:e1185913:g2635524] [LN:BSUB0016]
[AC:Z99119:AL009126] [GN:ytsA] [FN:unknown] [OR:*Bacillus subtilis*]
[DB:genpept-bct1] [DE:*Bacillus subtilis* complete genome (section 16 of 21):
from 2997771 to 3213410.] [NT:similar to two-component response regulator
[YtsB] [LE:114498] [RE:115193] [DI:complement] >gp:[GI:g2293175]
[LN:AF008220] [AC:AF008220] [PN:signal transduction regulator] [GN:ytsA)

-continued

[OR:*Bacillus subtilis*] [DB:genpept-bct2] [DE:*Bacillus subtilis* rrnB-dnaB genomic region.] [LE:65234] [RE:65929] [DI:direct]

| ORF Name | NT ID | AA ID | NT LN | AA LN | Score | P-Value |
|---|---|---|---|---|---|---|
| AI7503001001__22776938__c2__1323 | 3413 | 7185 | 156 | 51 | | |

Description
NO-HIT

| ORF Name | NT ID | AA ID | NT LN | AA LN | Score | P-Value |
|---|---|---|---|---|---|---|
| AI7503001001__22895400__f3__753 | 3414 | 7186 | 138 | 45 | | |

Description
NO-HIT

| ORF Name | NT ID | AA ID | NT LN | AA LN | Score | P-Value |
|---|---|---|---|---|---|---|
| AI7503001001__23427750__c1__938 | 3415 | 7187 | 171 | 56 | | |

Description
NO-HIT

| ORF Name | NT ID | AA ID | NT LN | AA LN | Score | P-Value |
|---|---|---|---|---|---|---|
| AI7503001001__23438461__c1__926 | 3416 | 7188 | 687 | 228 | 103 | 0.029 |

Description
gp:[GI:g5306158] [LN:AF160864] [AC:AF160864] [PN:orf1386] [GN:orf1386]
[OR:Mitochondrion *Tetrahymena pyriformis*] [SR:*Tetrahymena pyriformis*]
[DB:genpept] [DE:*Tetrahymena pyriformis* mitochondrial DNA, complete genome.]
[NT:Open reading frame ymf77 (CPGN); ATA initiation] [LE:22317] [RE:26477]
[DI complement]

| ORF Name | NT ID | AA ID | NT LN | AA LN | Score | P-Value |
|---|---|---|---|---|---|---|
| AI7503001001__23439005__f1__6 | 3417 | 7189 | 141 | 46 | | |

Description
NO-HIT

| ORF Name | NT ID | AA ID | NT LN | AA LN | Score | P-Value |
|---|---|---|---|---|---|---|
| AI7503001001__23429061__c1__984 | 3418 | 7190 | 531 | 176 | 258 | 3.4e−22 |

Description
pir:[LN:F69927] [AC:F69927] [PN:hypothetical protein yosT] [GN:yosT]
[OR:*Bacillus subtilis*] [DB:pir2] >gp:[GI:e1185472:g2634393] [LN:BSUB0011]
[AC:Z99114:AL009126] [GN:yosT] [FN:unknown] [OR:*Bacillus subtilis*]
[DB:genpept-bct1] [DE:*Bacillus subtilis* complete genome (section 11 of 21):
from 2000171 to 2207900.] [LE:157797] [RE:158246] [DI:complement]
>gp:[GI:g3025644] [LN:AF020713] [AC:AF020713] [PN:unknown] [GN:yosT]
[OR:Bacteriophage SPBc2] [DB:genpept-phg] [DE:Bacteriophage SPBc2 complete
genome.] [LE:127274] [RE:127723] [DI:direct] >gp:[GI:g2522410] [LN:AF012906]
[AC:AF012906:U80600] [PN:unknown] [GN:yojV] [OR:*Bacillus subtilis*]
[DB:genpept-bct2] [DE:*Bacillus subtilis* yojP gene, partial cds; yojQ/S,
yojR, yojT, yojU, yojV, yojW, yojX, yojY, yojZ, and yokA genes, complete
cds.] [LE:4921] [RE:5370] [DI:direct]

| ORF Name | NT ID | AA ID | NT LN | AA LN | Score | P-Value |
|---|---|---|---|---|---|---|
| AI7503001001__23444838__c2__1267 | 3419 | 7191 | 264 | 87 | 373 | 2.2e−34 |

Description
gp:[GI:e1387399:g4379428] [LN:SAAJ3781] [AC:AJ223781] [PN:thioredoxin
reductase] [GN:trxB] [OR:*Staphylococcus aureus*] [DB:genpept-bct1]
[EC:1.6.4.5] [DE:*Staphylococcus aureus* trxB gene.] [LE:1262] [RE:2197]
[DI:direct]

| ORF Name | NT ID | AA ID | NT LN | AA LN | Score | P-Value |
|---|---|---|---|---|---|---|
| AI7503001001__23445175__f3__674 | 3420 | 7192 | 135 | 44 | | |

Description
NO-HIT

| ORF Name | NT ID | AA ID | NT LN | AA LN | Score | P-Value |
|---|---|---|---|---|---|---|

-continued

| | | | | | | |
|---|---|---|---|---|---|---|
| AI7503001001__23445890__c2__1177 | 3421 | 7193 | 492 | 163 | 333 | 3.8e−30 |

Description
pir:[LN:S74709] [AC:S74709] [PN:hypothetical protein sll1188]
[OR:*Synechocystis* sp.] [SR:PCC 6803, , PCC 6803] [SR:PCC 6803,] [DB:pir2]
>gp:[GI:d1017593:g1651934] [LN:D90901] [AC:D90901:AB001339] [PN:hypothetical
protein] [OR:*Synechocystis* sp.] [SR:*Synechocystis* sp. (strain:PCC6803) DNA]
[DB:genpept-bct1] [DE:*Synechocystis* sp. PCC6803 complete genome, 3/27,
271600–402289.] [NT:ORF_ID:sll1188] [LE:42106] [RE:42600] [DI:complement]

| ORF Name | NT ID | AA ID | NT LN | AA LN | Score | P-Value |
|---|---|---|---|---|---|---|
| AI7503001001__23446912__f2__597 | 3422 | 7194 | 123 | 40 | | |

Description
NO-HIT

| ORF Name | NT ID | AA ID | NT LN | AA LN | Score | P-Value |
|---|---|---|---|---|---|---|
| AI7503001001__2345062__f3__639 | 3423 | 7195 | 171 | 56 | | |

Description
NO-HIT

| ORF Name | NT ID | AA ID | NT LN | AA LN | Score | P-Value |
|---|---|---|---|---|---|---|
| AI7503001001__23450__c3__1490 | 3424 | 7196 | 189 | 62 | | |

Description
NO-HIT

| ORF Name | NT ID | AA ID | NT LN | AA LN | Score | P-Value |
|---|---|---|---|---|---|---|
| AI7503001001__23469552__c1__923 | 3425 | 7197 | 207 | 68 | | |

Description
NO-HIT

| ORF Name | NT ID | AA ID | NT LN | AA LN | Score | P-Value |
|---|---|---|---|---|---|---|
| AI7503001001__23475892__c1__1121 | 3426 | 7198 | 1362 | 453 | 707 | 9.0e−70 |

Description
pir:[LN:G70015] [AC:G70015] [PN:conserved hypothetical protein yunD]
[GN:yunD] [OR:*Bacillus subtilis*] [DB:pir2] >gp:[GI:e1184316:g2635734]
[LN:BSUB0017] [AC:Z99120:AL009126] [GN:yunD] [FN:unknown] [OR:*Bacillus
subtilis*] [DB:genpept-bct1] [DE:*Bacillus subtilis* complete genome (section
17 of 21): from 3197001 to 3414420.] [NT:similar to hypothetical proteins]
[LE:125728] [RE:127116] [DI:complement]

| ORF Name | NT ID | AA ID | NT LN | AA LN | Score | P-Value |
|---|---|---|---|---|---|---|
| AI7503001001__23476517__c2__1259 | 3427 | 7199 | 1296 | 431 | 638 | 1.8e−62 |

Description
sp:[LN:CMF1_BACSU] [AC:P39145] [GN:COMFA:COMF1] [OR:*BACILLUS SUBTILIS*]
[DE:COMF OPERON PROTEIN 1] [SP:P39145] [DB:swissprot] >pir:[LN:G69602)
[AC:G69602:S77620:S35011:I40387:S28597] [PN:late competence protein
required for DNA uptake comfA:ATP-dependent DNA helicase/translocase comF1]
[GN:comFA:comF1] [CL:DEAD/H box helicase homology] [OR:*Bacillus subtilis*]
[DB:pir2] >gp:[GI:g580841] [LN:BSCOMFG] [AC:Z18629] [PN:F1] [GN:comForf1]
[OR:*Bacillus subtilis*] [DB:genpept-bct1] [DE:B. subtilis comF gene.]
[SP:P39145] [LE:952] [RE:2343] [DI:direct] >gp:[GI:e1184453:g2636073]
[LN:BSUB0019] [AC:Z99122:AL009126] [PN:late competence protein] [GN:comFA]
[FN:required for DNA uptake (competence)] [OR:*Bacillus subtilis*]
[DB:genpept-bct1] [DE:*Bacillus subtilis* complete genome (section 19 of 21):
from 3597091 to 3809700.] [SP:P39145] [LE:44137] [RE:45528] [DI:complement]
>gp:[GI:g1762332] [LN:BSU56901] [AC:U56901] [GN:comFA] [OR:*Bacillus
subtilis*] [DB:genpept-bct2] [DE:*Bacillus subtilis* putative transcriptional
regulator (yvhJ), Ycr59c/YigZ homolog (yvhK), histidine kinase
(degS), transcriptional regulator of degradation enzyme (degU), (degV),
(comFA), (comFB), (comFC), flagellar protein (yviB), negative regulator of
flagellin(flgM), flagellar protein (yviC), flagellar-hook associated
protein1 (flgK), flagellar-hook associated protein 3 (flgL),
(yviE), transmembrane protein (yviF), (csrA), flagellin (hag),
flagellar protein (yviH), flagellar hook-associated protein 2
(fliD), flagellar protein (fliS), flagellar protein (fliT), sigma-54modulator
homolog (yviI), and (secA) genes, complete cds.] [NT:involved in
transformation] [LE:5065] [RE:6456] [DI:direct] >gp:[GI:e1184453:g2636073]

-continued

[LN:BSUB0019] [AC:Z99122:AL009126] [PN:late competence protein] [GN:comFA]
[FN:required for DNA uptake (competence)] [OR:*Bacillus subtilis*]
[DB:genpept] [DE:*Bacillus subtilis* complete genome (section 19 of 21): from
3597091 to 3809700.] [SP:P39145] [LE:44137] [RE:45528] [DI:complement]

| ORF Name | NT ID | AA ID | NT LN | AA LN | Score | P-Value |
|---|---|---|---|---|---|---|
| AI7503001001_23492127_f2_368 | 3428 | 7200 | 453 | 150 | | |

Description
NO-HIT

| ORF Name | NT ID | AA ID | NT LN | AA LN | Score | P-Value |
|---|---|---|---|---|---|---|
| AI7503001001_23494051_f2_444 | 3429 | 7201 | 1101 | 366 | 336 | 1.8e−30 |

Description
sp:[LN:YHCK_BACSU] [AC:P54595] [GN:YHCK] [OR:*BACILLUS SUBTILIS*]
[DE:HYPOTHETICAL 40.7 KD PROTEIN IN CSPB-GLPP INTERGENIC REGION] [SP:P54595]
[DB:swissprot] >pir:[LN:G69822] [AC:G69822] [PN:conserved hypothetical
protein yhcK] [GN:yhcK] [OR:*Bacillus subtilis*] [DB:pir2]
>gp:[GI:e233892:g1239987] [LN:BS75DGREG] [AC:X96983] [PN:hypothetical
protein] [GN:yhcK] [OR:*Bacillus subtilis*] [DB:genpept-bct1] [DE:*B. subtilis*
chromosomal DNA (region 75 degrees:cspB upstream of glpPFKD operon).]
[NT:similarity to hypothetical proteins from] [SP:P54595] [LE:6616]
[RE:7695] [DI:complement] >gp:[GI:e1182901:g2633235] [LN:BSUB0005]
[AC:Z99108:AL009126] [GN:yhcK] [FN:unknown] [OR:*Bacillus subtilis*]
[DB:genpept-bct1] [DE:*Bacillus subtilis* complete genome (section 5 of 21):
from 802821 to 1011250.] [NT:similar to hypothetical proteins] [SP:P54595]
[LE:182422] [RE:183501] [DI:complement]

| ORF Name | NT ID | AA ID | NT LN | AA LN | Score | P-Value |
|---|---|---|---|---|---|---|
| AI7503001001_235042_c1_1064 | 3430 | 7202 | 141 | 46 | | |

Description
NO-HIT

| ORF Name | NT ID | AA ID | NT LN | AA LN | Score | P-Value |
|---|---|---|---|---|---|---|
| AI7503001001_2352140_f3_902 | 3431 | 7203 | 156 | 51 | | |

Description
NO-HIT

| ORF Name | NT ID | AA ID | NT LN | AA LN | Score | P-Value |
|---|---|---|---|---|---|---|
| AI7503001001_23523326_c3_1385 | 3432 | 7204 | 1242 | 413 | 416 | 6.1e−39 |

Description
sp:[LN:YICK_ECOLI] [AC:P31436] [GN:YICK] [OR:*ESCHERICHIA COLI*]
[DE:HYPOTHETICAL 43.5 KD PROTEIN IN SELC-NLPA INTERGENIC REGION] [SP:P31436]
[DB:swissprot] >pir:[LN:D65167] [AC:D65167] [PN:probable membrane protein
yicK] [GN:yicK] [OR:*Escherichia coli*] [DB:pir2] >gp:[GI:g290508]
[LN:ECOUW82] [AC:L10328] [GN:o394] [FN:unknown] [OR:*Escherichia coli*]
[SR:*Escherichia coli* K12 strain MG1655; lambda clones EC14–52]
[DB:genpept-bct1] [DE:*E. coli*; the region from 81.5 to 84.5 minutes.]
[NT:similar to unidentified ORF near 47 minutes] [LE:26345] [RE:27529]
[DI:direct] >gp:[GI:g1790091] [LN:AE000443] [AC:AE000443:U00096]
[PN:two-module transport protein] [GN:yicK] [FN:putative transport; Not
classified] [OR:*Escherichia coli*] [DB:genpept-bct2] [DE:*Escherichia coli*
K-12 MG1655 section 333 of 400 of the complete genome.] [NT:o394; 100 pct
identical to YICK_ECOLI SW:] [LE:8286] [RE:9470] [DI:direct]

| ORF Name | NT ID | AA ID | NT LN | AA LN | Score | P-Value |
|---|---|---|---|---|---|---|
| AI7503001001_23572177_c3_1482 | 3433 | 7205 | 1194 | 397 | 1792 | 9.5e−185 |

Description
gp:[GI:e1393155:g4490614] [LN:SAU133520] [AC:AJ133520] [PN:phosphoglycerate
kinase] [GN:pgk] [OR:*Staphylococcus aureus*] [DB:genpept-bct1]
[DE:*Staphylococcus aureus* gap operon (gapR, gap, pgk and tpi genes).]
[LE:2995] [RE:4185] [DI:direct]

-continued

| ORF Name | NT ID | AA ID | NT LN | AA LN | Score | P-Value |
|---|---|---|---|---|---|---|
| AI7503001001__23600175_f2__616 | 3434 | 7206 | 123 | 40 | | |

Description
NO-HIT

| ORF Name | NT ID | AA ID | NT LN | AA LN | Score | P-Value |
|---|---|---|---|---|---|---|
| AI7503001001__23617338_f1__66 | 3435 | 7207 | 528 | 175 | 215 | 1.2e−24 |

Description
sp:[LN:YAGU_ECOLI] [AC:P77262] [GN:YAGU] [OR:ESCHERICHIA COLI]
[DE:HYPOTHETICAL 23.0 KD PROTEIN IN INTF-EAEH INTERGENIC REGION] [SP:P77262]
[DB:swissprot] >pir:[LN:G64754] [AC:G64754] [PN:probable membrane protein
yagU] [GN:yagU] [OR:Escherichia coli] [DB:pir2] >gp:[GI:g1657488]
[LN:ECU73857] [AC:U73857] [OR:Escherichia coli] [DB:genpept-bct1]
[DE:Escherichia coli chromosome minutes 6–8.] [NT:hypothetical protein]
[LE:10789] [RE:11403] [DI:direct] >gp:[GI:g1786481] [LN:AE000136]
[AC:AE000136:U00096] [PN:orf, hypothetical protein] [GN:yagU] [FN:orf;
Unknown] [OR:Escherichia coli] [DB:genpept-bct2] [DE:Escherichia coli K-12
MG1655 section 26 of 400 of the complete genome.] [NT:o204; 26 pct identical
to 46 residues of approx.] [LE:7372] [RE:7986] [DI:direct]

| ORF Name | NT ID | AA ID | NT LN | AA LN | Score | P-Value |
|---|---|---|---|---|---|---|
| AI7503001001__23621010_c1__971 | 3436 | 7208 | 843 | 280 | 167 | 1.5e−10 |

Description
pir:[LN:E69777] [AC:E69777] [PN:transcription regulator AraC/XylS family
homolog ydeC] [GN:ydeC] [OR:Bacillus subtilis] [DB:pir2]
>gp:[GI:d1020103:g1881323] [LN:AB001488] [AC:AB001488] [GN:ydeC]
[OR:Bacillus subtilis] [SR:Bacillus subtilis (strain:168) DNA]
[DB:genpept-bct1] [DE:Bacillus subtilis genome sequence, 148 kb sequence of
the region between 35 and 47 degree.] [NT:PROBABLE HTH_ARAC_FAMILY OF
TRANSCRIPTIONAL] [LE:94733] [RE:95608] [DI:complement]
>gp:[GI:e1182481:g2632815] [LN:BSUB0003] [AC:Z99106:AL009126] [GN:ydeC]
[FN:unknown] [OR:Bacillus subtilis] [DB:genpept-bct1] [DE:Bacillus subtilis
complete genome (section 3 of 21):from 402751 to 611850.] [NT:similar to
transcriptional regulator [AraC/XylS] [LE:158478] [RE:159353]
[DI:complement]

| ORF Name | NT ID | AA ID | NT LN | AA LN | Score | P-Value |
|---|---|---|---|---|---|---|
| AI7503001001__23626000_f2__582 | 3437 | 7209 | 168 | 55 | | |

Description
NO-HIT

| ORF Name | NT ID | AA ID | NT LN | AA LN | Score | P-Value |
|---|---|---|---|---|---|---|
| AI7503001001__23629040_c2__1318 | 3438 | 7210 | 132 | 43 | | |

Description
NO-HIT

| ORF Name | NT ID | AA ID | NT LN | AA LN | Score | P-Value |
|---|---|---|---|---|---|---|
| AI7503001001__23631928_f2__520 | 3439 | 7211 | 228 | 75 | | |

Description
NO-HIT

| ORF Name | NT ID | AA ID | NT LN | AA LN | Score | P-Value |
|---|---|---|---|---|---|---|
| AI7503001001__23634651_c1__964 | 3440 | 7212 | 1044 | 347 | 549 | 5.0e−53 |

Description
pir:[LN:H70000] [AC:H70000] [PN:two-component sensor histidine kinase
homolog ytsB] [GN:ytsB] [OR:Bacillus subtilis] [DB:pir2]
>gp:[GI:e1185912:g2635523] [LN:BSUB0016] [AC:Z99119:AL009126] [GN:ytsB]
[FN:unknown] [OR:Bacillus subtilis] [DB:genpept-bct1] [DE:Bacillus subtilis
complete genome (section 16 of 21):from 2997771 to 3213410.] [NT:similar to
two-component sensor histidine kinase] [LE:113501] [RE:114505]
[DI:complement] >gp:[GI:g2293176] [LN:AF008220] [AC:AF008220] [PN:signal
transduction protein kinase] [GN:ytsB] [OR:Bacillus subtilis]
[DB:genpept-bct2] [DE:Bacillus subtilis rrnB-dnaB genomic region.]
[LE:65922] [RE:66926] [DI:direct]

-continued

| ORF Name | NT ID | AA ID | NT LN | AA LN | Score | P-Value |
|---|---|---|---|---|---|---|
| AI7503001001__23672137__c2__1196 | 3441 | 7213 | 957 | 318 | 260 | 6.6e−32 |

Description
pir:[LN:S76964] [AC:S76964] [PN:hypothetical protein] [OR:*Synechocystis* sp.] [SR:PCC 6803, , PCC 6803] [SR:PCC 6803,] [DB:pir2]
>gp:[GI:d1019609:g1653966] [LN:D90917] [AC:D90917:AB001339] [PN:47 kD protein] [OR:*Synechocystis* sp.] [SR:*Synechocystis* sp. (strain:PCC6803) DNA] [DB:genpept-bct1] [DE:*Synechocystis* sp. PCC6803 complete genome, 27/27, 3418852–3573470.] [NT:ORF_ID:slr0609] [LE:151573] [RE:152724] [DI:direct]

| ORF Name | NT ID | AA ID | NT LN | AA LN | Score | P-Value |
|---|---|---|---|---|---|---|
| AI7503001001__23672562__c1__924 | 3442 | 7214 | 297 | 98 | 86 | 0.0034 |

Description
gp:[GI:e8900:g1335718] [LN:PFRESAR1] [AC:X05182] [PN:ring-infected eryrthrocyte surface antigen] [GN:RESA] [OR:*Plasmodium falciparum*] [SR:malaria parasite *P. falciparum*] [DB:genpept-inv1] [DE:*P. falciparum* FC27 Ag46 RESA mRNA for ring-infected eryrthrocyte surface antigen.] [SP:P13830] [LE:<1] [RE:>955] [DI:direct]

| ORF Name | NT ID | AA ID | NT LN | AA LN | Score | P-Value |
|---|---|---|---|---|---|---|
| AI7503001001__23703750__c1__1095 | 3443 | 7215 | 639 | 212 | | |

Description
NO-HIT

| ORF Name | NT ID | AA ID | NT LN | AA LN | Score | P-Value |
|---|---|---|---|---|---|---|
| AI7503001001__23728412__c3__1509 | 3444 | 7216 | 699 | 232 | 726 | 8.7e−72 |

Description
pir:[LN:C70020] [AC:C70020] [PN:conserved hypothetical protein yusB] [GN:yusB] [CL:probable transport protein yaeE] [OR:*Bacillus subtilis*] [DB:pir2] >gp:[GI:e1184352:g2635770] [LN:BSUB0017] [AC:Z99120:AL009126] [GN:yusB] [FN:unknown] [OR:*Bacillus subtilis*] [DB:genpept-bct1] [DE:*Bacillus subtilis* complete genome (section 17 of 21):from 3197001 to 3414420.] [NT:similar to hypothetical proteins] [LE:164664] [RE:165332] [DI:complement]

| ORF Name | NT ID | AA ID | NT LN | AA LN | Score | P-Value |
|---|---|---|---|---|---|---|
| AI7503001001__23844575__c2__1274 | 3445 | 7217 | 1062 | 353 | 1442 | 1.2e−147 |

Description
gp:[GI:e1393153:g4490612] [LN:SAU133520] [AC:AJ133520] [PN:gap regulator] [GN:gapR] [OR:*Staphylococcus aureus*] [DB:genpept-bct1] [DE:*Staphylococcus aureus* gap operon (gapR, gap, pgk and tpi genes).] [LE:779] [RE:1792] [DI:direct]

| ORF Name | NT ID | AA ID | NT LN | AA LN | Score | P-Value |
|---|---|---|---|---|---|---|
| AI7503001001__23984775__f1__83 | 3446 | 7218 | 153 | 50 | | |

Description
NO-HIT

| ORF Name | NT ID | AA ID | NT LN | AA LN | Score | P-Value |
|---|---|---|---|---|---|---|
| AI7503001001__23989061__f2__399 | 3447 | 7219 | 138 | 45 | | |

Description
NO-HIT

| ORF Name | NT ID | AA ID | NT LN | AA LN | Score | P-Value |
|---|---|---|---|---|---|---|
| AI7503001001__2401430__c3__1473 | 3448 | 7220 | 762 | 253 | 1076 | 7.1e−109 |

Description
gp:[GI:e1387399:g4379428] [LN:SAAJ3781] [AC:AJ223781] [PN:thioredoxin reductase] [GN:trxB] [OR:*Staphylococcus aureus*] [DB:genpept-bct1] [EC:1.6.4.5] [DE:*Staphylococcus aureus* trxB gene.] [LE:1262] [RE:2197] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503001001__24022582__f2__316 | 3449 | 7221 | 150 | 49 | | |

Description
NO-HIT

| ORF Name | NT ID | AA ID | NT LN | AA LN | Score | P-Value |
|---|---|---|---|---|---|---|
| AI7503001001__24033567__c2__1316 | 3450 | 7222 | 450 | 149 | 207 | 8.6e−17 |

Description
pir:[LN:G70023] [AC:G70023] [PN:hypothetical protein yutE] [GN:yutE]
[OR:*Bacillus subtilis*] [DB:pir2] >gp:[GI:e1184309:g2635727] [LN:BSUB0017]
EAC:Z99120:AL009126] [GN:yutE] [FN:unknown] [OR:*Bacillus subtilis*]
[DB:genpept-bct1] [DE:*Bacillus subtilis* complete genome (section 17 of 21):
from 3197001 to 3414420.] [LE:120886] [RE:121320] [DI:complement]

| ORF Name | NT ID | AA ID | NT LN | AA LN | Score | P-Value |
|---|---|---|---|---|---|---|
| AI7503001001__24218785__c2__1275 | 3451 | 7223 | 1047 | 348 | 1597 | 4.4e−164 |

Description
gp:[GI:e1393154:g4490613] [LN:SAU133520] [AC:AJ133520]
[PN:glyceraldehyde-3-phosphate dehydrogenase] [GN:gap] [FN:transferrin
binding protein] [OR:*Staphylococcus aureus*] [DB:genpept-bct1]
[DE:*Staphylococcus aureus* gap operon (gapR, gap, pgk and tpi genes).]
[NT:putative] [LE:1845] [RE:2855] [DI:direct]

| ORF Name | NT ID | AA ID | NT LN | AA LN | Score | P-Value |
|---|---|---|---|---|---|---|
| AI7503001001__24230001__f2__362 | 3452 | 7224 | 258 | 85 | | |

Description
NO-HIT

| ORF Name | NT ID | AA ID | NT LN | AA LN | Score | P-Value |
|---|---|---|---|---|---|---|
| AI7503001001__24240888__f1__281 | 3453 | 7225 | 129 | 42 | | |

Description
NO-HIT

| ORF Name | NT ID | AA ID | NT LN | AA LN | Score | P-Value |
|---|---|---|---|---|---|---|
| AI7503001001__24242285__c3__1516 | 3454 | 7226 | 1056 | 351 | 439 | 2.2e−41 |

Description
gp:[GI:g4981378] [LN:AE001751] [AC:AE001751:AE000512] [PN:hemolysin-related
protein] [GN:TM0845] [OR:*Thermotoga maritima*] [DB:genpept-bct2]
[DE:*Thermotoga maritima* section 63 of 136 of the complete genome.]
[NT:similar to GB:AE000783 percent identity:61.61;] [LE:5310] [RE:6677]
[DI:direct]

| ORF Name | NT ID | AA ID | NT LN | AA LN | Score | P-Value |
|---|---|---|---|---|---|---|
| AI7503001001__24251500__f2__416 | 3455 | 7227 | 135 | 44 | | |

Description
NO-HIT

| ORF Name | NT ID | AA ID | NT LN | AA LN | Score | P-Value |
|---|---|---|---|---|---|---|
| AI7503001001__24253153__f1__150 | 3456 | 7228 | 129 | 42 | | |

Description
NO-HIT

| ORF Name | NT ID | AA ID | NT LN | AA LN | Score | P-Value |
|---|---|---|---|---|---|---|
| AI7503001001__24256287__c2__1260 | 3457 | 7229 | 141 | 46 | | |

Description
NO-HIT

| ORF Name | NT ID | AA ID | NT LN | AA LN | Score | P-Value |
|---|---|---|---|---|---|---|
| AI7503001001__24258388__c3__1405 | 3458 | 7230 | 507 | 168 | 102 | 0.0053 |

Description
gp:[GI:e1407794:g4493938] [LN:PFMAL3P5] [AC:AL034556] [GN:MAL3P5.10]

-continued

[OR:*Plasmodium falciparum*] [SR:malaria parasite *P. falciparum*]
[DB:genpept-inv1] [DE:*Plasmodium falciparum* MAL3P5, complete sequence.]
[NT:predicted using hexExon; MAL3P5.10 (PFC0620w),] [LE:46925] [RE:48919]
[DI:direct]

| ORF Name | NT ID | AA ID | NT LN | AA LN | Score | P-Value |
|---|---|---|---|---|---|---|
| AI7503001001__24259762__f3__679 | 3459 | 7231 | 132 | 43 | | |

Description
NO-HIT

| ORF Name | NT ID | AA ID | NT LN | AA LN | Score | P-Value |
|---|---|---|---|---|---|---|
| AI7503001001__24266888__c3__1413 | 3460 | 7232 | 123 | 40 | | |

Description
NO-HIT

| ORF Name | NT ID | AA ID | NT LN | AA LN | Score | P-Value |
|---|---|---|---|---|---|---|
| AI7503001001__24272125__c2__1292 | 3461 | 7233 | 261 | 86 | 72 | 0.024 |

Description
gp:[GI:g942589] [LN:MIU29676] [AC:U29676:X55271] [PN:unknown] [OR:*Mycoplasma iowae*] [DB:genpept-bct2] [DE:*Mycoplasma iowae* 16S rRNA gene, complete sequence, and 23S rRNA gene, partial sequence.] [LE:<1] [RE:438] [DI:direct]

| ORF Name | NT ID | AA ID | NT LN | AA LN | Score | P-Value |
|---|---|---|---|---|---|---|
| AI7503001001__24297000__f2__548 | 3462 | 7234 | 225 | 74 | | |

Description
NO-HIT

| ORF Name | NT ID | AA ID | NT LN | AA LN | Score | P-Value |
|---|---|---|---|---|---|---|
| AI7503001001__24329053__c1__979 | 3463 | 7235 | 444 | 147 | 142 | 2.8e−09 |

Description
gp:[GI:g3329623] [LN:CELF36H12] [AC:AF078790] [GN:F36H12.3]
[OR:*Caenorhabditis elegans*] [DB:genpept-inv2] [DE:*Caenorhabditis elegans* cosmid F36H12.] [NT:coded for by *C. elegans* cDNA CEMSF30F]
[LE:21606:21872:22500:22677] [RE:21701:22454:22629:22875] [DI:directJoin]

| ORF Name | NT ID | AA ID | NT LN | AA LN | Score | P-Value |
|---|---|---|---|---|---|---|
| AI7503001001__24335801__c2__1326 | 3464 | 7236 | 138 | 45 | | |

Description
NO-HIT

| ORF Name | NT ID | AA ID | NT LN | AA LN | Score | P-Value |
|---|---|---|---|---|---|---|
| AI7503001001__24345257__f3__652 | 3465 | 7237 | 168 | 55 | | |

Description
NO-HIT

| ORF Name | NT ID | AA ID | NT LN | AA LN | Score | P-Value |
|---|---|---|---|---|---|---|
| AI7503001001__24347175__c3__1416 | 3466 | 7238 | 165 | 54 | | |

Description
NO-HIT

| ORF Name | NT ID | AA ID | NT LN | AA LN | Score | P-Value |
|---|---|---|---|---|---|---|
| AI7503001001__24391937__c1__1068 | 3467 | 7239 | 759 | 252 | 105 | 0.0062 |

Description
pir:[LN:E70031] [AC:E70031] [PN:hypothetical protein yvcD] [GN:yvcD]
[CL:tetratricopeptide repeat homology] [OR:*Bacillus subtilis*] [DB:pir2]
>gp:[GI:e1186169:g2635994] [LN:BSUB0018] [AC:Z99121:AL009126] [GN:yvcD]
[FN:unknown] [OR:*Bacillus subtilis*] [DB:genpept-bct1] [DE:*Bacillus subtilis* complete genome (section 18 of 21):from 3399551 to 3609060.] [LE:175675]
[RE:177129] [DI:complement] >gp:[GI:e313021:g1945645] [LN:BSZ94043]
[AC:Z94043] [PN:hypothetical protein] [GN:yvcD] [OR:*Bacillus subtilis*]
[DB:genpept-bct1] [DE:*B. subtilis* genomic DNA fragment (88 kb).] [LE:4542]

-continued

[RE:5996] [DI:direct]

| ORF Name | NT ID | AA ID | NT LN | AA LN | Score | P-Value |
|---|---|---|---|---|---|---|
| AI7503001001_24397952_c1_1067 | 3468 | 7240 | 681 | 226 | 119 | 0.00011 |

Description
pir:[LN:E70031] [AC:E70031] [PN:hypothetical protein yvcD] [GN:yvcD]
[CL:tetratricopeptide repeat homology] [OR:*Bacillus subtilis*] [DB:pir2]
>gp:[GI:e1186169:g2635994] [LN:BSUB0018] [AC:Z99121:AL009126] [GN:yvcD]
[FN:unknown] [OR:*Bacillus subtilis*] [DB:genpept-bct1] [DE:*Bacillus subtilis*
complete genome (section 18 of 21):from 3399551 to 3609060.] [LE:175675]
[RE:177129] [DI:complement] >gp:[GI:e313021:g1945645] [LN:BSZ94043]
[AC:Z94043] [PN:hypothetical protein] [GN:yvcD] [OR:*Bacillus subtilis*]
[DB:genpept-bct1] [DE:*B. subtilis* genomic DNA fragment (88 kb).] [LE:4542]
[RE:5996] [DI:direct]

| ORF Name | NT ID | AA ID | NT LN | AA LN | Score | P-Value |
|---|---|---|---|---|---|---|
| AI7503001001_24406577_c3_1415 | 3469 | 7241 | 390 | 129 | | |

Description
NO-HIT

| ORF Name | NT ID | AA ID | NT LN | AA LN | Score | P-Value |
|---|---|---|---|---|---|---|
| AI7503001001_24407637_f1_57 | 3470 | 7242 | 243 | 80 | | |

Description
NO-HIT

| ORF Name | NT ID | AA ID | NT LN | AA LN | Score | P-Value |
|---|---|---|---|---|---|---|
| AI7503001001_24415930_f2_310 | 3471 | 7243 | 1068 | 355 | 977 | 2.2e−98 |

Description
pir:[LN:D70024] [AC:D70024] [PN:NADH dehydrogenase homolog yutJ] [GN:yutJ]
[OR:*Bacillus subtilis*] [DB:pir2] >gp:[GI:e1184299:g2635717] [LN:BSUB0017]
[AC:Z99120:AL009126] [GN:yutJ] [FN:unknown] [OR:*Bacillus subtilis*]
[DB:genpept-bct1] [DE:*Bacillus subtilis* complete genome (section 17 of 21):
from 3197001 to 3414420.] [NT:similar to NADH dehydrogenase] [LE:110924]
[RE:111916] [DI:direct]

| ORF Name | NT ID | AA ID | NT LN | AA LN | Score | P-Value |
|---|---|---|---|---|---|---|
| AI7503001001_24429650_c3_1408 | 3472 | 7244 | 1197 | 398 | 848 | 1.0e−84 |

Description
sp:[LN:NAGA_BACSU] [AC:O34450] [GN:NAGA] [OR:*BACILLUS SUBTILIS*]
[EC:3.5.1.25] [DE:DEACETYLASE)] [SP:O34450] [DB:swissprot] >pir:[LN:A69664]
[AC:A69664] [PN:N-acetylglucosamine-6-phosphate deacetylase nagA] [GN:nagA]
[OR:*Bacillus subtilis*] [DB:pir2] >gp:[GI:e1186189:g2636014] [LN:BSUB0018]
[AC:Z99121:AL009126] [PN:N-acetylglucosamine-G-phosphate deacetylase]
[GN:nagA] [FN:N-acetyl glucosamine utilization] [OR:*Bacillus subtilis*]
[DB:genpept-bct1] [EC:3.5.1.25] [DE:*Bacillus subtilis* complete genome
(section 18 of 21):from 3399551 to 3609060.] [SP:O34450] [LE:194866]
[RE:196056] [DI:direct] >gp:[GI:g2618856] [LN:AF017113] [AC:AF017113]
[PN:N-acetylglucosamine 6-P deacetylase] [GN:nagA] [OR:*Bacillus subtilis*]
[DB:genpept-bct2] [DE:*Bacillus subtilis* 300–304 degree genomic sequence.]
[LE:31777] [RE:32967] [DI:complement]

| ORF Name | NT ID | AA ID | NT LN | AA LN | Score | P-Value |
|---|---|---|---|---|---|---|
| AI7503001001_24479842_c1_1106 | 3473 | 7245 | 558 | 185 | 256 | 5.5e−22 |

Description
pir:[LN:D69800] [AC:D69800] [PN:conserved hypothetical protein yfhC]
[GN:yfhC] [OR:*Bacillus subtilis*] [DB:pir2] >gp:[GI:e1182838:g2633172]
[LN:BSUB0005] [AC:Z99108:AL009126] [GN:yfhC] [FN:unknown] [OR:*Bacillus
subtilis*] [DB:genpept-bct1] [DE:*Bacillus subtilis* complete genome (section 5
of 21):from 802821 to 1011250.] [NT:similar to hypothetical proteins]
[LE:120274] [RE:120858] [DI:direct] >gp:[GI:d1025385:g2804533] [LN:D85082]
[AC:D85082] [PN:YfhC] [OR:*Bacillus subtilis*] [SR:*Bacillus subtilis* DNA]
[DB:genpept-bct1] [DE:*Bacillus subtilis* DNA, genome sequence, 79 to 81
degree region.] [LE:13165] [RE:13749] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503001001__24490676__c2__1179 | 3474 | 7246 | 141 | 46 | | |

Description
NO-HIT

| ORF Name | NT ID | AA ID | NT LN | AA LN | Score | P-Value |
|---|---|---|---|---|---|---|
| AI7503001001__24506712__c2__1240 | 3475 | 7247 | 975 | 324 | 879 | 5.3e−88 |

Description
gp:[GI:e1330453:g3724156] [LN:SAA005352] [AC:AJ005352] [PN:membrane protein]
[GN:sstB] [FN:iron transport] [OR:*Staphylococcus aureus*] [DB:genpept-bct1]
[DE:*Staphylococcus aureus*, Sst putative iron transport operon.] [LE:1451]
[RE:2132] [DI:direct]

| ORF Name | NT ID | AA ID | NT LN | AA LN | Score | P-Value |
|---|---|---|---|---|---|---|
| AI7503001001__24507932__c1__1027 | 3476 | 7248 | 600 | 199 | 322 | 5.6e−29 |

Description
pir:[LN:D699241] [AC:D69924] [PN:hypothetical protein yorS] [GN:yorS]
[OR:*Bacillus subtilis*] [DB:pir2] >gp:[GI:e1185499:g2634420] [LN:BSUB0011]
[AC:Z99114:AL009126] [GN:yorS] [FN:unknown] [OR:*Bacillus subtilis*]
[DB:genpept-bct1] [DE:*Bacillus subtilis* complete genome (section 11 of 21):
from 2000171 to 2207900.] [LE:172005] [RE:172523] [DI:complement]
>gp:[GI:g3025618] [LN:AF020713] [AC:AF020713] [PN:unknown] [GN:yorS]
[OR:Bacteriophage SPBc2] [DB:genpept-phg] [DE:Bacteriophage SPBc2 complete
genome.] [LE:112997] [RE:113515] [DI:direct]

| ORF Name | NT ID | AA ID | NT LN | AA LN | Score | P-Value |
|---|---|---|---|---|---|---|
| AI7503001001__24611512__c2__1139 | 3477 | 7249 | 129 | 42 | | |

Description
NO-HIT

| ORF Name | NT ID | AA ID | NT LN | AA LN | Score | P-Value |
|---|---|---|---|---|---|---|
| AI7503001001__24616050__f2__445 | 3478 | 7250 | 150 | 49 | | |

Description
NO-HIT

| ORF Name | NT ID | AA ID | NT LN | AA LN | Score | P-Value |
|---|---|---|---|---|---|---|
| AI7503001001__24640828__c2__1138 | 3479 | 7251 | 516 | 171 | | |

Description
NO-HIT

| ORF Name | NT ID | AA ID | NT LN | AA LN | Score | P-Value |
|---|---|---|---|---|---|---|
| AI7503001001__24642632__f3__765 | 3480 | 7252 | 1245 | 414 | 1245 | 8.7e−127 |

Description
sp:[LN:PEPT_BACSU] [AC:P55179] [GN:PEPT] [OR:*BACILLUS SUBTILIS*]
[EC:3.4.11.—] [DE:PEPTIDASE T, (AMINOTRIPEPTIDASE) (TRIPEPTIDASE)]
[SP:P55179] [DB:swissprot] >pir:[LN:H69674] [AC:H69674]
[PN:aminotripeptidase,:peptidase T] [GN:pepT] [OR:*Bacillus subtilis*]
[EC:3.4.11.—] [DB:pir2] >gp:[GI:e254163:g1429259] [LN:BSGALE] [AC:X99339]
[GN:pepT] [FN:unknown] [OR:*Bacillus subtilis*] [DB:genpept-bct1]
[DE:*B. subtilis* orfs 1,2,3,4, pepT and galE genes.] [SP:P55179] [LE:5267]
[RE:6499] [DI:direct] >gp:[GI:e1186391:g2636427] [LN:BSUB0020]
[AC:Z99123:AL009126] [PN:peptidase T (tripeptidase)] [GN:pepT] [OR:*Bacillus
subtilis*] [DB:genpept-bct1] [EC:3.4.11.—] [DE:*Bacillus subtilis* complete
genome (section 20 of 21):from 3798401 to 4010550.] [SP:P55179] [LE:195467]
[RE:196699] [DI:direct] >gp:[GI:d1012379:g1783235] [LN:D83026]
[AC:D83026:D45911] [GN:pepT] [OR:*Bacillus subtilis*] [SR:*Bacillus subtilis*
(strain:BGSC 1A1) DNA] [DB:genpept-bct1] [DE:*Bacillus subtilis* genome
sequence covering lic-cel region.] [NT:highly homologous to tripeptidases
(peptidase T)] [LE:27766] [RE:28998] [DI:complement]

| ORF Name | NT ID | AA ID | NT LN | AA LN | Score | P-Value |
|---|---|---|---|---|---|---|
| AI7503001001__24650427__f2__349 | 3481 | 7253 | 330 | 109 | 331 | 6.2e−30 |

Description
pir:[LN:C69772] [AC:C69772] [PN:thioredoxin homolog ydbP] [GN:ydbP]
[CL:thioredoxin:thioredoxin homology] [OR:*Bacillus subtilis*] [DB:pir2]

-continued

>gp:[GI:d1020045:g1881265] [LN:AB001488] [AC:AB001488] [GN:ydbP]
[OR:*Bacillus subtilis*] [SR:*Bacillus subtilis* (strain:168) DNA]
[DB:genpept-bct1] [DE:*Bacillus subtilis* genome sequence, 148 kb sequence of
the region between 35 and 47 degree.] [NT:PROBABLE THIOREDOXIN.] [LE:40816]
[RE:41136] [DI:complement] >gp:[GI:e1182421:g2632755] [LN:BSUB0003]
[AC:Z99106:AL009126] [GN:ydbP] [FN:unknown] [OR:*Bacillus subtilis*]
[DB:genpept-bct1] [DE:*Bacillus subtilis* complete genome (section 3 of 21):
from 402751 to 611850.] [NT:similar to thioredoxin] [LE:104560] [RE:104880]
[DI:complement]

| ORF Name | NT ID | AA ID | NT LN | AA LN | Score | P-Value |
|---|---|---|---|---|---|---|
| AI7503001001__24650462__c1__944 | 3482 | 7254 | 1515 | 504 | 848 | 1.0e−84 |

Description
pir:[LN:G70008] [AC:G70008] [PN:NADH dehydrogenase (ubiquinone) homolog
yufD] [GN:yufD] [OR:*Bacillus subtilis*] [DB:pir2] >gp:[GI:e1184241:g2635659]
[LN:BSUB0017] [AC:Z99120:AL009126] [GN:yufD] [FN:unknown] [OR:*Bacillus
subtilis*] [DB:genpept-bct1] [DE:*Bacillus subtilis* complete genome (section
17 of 21):from 3197001 to 3414420.] [NT:similar to NADH dehydrogenase
(ubiquinone)] [LE:51840] [RE:53282] [DI:direct]

| ORF Name | NT ID | AA ID | NT LN | AA LN | Score | P-Value |
|---|---|---|---|---|---|---|
| AI7503001001__24664840__c2__1203 | 3483 | 7255 | 1968 | 655 | 1694 | 2.3e−174 |

Description
pir:[LN:H69626] [AC:H69626] [PN:PTS fructose-specific enzyme IIBC component
fruA] [GN:fruA] [CL:phosphotransferase system enzyme II,
fructose-specific:phosphotransferase system mannitol-specific enzyme II
factor III homology] [OR:*Bacillus subtilis*] [DB:pir2]
>gp:[GI:e1185030:g2633811] [LN:BSUB0008] [AC:Z99111:AL009126]
[PN:phosphotransferase system (PTS)] [GN:fruA] [OR:*Bacillus subtilis*]
[DB:genpept-bct1] [DE:*Bacillus subtilis* complete genome (section 8 of 21):
from 1394791 to 1603020.] [LE:113871] [RE:115778] [DI:direct]
>gp:[GI:g3282125] [LN:AF012285] [AC:AF012285:AF012284:U51911] [PN:fructose
PTS IIABC] [GN:fruA] [OR:*Bacillus subtilis*] [DB:genpept-bct2] [DE:*Bacillus
subtilis* mobA-nprE gene region.] [NT:similar to fructose-specific PTS system
IIBC] [LE:14359] [RE:16266] [DI:direct]

| ORF Name | NT ID | AA ID | NT LN | AA LN | Score | P-Value |
|---|---|---|---|---|---|---|
| AI7503001001__24796927__f1__61 | 3484 | 7256 | 789 | 262 | 325 | 2.7e−29 |

Description
pir:[LN:E69883] [AC:E69883] [PN:phage-related replication protein homolog
ymaC] [GN:ymaC] [CL:phage-related replication protein] [OR:*Bacillus
subtilis*] [DB:pir2] >gp:[GI:e1183386:g2634111] [LN:BSUB0010]
[AC:Z99113:AL009126] [GN:ymaC] [FN:unknown] [OR:*Bacillus subtilis*]
[DB:genpept-bct1] [DE:*Bacillus subtilis* complete genome (section 10 of 21):
from 1781201 to 2014980.] [NT:similar to phage-related protein] [LE:81490]
[RE:82197] [DI:direct]

| ORF Name | NT ID | AA ID | NT LN | AA LN | Score | P-Value |
|---|---|---|---|---|---|---|
| AI7503001001__24803125__c1__993 | 3485 | 7257 | 978 | 325 | 982 | 6.5e−99 |

Description
sp:[LN:MDH_BACIS] [AC:Q59202] [GN:MDH] [OR:*BACILLUS ISRAELI*] [EC:1.1.1.37]
[DE:MALATE DEHYDROGENASE,] [SP:Q59202] [DB:swissprot] >pir:[LN:S61213]
[AC:S61213] [PN:malate dehydrogenase,] [CL:L-lactate dehydrogenase]
[OR:*Bacillus israeli*] [EC:1.1.1.37] [DB:pir2] >gp:[GI:g963019] [LN:BIDNAMD]
[AC:X90527] [PN:malate dehydrogenase] [OR:*Bacillus israeli*]
[DB:genpept-bct1] [EC:1.1.1.37] [DE:*B. israeli* DNA for malate dehydrogenase
gene.] [SP:Q59202] [LE:291] [RE:1229] [DI:direct]

| ORF Name | NT ID | AA ID | NT LN | AA LN | Score | P-Value |
|---|---|---|---|---|---|---|
| AI7503001001__24803332__c2__1305 | 3486 | 7258 | 840 | 279 | 712 | 2.6e−70 |

Description
pir:[LN:B70020] [AC:B70020] [PN:conserved hypothetical protein yusA]
[GN:yusA] [CL:lipoprotein-28] [OR:*Bacillus subtilis*] [DB:pir2]
>gp:[GI:e1184351:g2635769] [LN:BSUB0017] [AC:Z99120:AL009126] [GN:yusA]
[FN:unknown] [OR:*Bacillus subtilis*] [DB:genpept-bct1] [DE:*Bacillus subtilis*
complete genome (section 17 of 21):from 3197001 to 3414420.] [NT:similar to
hypothetical proteins] [LE:163826] [RE:164650] [DI:complement]

-continued

| ORF Name | NT ID | AA ID | NT LN | AA LN | Score | P-Value |
|---|---|---|---|---|---|---|
| AI7503001001__2531500__c3__1360 | 3487 | 7259 | 177 | 58 | | |

Description
NO-HIT

| ORF Name | NT ID | AA ID | NT LN | AA LN | Score | P-Value |
|---|---|---|---|---|---|---|
| AI7503001001__25401377__c1__1045 | 3488 | 7260 | 852 | 283 | 939 | 2.3e−94 |

Description
gp:[GI:e1330454:g3724157] [LN:SAA005352] [AC:AJ005352] [PN:ATP binding protein] [GN:SstC] [FN:iron transport] [OR:*Staphylococcus aureus*] [DB:genpept-bct1] [DE:*Staphylococcus aureus*, Sst putative iron transport operon.] [LE:2186] [RE:2947] [DI:direct]

| ORF Name | NT ID | AA ID | NT LN | AA LN | Score | P-Value |
|---|---|---|---|---|---|---|
| AI7503001001__25401675__c2__1319 | 3489 | 7261 | 174 | 57 | | |

Description
NO-HIT

| ORF Name | NT ID | AA ID | NT LN | AA LN | Score | P-Value |
|---|---|---|---|---|---|---|
| AI7503001001__25415802__c1__1102 | 3490 | 7262 | 126 | 41 | | |

Description
NO-HIT

| ORF Name | NT ID | AA ID | NT LN | AA LN | Score | P-Value |
|---|---|---|---|---|---|---|
| AI7503001001__25473782__c3__1498 | 3491 | 7263 | 186 | 61 | | |

Description
NO-HIT

| ORF Name | NT ID | AA ID | NT LN | AA LN | Score | P-Value |
|---|---|---|---|---|---|---|
| AI7503001001__25492312__f1__302 | 3492 | 7264 | 126 | 41 | | |

Description
NO-HIT

| ORF Name | NT ID | AA ID | NT LN | AA LN | Score | P-Value |
|---|---|---|---|---|---|---|
| AI7503001001__25572180__c1__956 | 3493 | 7265 | 1272 | 423 | 895 | 1.1e−89 |

Description
sp:[LN:YXJA_BACSU] [AC:P42312] [GN:YXJA:N15HR] [OR:*BACILLUS SUBTILIS*] [DE:HYPOTHETICAL 43.7 KD PROTEIN IN KATB 3'REGION] [SP:P42312] [DB:swissprot] >pir:[LN:G70078] [AC:G70078] [PN:pyrimidine nucleoside transport homolog yxjA] [GN:yxjA] [CL:pyrimidine nucleoside transport protein nupC] [OR:*Bacillus subtilis*] [DB:pir2] >gp:[GI:e1186401:g2636437] [LN:BSUB0020] [AC:Z99123:AL009126] [GN:yxjA] [FN:unknown] [OR:*Bacillus subtilis*] [DB:genpept-bct1] [DE:*Bacillus subtilis* complete genome (section 20 of 21):from 3798401 to 4010550.] [NT:similar to pyrimidine nucleoside transport] [SP:P42312] [LE:206141] [RE:207334] [DI:direct] >gp:[GI:e1184627:g2636448] [LN:BSUB0021] [AC:Z99124:AL009126] [GN:yxjA] [FN:unknown] [OR:*Bacillus subtilis*] [DB:genpept-bct1] [DE:*Bacillus subtilis* complete genome (section 21 of 21):from 3999281 to 4214814.] [NT:similar to pyrimidine nucleoside transport] [SP:P42312] [LE:5261] [RE:6454] [DI:direct] >gp:[GI:d1012369:g665999] [LN:D83026] [AC:D83026:D45911] [GN:yxjA] [OR:*Bacillus subtilis*] [SR:*Bacillus subtilis* (strain:BGSC 1A1) DNA] [DB:genpept-bct1] [DE:*Bacillus subtilis* genome sequence covering lic-cel region.] [NT:homologous to pyrimidine nucleoside transport] [LE:17131] [RE:18324] [DI:complement]

| ORF Name | NT ID | AA ID | NT LN | AA LN | Score | P-Value |
|---|---|---|---|---|---|---|
| AI7503001001__25585891__c2__1218 | 3494 | 7266 | 1980 | 659 | 1949 | 2.2e−201 |

Description
pir:[LN:D69815] [AC:D69815] [PN:conserved hypothetical protein yfnI] [GN:yfnI] [CL:*Bacillus subtilis* probable anion-binding protein yflE] [OR:*Bacillus subtilis*] [DB:pir2] >gp:[GI:e1182705:g2633039] [LN:BSUB0004] [AC:Z99107:AL009126] [GN:yfnI] [FN:unknown] [OR:*Bacillus subtilis*] [DB:genpept-bct1] [DE:*Bacillus subtilis* complete genome (section 4 of 21): from 600701 to 813890.] [NT:alternate gene name:yetP; similar to -continued hypothetical] [LE:195080] [RE:197041] [DI:direct] >gp:[GI:d1020933:g2116767]
[LN:D86418] [AC:D86418] [PN:YfnI] [OR:*Bacillus subtilis*] [SR:*Bacillus subtilis* (strain:AC327) DNA] [DB:genpept-bct1] [DE:*Bacillus subtilis* genomic DNA 69–70 degree region, partial sequence.] [LE:16150] [RE:18111] [DI:complement]

| ORF Name | NT ID | AA ID | NT LN | AA LN | Score | P-Value |
|---|---|---|---|---|---|---|
| AI7503001001__25806300_f1__275 | 3495 | 7267 | 750 | 249 | 1270 | 2.0e–129 |

Description
gp:[GI:e255626:g1617428] [LN:SEABCTS] [AC:X99127] [PN:ATP binding protein] [FN:iron repressible ABC transport system] [OR:*Staphylococcus epidermidis*] [DB:genpept-bct1] [DE:*S. epidermidis* gene encoding ABC transport system.] [LE:41] [RE:787] [DI:direct]

| ORF Name | NT ID | AA ID | NT LN | AA LN | Score | P-Value |
|---|---|---|---|---|---|---|
| AI7503001001__26171927_c2__1246 | 3496 | 7268 | 342 | 113 | 221 | 2.8e–18 |

Description
sp:[LN:YTXJ_BACSU] [AC:P39914] [GN:YTXJ] [OR:*BACILLUS SUBTILIS*] [DE:(ORF3)] [SP:P39914] [DB:swissprot] >pir:[LN:S21420] [AC:S21420:F70003:S71003] [PN:general stress protein homolog ytxJ] [GN:ytxJ] [OR:*Bacillus subtilis*] [DB:pir2] >gp:[GI:g39815] [LN:BSAROAG] [AC:X65945] [GN:orf 2] [OR:*Bacillus subtilis*] [DB:genpept-bct1] [DE:*B. subtilis* aroA-aroG gene.] [SP:P39914] [LE:105] [RE:431] [DI:direct] >gp:[GI:e1185849:g2635460] [LN:BSUB0016] [AC:Z99119:AL009126] [GN:ytxJ] [FN:unknown] [OR:*Bacillus subtilis*] [DB:genpept-bct1] [DE:*Bacillus subtilis* complete genome (section 16 of 21): from 2997771 to 3213410.] [NT:alternate gene name:csb40; similar to general] [SP:P39914] [LE:48061] [RE:48387] [DI:complement] >gp:[GI:g2293219] [LN:AF008220] [AC:AF008220] [PN:YtxJ] [GN:ytxJ] [OR:*Bacillus subtilis*] [DB:genpept-bct2] [DE:*Bacillus subtilis* rrnB-dnaB genomic region.] [LE:132039] [RE:132365] [DI:direct]

| ORF Name | NT ID | AA ID | NT LN | AA LN | Score | P-Value |
|---|---|---|---|---|---|---|
| AI7503001001__26176693_f2__482 | 3497 | 7269 | 828 | 275 | 685 | 1.9e–67 |

Description
pir:[LN:A69162] [AC:A69162] [PN:gufA protein homolog MTH473] [GN:MTH473] [CL:gufA protein] [OR:*Methanobacterium thermoautotrophicum*] [DB:pir2] >gp:[GI:g2621542] [LN:AE000831] [AC:AE000831:AE000666] [PN:conserved protein] [GN:MTH473] [OR:*Methanobacterium thermoautotrophicum*] [DB:genpept-bct1] [DE:*Methanobacterium thermoautotrophicum* from bases 404817 to 415582 (section 37 of 148) of the complete genome.] [NT:Function Code:14.01 - Unknown, Conserved protein;] [LE:9769] [RE:10548] [DI:direct]

| ORF Name | NT ID | AA ID | NT LN | AA LN | Score | P-Value |
|---|---|---|---|---|---|---|
| AI7503001001__2618827_c1__1042 | 3498 | 7270 | 288 | 95 | 75 | 0.023 |

Description
sp:[LN:LUXY_VIBFI] [AC:P21578] [GN:LUXY] [OR:*VIBRIO FISCHERI*] [DE:YELLOW FLUORESCENT PROTEIN (YFP)] [SP:P21578] [DB:swissprot] >pir:[LN:A36037] [AC:A36037:A39946] [PN:yellow fluorescent protein:luxY protein] [GN:luxY] [CL:riboflavin synthase alpha chain] [OR:*Vibrio fischeri*] [DB:pir2] >gp:[GI:g155235] [LN:VIBLUXY] [AC:M60852] [PN:yellow fluorescent protein] [GN:luxY] [OR:*Vibrio fischeri*] [SR:*V. fischeri* (strain Y-1) DNA] [DB:genpept-bct1] [DE:*Vibrio fischeri* yellow fluorescent protein (luxY) gene, completecds.] [LE:45] [RE:629] [DI:direct]

| ORF Name | NT ID | AA ID | NT LN | AA LN | Score | P-Value |
|---|---|---|---|---|---|---|
| AI7503001001__26190785_c2__1306 | 3499 | 7271 | 1287 | 428 | 1408 | 4.7e–144 |

Description
pir:[LN:F70019] [AC:F70019] [PN:NifS protein homolog homolog yurW] [GN:yurW] [CL:nifS protein] [OR:*Bacillus subtilis*] [DB:pir2] >gp:[GI:e1184347:g2635765] [LN:BSUB0017] [AC:Z99120:AL009126] [GN:yurW] [FN:unknown] [OR:*Bacillus subtilis*] [DB:genpept-bct1] [DE:*Bacillus subtilis* complete genome (section 17 of 21):from 3197001 to 3414420.] [NT:similar to NifS protein homolog] [LE:159503] [RE:160723] [DI:complement]

| ORF Name | NT ID | AA ID | NT LN | AA LN | Score | P-Value |
|---|---|---|---|---|---|---|
| AI7503001001__26204837_f1__69 | 3500 | 7272 | 159 | 52 | | |

-continued

| ORF Name | NT ID | AA ID | NT LN | AA LN | Score | P-Value |
|---|---|---|---|---|---|---|
| | | | | | | |

Description
NO-HIT

| ORF Name | NT ID | AA ID | NT LN | AA LN | Score | P-Value |
|---|---|---|---|---|---|---|
| AI7503001001_26211552_c2_1270 | 3501 | 7273 | 984 | 327 | 1034 | 2.0e−104 |

Description
pir:[LN:B70032] [AC:B70032] [PN:conserved hypothetical protein yvcL]
[GN:yvcL] [OR:*Bacillus subtilis*] [DB:pir2] >gp:[GI:e1186163:g2635988]
[LN:BSUB0018] [AC:Z99121:AL009126] [GN:yvcL] [FN:unknown] [OR:*Bacillus
subtilis*] [DB:genpept-bct1] [DE:*Bacillus subtilis* complete genome (section
18 of 21):from 3399551 to 3609060.] [NT:similar to hypothetical proteins]
[LE:169083] [RE:170033] [DI:complement] >gp:[GI:e313028:g1945652]
[LN:BSZ94043] [AC:Z94043] [PN:hypothetical protein] EGN:yvcL] [OR:*Bacillus
subtilis*] [DB:genpept-bct1] [DE:*B. subtilis* genomic DNA fragment (88 kb).]
[NT:similar to Y103_MYCGE hypothetical protein mg103] [LE:11638] [RE:12588]
[DI:direct]

| ORF Name | NT ID | AA ID | NT LN | AA LN | Score | P-Value |
|---|---|---|---|---|---|---|
| AI7503001001_26259638_f1_134 | 3502 | 7274 | 765 | 254 | 176 | 2.2e−11 |

Description
pir:[LN:B70798] [AC:B70798 ] [PN:probable membrane protein] [GN:Rv3737]
[OR:*Mycobacterium tuberculosis*] [DB:pir2] >gp:[GI:e1264597:g2960161]
[LN:MTV025] [AC:AL022121:AL123456] [PN:hypothetical protein Rv3737]
[GN:Rv3737] [OR:*Mycobacterium tuberculosis*] [DB:genpept-bct1]
[DE:*Mycobacterium tuberculosis* H37Rv complete genome; segment 155/162.]
[NT:Rv3737, (MTV025.085), len:529. Probable membrane] [LE:94796] [RE:96385]
[DI:direct] >gp:[GI:e1264597:g2960161] [LN:MTV025] [AC:AL022121:AL123456]
[PN:hypothetical protein Rv3737] [GN:Rv3737] [OR:*Mycobacterium tuberculosis*]
[DB:genpept] [DE:*Mycobacterium tuberculosis* H37Rv complete genome; segment
155/162.] [NT:Rv3737, (MTV025.085), len:529. Probable membrane] [LE:94796]
[RE:96385] [DI:direct]

| ORF Name | NT ID | AA ID | NT LN | AA LN | Score | P-Value |
|---|---|---|---|---|---|---|
| AI7503001001_26359805_f1_11 | 3503 | 7275 | 168 | 55 | | |

Description
NO-HIT

| ORF Name | NT ID | AA ID | NT LN | AA LN | Score | P-Value |
|---|---|---|---|---|---|---|
| AI7503001001_26360663_c3_1530 | 3504 | 7276 | 1308 | 435 | 1039 | 5.9e−105 |

Description
pir:[LN:A70015] [AC:A70015] [PN:NADH dehydrogenase homolog yumB] [GN:yumB]
[CL:NADH dehydrogenase] [OR:*Bacillus subtilis*] [DB:pir2]
>gp:[GI:e1184289:g2635707] [LN:BSUB0017] [AC:Z99120:AL009126] [GN:yumB]
[FN:unknown] [OR:*Bacillus subtilis*] [DB:genpept-bct1] [DE:*Bacillus subtilis*
complete genome (section 17 of 21):from 3197001 to 3414420.] [NT:similar to
NADH dehydrogenase] [LE:102091] [RE:103311] [DI:complement]
>gp:[GI:e311467:g1934829] [LN:BSZ93939] [AC:Z93939] [PN:NADH dehydrogenase]
[GN:yumB] [OR:*Bacillus subtilis*] [DB:genpept-bct1] [DE:*B. subtilis* genomic
DNA fragment from yumA to yulF.] [NT:putative; unknown] [LE:528] [RE:1748]
[DI:complement]

| ORF Name | NT ID | AA ID | NT LN | AA LN | Score | P-Value |
|---|---|---|---|---|---|---|
| AI7503001001_26367175_c3_1476 | 3505 | 7277 | 123 | 40 | | |

Description
NO-HIT

| ORF Name | NT ID | AA ID | NT LN | AA LN | Score | P-Value |
|---|---|---|---|---|---|---|
| AI7503001001_26376077_c1_1113 | 3506 | 7278 | 192 | 63 | 101 | 1.5e−05 |

Description
pir:[LN:C70063] [AC:C70063] [PN:hypothetical protein ywmG] [GN:ywmG]
[OR:*Bacillus subtilis*] [DB:pir2] >gp:[GI:e276829:g1648859] [LN:BSATPC]
[AC:Z81356] [PN:unknown] [GN:ywmH] [OR:*Bacillus subtilis*] [DB:genpept-bct1]
[DE:*B. subtilis* atpC gene.] [LE:10910] [RE:11098] [DI:direct]
>gp:[GI:e1184573:g2636192] [LN:BSUB0019] [AC:Z99122:AL009126] [GN:ywmG]
[FN:unknown] [OR:*Bacillus subtilis*] [DB:genpept-bct1] [DE:*Bacillus subtilis*
complete genome (section 19 of 21):from 3597091 to 3809700.] [LE:172069]
[RE:172257] [DI:complement] >gp:[GI:e1184573:g2636192] [LN:BSUB0019]

-continued

[AC:Z99122:AL009126] [GN:ywmG] [FN:unknown] [OR:*Bacillus subtilis*]
[DB:genpept] [DE:*Bacillus subtilis* complete genome (section 19 of 21):from
3597091 to 3809700.] [LE:172069] [RE:172257] [DI:complement]

| ORF Name | NT ID | AA ID | NT LN | AA LN | Score | P-Value |
|---|---|---|---|---|---|---|
| AI7503001001__26464707__c3__1493 | 3507 | 7279 | 141 | 46 | 43 | 0.039 |

Description
pir:[LN:S58357] [AC:S66652:S58357] [PN:pepI protein] [GN:pepI]
[OR:*Staphylococcus epidermidis*] [DB:pir2] >gp:[GI:g945016] [LN:SEPEPGNS]
[AC:Z49865] [PN:PepI] [GN:pepI] [OR:*Staphylococcus epidermidis*]
[DB:genpept-bct1] [DE:*S. epidermidis* pepA, pepB, pepC, pepI, pepP and pepT
genes.] [LE:2028] [RE:2237] [DI:direct] >gp:[GI:g398082] [LN:STAPEPA]
[AC:L23967] [PN:immunity protein] [GN:pepI] [OR:*Staphylococcus epidermidis*]
[SR:*Staphylococcus epidermidis* DNA] [DB:genpept-bct1] [DE:*Staphylococcus
epidermidis* lantibiotic (pepA) and immunity protein (pepI) gene, complete
cds.] [LE:377] [RE:586] [DI:direct]

| ORF Name | NT ID | AA ID | NT LN | AA LN | Score | P-Value |
|---|---|---|---|---|---|---|
| AI7503001001__26578577__c1__1065 | 3508 | 7280 | 1791 | 596 | 2276 | 1.8e−238 |

Description
sp:[LN:UVRA_BACSU] [AC:O34863] [GN:UVRA] [OR:*BACILLUS SUBTILIS*]
[DE:EXCINUCLEASE ABC SUBUNIT A] [SP:O34863] [DB:swissprot] >pir:[LN:F69729]
[AC:F69729] [PN:excinuclease ABC chain A:excision endonuclease ABC,, chain
A:uvrA protein] [GN:uvrA] [CL:excinuclease ABC chain A:ATP-binding cassette
homology] [OR:*Bacillus subtilis*] [EC:3.1.—.—] [DB:pir2]
>gp:[GI:e1184422:g2636042] [LN:BSUB0019] [AC:Z99122:AL009126]
[PN:excinuclease ABC (subunit A)] [GN:uvrA] [FN:excision of ultraviolet
light-induced] [OR:*Bacillus subtilis*] [DB:genpept-bct1] [DE:*Bacillus
subtilis* complete genome (section 19 of 21):from 3597091 to 3809700.]
[SP:O34863] [LE:12034] [RE:14907] [DI:complement] >gp:[GI:g2618842]
[LN:AF017113] [AC:AF017113] [PN:excinuclease ABC subunit A] [GN:uvrA]
[OR:*Bacillus subtilis*] [DB:genpept-bct2] [DE:*Bacillus subtilis* 300–304
degree genomic sequence.] [LE:15386] [RE:18259] [DI:direct]
>gp:[GI:e1184422:g2636042] [LN:BSUB0019] [AC:Z99122:AL009126]
[PN:excinuclease ABC (subunit A)] [GN:uvrA] [FN:excision of ultraviolet
light-induced] [OR:*Bacillus subtilis*] [DB:genpept] [DE:*Bacillus subtilis*
complete genome (section 19 of 21):from 3597091 to 3809700.] [SP:O34863]
[LE:12034] [RE:14907] [DI:complement]

| ORF Name | NT ID | AA ID | NT LN | AA LN | Score | P-Value |
|---|---|---|---|---|---|---|
| AI7503001001__26594050__c3__1524 | 3509 | 7281 | 243 | 80 | 378 | 6.5e−35 |

Description
gp:[GI:d1013748:g1405337] [LN:D86240] [AC:D86240] [PN:D-alanyl carrier
protein] [GN:dltC] [OR:*Staphylococcus aureus*] [SR:*Staphylococcus aureus*
(isolate:KAN9G) DNA] [DB:genpept-bct1] [DE:*Staphylococcus aureus* gene for
unknown function and dlt operon dltA, dltB, dltC and dltD genes, complete cds.]
[NT:Sequence homologous to the dltC genes of] [LE:5303] [RE:5539]
[DI:direct] >gp:[GI:g4530243] [LN:AF101234] [AC:AF101234] [PN:D-alanine
carrier protein DltC] [GN:dltC] [OR:*Staphylococcus aureus*] [DB:genpept-bct2]
[DE:*Staphylococcus aureus* dltABCD operon, complete sequence; and unknown
gene.] [LE:4276] [RE:4512] [DI:direct]

| ORF Name | NT ID | AA ID | NT LN | AA LN | Score | P-Value |
|---|---|---|---|---|---|---|
| AI7503001001__26735877__c3__1508 | 3510 | 7282 | 402 | 133 | 446 | 4.1e−42 |

Description
pir:[LN:A70021] [AC:A70021] [PN:glycine cleavage system protein H homolog
yusH] [GN:yusH] [CL:glycine cleavage system protein H:
lipoyl/biotin-binding homology] [OR:*Bacillus subtilis*] [DB:pir2]
>gp:[GI:e1184358:g2635776] [LN:BSUB0017] [AC:Z99120:AL009126] [GN:yusH]
[FN:unknown] [OR:*Bacillus subtilis*] [DB:genpept-bct1] [DE:*Bacillus subtilis*
complete genome (section 17 of 21):from 3197001 to 3414420.] [NT:similar to
glycine cleavage system protein H] [LE:168182] [RE:168565] [DI:complement]

| ORF Name | NT ID | AA ID | NT LN | AA LN | Score | P-Value |
|---|---|---|---|---|---|---|
| AI7503001001__26753150__f1__147 | 3511 | 7283 | 336 | 111 | 295 | 4.1e−26 |

Description
sp:[LN:YKI4_YEAST] [AC:P36078] [GN:YKL084W] [OR:*SACCHAROMYCES CEREVISIAE*]
[SR:,BAKER'S YEAST] [DE:HYPOTHETICAL 13.6 KD PROTEIN IN MDH1-VMA5 INTERGENIC
REGION] [SP:P36078] [DB:swissprot] >pir:[LN:S37909] [AC:S37909]

-continued

[PN:hypothetical protein YKL084w] [OR:*Saccharomyces cerevisiae*] [DB:pir2]
[MP:11L] >gp:[GI:g486123] [LN:SCYKL084W] [AC:Z28084:Y13137]
[OR:*Saccharomyces cerevisiae*] [SR:baker's yeast] [DB:genpept-pln1]
[DE:*S. cerevisiae* chromosome XI reading frame ORF YKL084w.] [NT:ORF YKL084w]
[SP:P36078] [LE:382] [RE:732] [DI:direct]

| ORF Name | NT ID | AA ID | NT LN | AA LN | Score | P-Value |
|---|---|---|---|---|---|---|
| AI7503001001__26757807__f2__578 | 3512 | 7284 | 951 | 316 | 1619 | 2.0e−166 |

Description
gp:[GI:e255529:g1617430] [LN:SEABCTS] [AC:X99127] [PN:lipoprotein] [FN:iron
repressible ABC transport system] [OR:*Staphylococcus epidermidis*]
[DB:genpept-bct1] [DE:*S. epidermidis* gene encoding ABC transport system.]
[LE:1621] [RE:2550] [DI:direct]

| ORF Name | NT ID | AA ID | NT LN | AA LN | Score | P-Value |
|---|---|---|---|---|---|---|
| AI7503001001__26834387__f1__234 | 3513 | 7285 | 711 | 236 | 115 | 1.2e−06 |

Description
gp:[GI:g3043880] [LN:LLU95841] [AC:U95841] [PN:transmembrane protein Tmp6]
[OR:*Lactococcus lactis*] [DB:genpept-bct2] [DE:*Lactococcus lactis*
transmembrane protein Tmp6 gene, partial cds.] [NT:identified as a fusion to
a signal peptide-less] [LE:<1] [RE:354] [DI:complement]

| ORF Name | NT ID | AA ID | NT LN | AA LN | Score | P-Value |
|---|---|---|---|---|---|---|
| AI7503001001__26839462__c3__1474 | 3514 | 7286 | 1011 | 336 | 817 | 2.0e−81 |

Description
sp:[LN:YVCK_BACSU] [AC:O06974] [GN:YVCK] [OR:*BACILLUS SUBTILIS*]
[DE:HYPOTHETICAL 34.7 KD PROTEIN IN CRH-TRXB INTERGENIC REGION] [SP:O06974]
[DB:swissprot] >gp:[GI:e313027:g1945651] [LN:BSZ94043] [AC:Z94043]
[PN:hypothetical protein] [GN:yvcK] [OR:*Bacillus subtilis*] [DB:genpept-bct1]
[DE:*B. subtilis* genomic DNA fragment (88 kb).] [NT:similar to hypothetical
SYCSLRA] [SP:O06974] [LE:10662] [RE:11615] [DI:direct]

| ORF Name | NT ID | AA ID | NT LN | AA LN | Score | P-Value |
|---|---|---|---|---|---|---|
| AI7503001001__2752262__c3__1426 | 3515 | 7287 | 1014 | 337 | 652 | 6.0e−64 |

Description
pir:[LN:G69669] [AC:G69669] [PN:choline ABC transporter (ATP-binding
protein) opuBA] [GN:opuBA] [CL:glycine betaine/proline transport protein
proV:ATP-binding cassette homology:CBS homology] [OR:*Bacillus subtilis*]
[DB:pir2] >gp:[GI:e1186061:g2635886] [LN:BSUB0018] [AC:Z99121:AL009126]
[PN:choline ABC transporter (ATP-binding protein)] [GN:opuBA] [FN:high
affinity transport of choline] [OR:*Bacillus subtilis*] [DB:genpept-bct1]
[DE:*Bacillus subtilis* complete genome (section 18 of 21):from 3399551 to
3609060.] [NT:alternate gene name:proV] [LE:61618] [RE:62763]
[DI:complement] >gp:[GI:g2293447] [LN:AF008930] [AC:AF008930] [PN:ATPase]
[GN:opuBA] [OR:*Bacillus subtilis*] [DB:genpept-bct2] [DE:*Bacillus subtilis*
choline transport system including ATPase (opuBA), transmembrane protein
(opuBB), choline binding protein precursor (opuBC) and transmembrane protein
(opuBD) genes, complete cds; and unknown gene.] [NT:OpuBA; part of choline
uptake system] [LE:881] [RE:2026] [DI:direct]

| ORF Name | NT ID | AA ID | NT LN | AA LN | Score | P-Value |
|---|---|---|---|---|---|---|
| AI7503001001__275268__c2__1225 | 3516 | 7288 | 1125 | 374 | 766 | 5.0e−76 |

Description
sp:[LN:HIS8_BACSU] [AC:P17731:O32008] [GN:HISC:HISH] [OR:*BACILLUS SUBTILIS*]
[EC:2.E.1.9] [DE:PHOSPHATE TRANSAMINASE)] [SP:P17731:O32008] [DB:swissprot]
>pir:[LN:A26532] [AC:A26532:G22794:H69640] [PN:histidinol-phosphate
transaminase, / tyrosine and phenylalanine aminotransferase
hisC:histidinol-phosphate aminotransferase] [GN:hisC:hisH] [CL:probable
histidinol-phosphate transaminase] [OR:*Bacillus subtilis*] [EC:2.6.1.9]
[DB:pir2] [MP:205 (degrees)] >gp:[GI:g143814] [LN:BACVARGNS]
[AC:M80245:M15409] [PN:HisH] [GN:HisH] [OR:*Bacillus subtilis*] [SR:*Bacillus
subtilis* DNA] [DB:genpept-bct1] [DE:*B. subtilis* dbpA, mtr(A,B), gerC(1–3),
ndk, cheR, aro(B,E,F,H), trp(A–F), hisH, and tyrA genes, complete cds.]
[LE:14250] [RE:15332] [DI:direct] >gp:[GI:e1183707:g2634680] [LN:BSUB0012]
[AC:Z99115:AL009126] [PN:tyrosine/phenylalanine aminotransferase] [GN:hisC]
[FN:histidine biosynthesis] [OR:*Bacillus subtilis*] [DB:genpept-bct1]

-continued

[EC:2.6.1.9:2.6.1.5] [DE:*Bacillus subtilis* complete genome (section 12 of 21):from 2195541 to 2409220.] [NT:alternate gene name:aroJ; histidinol-phosphate] [SP:P17731] [LE:174116] [RE:175198] [DI:complement]

| ORF Name | NT ID | AA ID | NT LN | AA LN | Score | P-Value |
|---|---|---|---|---|---|---|
| AI7503001001__2917200__f1__277 | 3517 | 7289 | 192 | 63 | | |

Description
NO-HIT

| ORF Name | NT ID | AA ID | NT LN | AA LN | Score | P-Value |
|---|---|---|---|---|---|---|
| AI7503001001__2926425__f2__465 | 3518 | 7290 | 960 | 319 | 456 | 3.5e−43 |

Description
sp:[LN:BMRU__BACSU] [AC:P39074] [GN:BMRU] [OR:*BACILLUS SUBTILIS*] [DE:BMRU PROTEIN] [SP:P39074] [DB:swissprot] >pir:[LN:F69595] [AC:F69595] [PN:multidrug resistance protein cotranscribed with bmr bmrU] [GN:bmrU] [OR:*Bacillus subtilis*] [DB:pir2] >gp:[GI:g409286] [LN:BACBMRURBE] [AC:L25604] [GN:bmrU] [FN:unknown, but cotranscribed with bmr] [OR:*Bacillus subtilis*] [DB:genpept-bct1] [DE:*Bacillus subtilis* bmrU, multidrug efflux transporter (bmr) and its regulator (bmrR) genes, complete cds, and branched-chain 2-oxo acid dehydrogenase (bfmB) gene, 3 end.] [LE:227] [RE:1120] [DI:direct] >gp:[GI:d1013282:g1303947] [LN:BACJH642] [AC:D84432:D82370] [PN:BmrU] [OR:*Bacillus subtilis*] [SR:*Bacillus subtilis* (strain:JH642(trpC2 PheAl)) DNA] [DB:genpept-bct1] [DE:*Bacillus subtilis* DNA, 283 Kb region containing skin element.] [LE:225092] [RE:225985] [DI:complement] >gp:[GI:e1185268:g2634834] [LN:BSUB0013] [AC:Z99116:AL009126] [PN:multidrug resistance protein] [GN:bmrU] [OR:*Bacillus subtilis*] [DB:genpept-bct1] [DE:*Bacillus subtilis* complete genome (section 13 of 21):from 2395261 to 2613730.] [SP:P39074] [LE:97634] [RE:98527] [DI:direct]

| ORF Name | NT ID | AA ID | NT LN | AA LN | Score | P-Value |
|---|---|---|---|---|---|---|
| AI7503001001__2929517__c3__1399 | 3519 | 7291 | 126 | 41 | | |

Description
NO-HIT

| ORF Name | NT ID | AA ID | NT LN | AA LN | Score | P-Value |
|---|---|---|---|---|---|---|
| AI7503001001__29376503__f2__504 | 3520 | 7292 | 246 | 81 | | |

Description
NO-HIT

| ORF Name | NT ID | AA ID | NT LN | AA LN | Score | P-Value |
|---|---|---|---|---|---|---|
| AI7503001001__29378425__f3__790 | 3521 | 7293 | 132 | 43 | | |

Description
NO-HIT

| ORF Name | NT ID | AA ID | NT LN | AA LN | Score | P-Value |
|---|---|---|---|---|---|---|
| AI7503001001__29501510__c1__950 | 3522 | 7294 | 1125 | 374 | 432 | 1.2e−40 |

Description
sp:[LN:TAGB__BACSU] [AC:P27621] [GN:TAGB] [OR:*BACILLUS SUBTILIS*] [DE:TEICHOIC ACID BIOSYNTHESIS PROTEIN B PRECURSOR] [SP:P27621] [DB:swissprot] >pir:[LN:C49757] [AC:C49757:C69720] [PN:polyglycerol phosphate techoic acid biosynthesis protein tagB] [GN:tagB] [OR:*Bacillus subtilis*] [DB:pir2] >gp:[GI:g143725] [LN:BACTAGABCD] [AC:M57497] [GN:tagB] [OR:*Bacillus subtilis*] [SR:*B. subtilis* (strain 168) DNA] [DB:genpept-bct1] [DE:*B. subtilis* tagA, tagB, tagC and tagD genes, complete cds.] [NT:putative] [LE:1603] [RE:2748] [DI:direct] >gp:[GI:e1184482:g2636102] [LN:BSUB0019] [AC:Z99122:AL009126] [GN:tagB] [FN:polyglycerol phosphate assembly and export] [OR:*Bacillus subtilis*] [DB:genpept-bct1] [DE:*Bacillus subtilis* complete genome (section 19 of 21):from 3597091 to 3809700.] [SP:P27621] [LE:84143] [RE:85288] [DI:direct] >gp:[GI:e1184482:g2636102] [LN:BSUB0019] [AC:Z99122:AL009126] [GN:tagB] [FN:polyglycerol phosphate assembly and export] [OR:*Bacillus subtilis*] [DB:genpept] [DE:*Bacillus subtilis* complete genome (section 19 of 21):from 3597091 to 3809700.] [SP:P27621] [LE:84143] [RE:85288] [DI:direct]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503001001__29570877__c3__1414 | 3523 | 7295 | 153 | 50 | | |

Description
NO-HIT

| ORF Name | NT ID | AA ID | NT LN | AA LN | Score | P-Value |
|---|---|---|---|---|---|---|
| AI7503001001__3001313__c2__1262 | 3524 | 7296 | 681 | 226 | 154 | 3.6e−11 |

Description
pir:[LN:A65001] [AC:A65001] [PN:hypothetical protein b2291] [OR:*Escherichia coli*] [DB:pir2] >gp:[GI:g1788628] [LN:AE000318] [AC:AE000318:U00096] [PN:putative alpha helix protein] [GN:b2291] [FN:phenotype; Not classified] [OR:*Escherichia coli*] [DB:genpept-bct2] [DE:*Escherichia coli* K-12 MG1655 section 208 of 400 of the complete genome.] [NT:o199] [LE:4988] [RE:5587] [DI:direct]

| ORF Name | NT ID | AA ID | NT LN | AA LN | Score | P-Value |
|---|---|---|---|---|---|---|
| AI7503001001__30198587__f3__629 | 3525 | 7297 | 258 | 85 | 306 | 2.8e−27 |

Description
pir:[LN:C70024] [AC:C70024] [PN:NifU protein homolog homolog yutI] [GN:yutI] [CL:conserved hypothetical nifU-like protein HP1492] [OR:*Bacillus subtilis*] [DB:pir2] >gp:[GI:e1184301:g2635719] [LN:BSUB0017] [AC:Z99120:AL009126] [GN:yutI] [FN:unknown] [OR:*Bacillus subtilis*] [DB:genpept-bct1] [DE:*Bacillus subtilis* complete genome (section 17 of 21): from 3197001 to 3414420.] [NT:similar to NifU protein homolog] [LE:112444] [RE:112779] [DI:direct]

| ORF Name | NT ID | AA ID | NT LN | AA LN | Score | P-Value |
|---|---|---|---|---|---|---|
| AI7503001001__30265692__c3__1521 | 3526 | 7298 | 1050 | 349 | 1070 | 3.1e−108 |

Description
gp:[GI:g4530240] [LN:AF101234] [AC:AF101234] [PN:unknown] [OR:*Staphylococcus aureus*] [DB:genpept-bct2] [DE:*Staphylococcus aureus* dltABCD operon, complete sequence; and unknown gene.] [NT:Orf1; similar to hydroxyacid dehydrogenases] [LE:51] [RE:1010] [DI:direct]

| ORF Name | NT ID | AA ID | NT LN | AA LN | Score | P-Value |
|---|---|---|---|---|---|---|
| AI7503001001__30272661__f1__265 | 3527 | 7299 | 174 | 57 | | |

Description
NO-HIT

| ORF Name | NT ID | AA ID | NT LN | AA LN | Score | P-Value |
|---|---|---|---|---|---|---|
| AI7503001001__30491275__c1__961 | 3528 | 7300 | 1104 | 367 | 391 | 2.7e−36 |

Description
pir:[LN:H69867] [AC:H69867] [PN:conserved hypothetical protein ykvI] [GN:ykvI] [OR:*Bacillus subtilis*] [DB:pir2] >gp:[GI:e1184961:g2633742] [LN:BSUB0008] [AC:Z99111:AL009126] [GN:ykvI] [FN:unknown] [OR:*Bacillus subtilis*] [DB:genpept-bct1] [DE:*Bacillus subtilis* complete genome (section 8 of 21):from 1394791 to 1603020.] [NT:similar to hypothetical proteins from *B. subtilis*] [LE:42768] [RE:43811] [DI:direct]

| ORF Name | NT ID | AA ID | NT LN | AA LN | Score | P-Value |
|---|---|---|---|---|---|---|
| AI7503001001__30601588__c3__1356 | 3529 | 7301 | 834 | 277 | 561 | 2.6e−54 |

Description
sp:[LN:TAGG_BACSU] [AC:P42953] [GN:TAGG] [OR:*BACILLUS SUBTILIS*] [DE:TEICHOIC ACID TRANSLOCATION PERMEASE PROTEIN TAGG] [SP:P42953] [DB:swissprot] >pir:[LN:S69202] [AC:S69202:H69720] [PN:teichoic acid permease tagG:integral membrane protein tagG] [GN:tagG] [OR:*Bacillus subtilis*] [DB:pir2] >gp:[GI:g755152] [LN:BSU13832] [AC:U13832] [PN:highly hydrophobic integral membrane protein] [GN:tagG] [FN:teichoic acid translocation] [OR:*Bacillus subtilis*] [DB:genpept-bct1] [DE:*Bacillus subtilis* 168 highly hydrophobic integral membrane protein(tagG) gene and ATP-binding protein (tagH) gene, complete cds.] [LE:287] [RE:1114] [DI:direct] >gp:[GI:e1184477:g2636097] [LN:BSUB0019] [AC:Z99122:AL009126] [PN:permease] [GN:tagG] [FN:teichoic acid translocation] [OR:*Bacillus subtilis*] [DB:genpept-bct1] [DE:*Bacillus subtilis* complete genome (section 19 of 21): from 3597091 to 3809700.] [SP:P42953] [LE:77137] [RE:77964] [DI:complement] >gp:[GI:e1184477:g2636097] [LN:BSUB0019] [AC:Z99122:AL009126] [PN:permease] [GN:tagG] [FN:teichoic acid translocation] [OR:*Bacillus subtilis*]

-continued

[DB:genpept] [DE:*Bacillus subtilis* complete genome (section 19 of 21):from 3597091 to 3809700.] [SP:P42953] [LE:77137] [RE:77964] [DI:complement]

| ORF Name | NT ID | AA ID | NT LN | AA LN | Score | P-Value |
|---|---|---|---|---|---|---|
| AI7503001001__30661260__c1__1080 | 3530 | 7302 | 132 | 43 | | |

Description
NO-HIT

| ORF Name | NT ID | AA ID | NT LN | AA LN | Score | P-Value |
|---|---|---|---|---|---|---|
| AI7503001001__30745328__c1__1103 | 3531 | 7303 | 606 | 201 | 200 | 4.8e−16 |

Description
pir:[LN:S56619] [AC:S56619:B65255] [PN:gpmB protein:hypothetical protein o215b] [GN:gpmB] [CL:phosphoglycerate mutase homology] [OR:*Escherichia coli*] [DB:pir2] >gp:[GI:g537235] [LN:ECOUW93] [AC:U14003] [OR:*Escherichia coli*] [DB:genpept-bct1] [DE:*Escherichia coli* K-12 chromosomal region from 92.8 to 00.1 minutes.] [NT:Kenn Rudd identifies as gpmB] [LE:324630] [RE:325277] [DI:direct] >gp:[GI:g1790856] [LN:AE000509] [AC:AE000509:U00096] [PN:phosphoglyceromutase 2] [GN:gpmB] [FN:enzyme; Energy metabolism, carbon: Glycolysis] [OR:*Escherichia coli*] [DB:genpept-bct2] [DE:*Escherichia coli* K-12 MG1655 section 399 of 400 of the complete genome.] [LE:8985] [RE:9632] [DI:direct]

| ORF Name | NT ID | AA ID | NT LN | AA LN | Score | P-Value |
|---|---|---|---|---|---|---|
| AI7503001001__31257943__c2__1156 | 3532 | 7304 | 414 | 137 | 669 | 9.5e−66 |

Description
gp:[GI:g1913907] [LN:SAU91741] [AC:U91741] [PN:TagD] [GN:tagD] [FN:teichoic acid biosynthesis] [OR:*Staphylococcus aureus*] [DB:genpept-bct1] [DE:*Staphylococcus aureus* teichoic acid biosynthesis TagB gene, partial cds and TagX and TagD genes, complete cds.] [NT:similar to *Bacillus subtilis* TagD] [LE:1534] [RE:1932] [DI:direct]

| ORF Name | NT ID | AA ID | NT LN | AA LN | Score | P-Value |
|---|---|---|---|---|---|---|
| AI7503001001__31267503__c2__1168 | 3533 | 7305 | 813 | 270 | 784 | 6.2e−78 |

Description
pir:[LN:A70001] [AC:A70001] [PN:ABC transporter (ATP-binding protein) homolog ytsC] [GN:ytsC] [CL:ATP-binding cassette homology] [OR:*Bacillus subtilis*] [DB:pir2] >gp:[GI:e1185911:g2635522] [LN:BSUB0016] [AC:Z99119:AL009126] [GN:ytsC] [FN:unknown] [OR:*Bacillus subtilis*] [DB:genpept-bct1] [DE:*Bacillus subtilis* complete genome (section 16 of 21): from 2997771 to 3213410.] [NT:similar to ABC transporter (ATP-binding protein)] [LE:112638] [RE:113399] [DI:complement] >gp:[GI:g2293177] [LN:AF008220] [AC:AF008220] [PN:transporter] [GN:ytsC] [OR:*Bacillus subtilis*] [DB:genpept-bct2] [DE:*Bacillus subtilis* rrnB-dnaB genomic region.] [LE:67028] [RE:67789] [DI:direct]

| ORF Name | NT ID | AA ID | NT LN | AA LN | Score | P-Value |
|---|---|---|---|---|---|---|
| AI7503001001__31289687__c1__1051 | 3534 | 7306 | 681 | 226 | 132 | 5.1e−06 |

Description
gp:[GI:g4894306] [LN:AF065404] [AC:AF065404] [PN:pXO1-90] [OR:*Bacillus anthracis*] [DB:genpept-bct2] [DE:*Bacillus anthracis* virulence plasmid PX01, complete sequence.] [LE:106772] [RE:108730] [DI:direct]

| ORF Name | NT ID | AA ID | NT LN | AA LN | Score | P-Value |
|---|---|---|---|---|---|---|
| AI7503001001__31428188__f2__401 | 3535 | 7307 | 222 | 73 | | |

Description
NO-HIT

| ORF Name | NT ID | AA ID | NT LN | AA LN | Score | P-Value |
|---|---|---|---|---|---|---|
| AI7503001001__31578__c2__1265 | 3536 | 7308 | 537 | 178 | 463 | 5.4e−44 |

Description
pir:[LN:H70044] [AC:H70044] [PN:O-acetyltransferase homolog yvoF] [GN:yvoF] [OR:*Bacillus subtilis*] [DB:pir2] >gp:[GI:e1186184:g2636009] [LN:BSUB0018] [AC:Z99121:AL009126] [GN:yvoF] [FN:unknown] [OR:*Bacillus subtilis*] [DB:genpept-bct1] [DE:*Bacillus subtilis* complete genome (section 18 of 21): from 3399551 to 3609060.] [NT:similar to O-acetyltransferase] [LE:190798]

-continued

[RE:191316] [DI:complement] >gp:[GI:g2618861] [LN:AF017113] [AC:AF017113]
[PN:putative acetyltransferase] [GN:yvoF] [OR:*Bacillus subtilis*]
[DB:genpept-bct2] [DE:*Bacillus subtilis* 300–304 degree genomic sequence.]
[LE:36517] [RE:37035] [DI:direct]

| ORF Name | NT ID | AA ID | NT LN | AA LN | Score | P-Value |
|---|---|---|---|---|---|---|
| AI7503001001__31803377__f3__884 | 3537 | 7309 | 612 | 203 | | |

Description
NO-HIT

| ORF Name | NT ID | AA ID | NT LN | AA LN | Score | P-Value |
|---|---|---|---|---|---|---|
| AI7503001001__31876563__c1__1124 | 3538 | 7310 | 1239 | 412 | 1924 | 9.7e−199 |

Description
gp:[GI:d1013747:g1405336] [LN:D86240] [AC:D86240] [PN:hypothethecal membrane
transporter] [GN:dltB] [OR:*Staphylococcus aureus*] [SR:*Staphylococcus aureus*
(isolate:KAN96) DNA] [DB:genpept-bct1] [DE:*Staphylococcus aureus* gene for
unknown function and dlt operon dltA, dltB, dltC and dltD genes, complete cds.]
[NT:Sequence homologous to the dltB genes of] [LE:4071] [RE:5285]
[DI:direct] >gp:GI:g4530242] [LN:AF101234] [AC:AF101234] [PN:putative
membrane protein DltB] [GN:dltB] [FN:involved in D-alanine transfer into
teichoic] [OR:*Staphylococcus aureus*] [DB:genpept-bct2] [DE:*Staphylococcus
aureus* dltABCD operon, complete sequence; and unknown gene.] [LE:3044]
[RE:4258] [DI:direct]

| ORF Name | NT ID | AA ID | NT LN | AA LN | Score | P-Value |
|---|---|---|---|---|---|---|
| AI7503001001__32062553__c1__943 | 3539 | 7311 | 468 | 155 | 354 | 2.3e−32 |

Description
pir:[LN:S61393] [AC:561393] [PN:hypothetical protein 2] [OR:*Bacillus* sp.]
[SR:strain C-125, , strain C-125] [SR:strain C-125,] [DB:pir2]
>gp:[GI:d1007182:g854656] [LN:BACAPS] [AC:D31823] [PN:ORF2] [OR:*Bacillus*
sp.] [SR:*Bacillus* sp. (strain:C-125) DNA] [DB:genpept-bct2] [DE:*Bacillus* sp.
Na+/H+ antiporter system responsible genes.] [NT:Na+/H+ antiporter system
responsible gene] [LE:2669] [RE:3109] [DI:direct]

| ORF Name | NT ID | AA ID | NT LN | AA LN | Score | P-Value |
|---|---|---|---|---|---|---|
| AI7503001001__32070827__f3__789 | 3540 | 7312 | 168 | 55 | | |

Description
NO-HIT

| ORF Name | NT ID | AA ID | NT LN | AA LN | Score | P-Value |
|---|---|---|---|---|---|---|
| AI7503001001__32212902__c2__1135 | 3541 | 7313 | 1035 | 344 | 468 | 1.9e−44 |

Description
pir:[LN:F70046] [AC:F70046] [PN:iron permease homolog yvrB] [GN:yvrB]
[OR:*Bacillus subtilis*] [DB:pir2] >gp:[GI:e1249808:g2832812] [LN:BS43KBDNA]
[AC:AJ223978] [PN:putative hemin permease, YvrB] [GN:yvrB] [OR:*Bacillus
subtilis*] [DB:genpept-bct1] [DE:*Bacillus subtilis* 42.7 kB DNA fragment from
yvsA to yvqA.] [LE:24699] [RE:25760] [DI:direct] >gp:[GI:e1184396:g2635814]
[LN:BSUB0017] [AC:Z99120:AL009126] [GN:yvrB] [FN:unknown] [OR:*Bacillus
subtilis*] [DB:genpept-bct1] [DE:*Bacillus subtilis* complete genome (section
17 of 21):from 3197001 to 3414420.] [NT:similar to iron permease]
[LE:204527] [RE:205588] [DI:complement] >gp:[GI:e1186005:g2635830]
[LN:BSUB0018] [AC:Z99121:AL009126] [GN:yvrB] [FN:unknown] [OR:*Bacillus
subtilis*] [DB:genpept-bct1] [DE:*Bacillus subtilis* complete genome (section
18 of 21):from 3399551 to 3609060.] [NT:similar to iron permease] [LE:1977]
[RE:3038] [DI:complement]

| ORF Name | NT ID | AA ID | NT LN | AA LN | Score | P-Value |
|---|---|---|---|---|---|---|
| AI7503001001__32225012__f1__54 | 3542 | 7314 | 498 | 165 | 276 | 4.2e−24 |

Description
pir:[LN:F69870] [AC:F69870] [PN:general stress protein homolog ykzA]
[GN:ykzA] [CL:hypothetical protein yklA] [OR:*Bacillus subtilis*] [DB:pir2]
>gp:[GI:e1181516:g2632036] [LN:BSAJ2571] [AC:AJ002571] [PN:YknA] [GN:yknA]
[FN:unknown] [OR:*Bacillus subtilis*] [DB:genpept-bct1] [DE:*Bacillus subtilis*
168 56 kb DNA fragment between xlyA and ykoR.] [NT:homologous to OsmC from
*Escherichia coli*] [LE:34145] [RE:34555] [DI:direct]
>gp:[GI:e1183336:g2633670] [LN:BSUB0007] [AC:Z99110:AL009126] [GN:ykzA]
[FN:unknown] [OR:*Bacillus subtilis*] [DB:genpept-bct1] [DE:*Bacillus subtilis*

-continued complete genome (section 7 of 21):from 1194391 to 1411140.] [NT:alternate gene name:yzzE; similar to general] [LE:187094] [RE:187504] [DI:direct]

| ORF Name | NT ID | AA ID | NT LN | AA LN | Score | P-Value |
|---|---|---|---|---|---|---|
| AI7503001001_32475037_f3_651 | 3543 | 7315 | 123 | 40 | | |

Description
NO-HIT

| ORF Name | NT ID | AA ID | NT LN | AA LN | Score | P-Value |
|---|---|---|---|---|---|---|
| AI7503001001_32611068_c1_927 | 3544 | 7316 | 1674 | 557 | 1694 | 2.3e−174 |

Description
sp:[LN:SYR_BACSU] [AC:P46906] [GN:ARGS] [OR:*BACILLUS SUBTILIS*] [EC:6.1.1.19] [DE:ARGINYL-TRNA SYNTHETASE, (ARGININE--TRNA LIGASE) (ARGRS)] [SP:P46906] [DB:swissprot] >pir:[LN:E69589] [AC:E69589:S60082] [PN:arginine--tRNA ligase, argS:arginyl-tRNA synthetase] [GN:argS] [CL:*Bacillus arginine*--tRNA ligase] [OR:*Bacillus subtilis*] [EC:6.1.1.19] [DB:pir2] >gp:[GI:e1186234:g2636270] [LN:BSUB0020] [AC:Z99123:AL009126] [PN:arginyl-tRNA synthetase] [GN:argS] [OR:*Bacillus subtilis*] [DB:genpept-bct1] [EC:6.1.1.19] [DE:*Bacillus subtilis* complete genome (section 20 of 21):from 3798401 to 4010550.] [SP:P46906] [LE:34303] [RE:35973] [DI:complement] >gp:[GI:e324388:g2224756] [LN:B5Z97024] [AC:Z97024] [PN:arginyl tRNA synthetase] [GN:argS] [OR:*Bacillus subtilis*] [DB:genpept-bct1] [DE:*Bacillus subtilis* ywiA, sbo, ywiB, argS and narK genes.] [SP:P46906] [LE:1680] [RE:3350] [DI:direct]

| ORF Name | NT ID | AA ID | NT LN | AA LN | Score | P-Value |
|---|---|---|---|---|---|---|
| AI7503001001_33210952_f2_370 | 3545 | 7317 | 234 | 77 | 93 | 0.0025 |

Description
gp:[GI:g3859891] [LN:AF072678] [AC:AF072678] [PN:alpha-actinin] [GN:AACTI] [OR:*Trichomonas vaginalis*] [DB:genpept-inv2] [DE:*Trichomonas vaginalis* alpha-actinin (AACTI) mRNA, complete cds.] [NT:actin binding protein] [LE:247] [RE:3042] [DI:direct]

| ORF Name | NT ID | AA ID | NT LN | AA LN | Score | P-Value |
|---|---|---|---|---|---|---|
| AI7503001001_33239001_f2_356 | 3546 | 7318 | 276 | 91 | | |

Description
NO-HIT

| ORF Name | NT ID | AA ID | NT LN | AA LN | Score | P-Value |
|---|---|---|---|---|---|---|
| AI7503001001_33304063_f1_151 | 3547 | 7319 | 159 | 52 | | |

Description
NO-HIT

| ORF Name | NT ID | AA ID | NT LN | AA LN | Score | P-Value |
|---|---|---|---|---|---|---|
| AI7503001001_33414143_c3_1395 | 3548 | 7320 | 1710 | 569 | 619 | 1.9e−60 |

Description
gp:[GI:g2773332] [LN:AF040718] [AC:AF040718] [PN:ABC transporter CydC] [GN:cydC] [OR:*Shigella flexneri*] [DB:genpept-bct2] [DE:*Shigella flexneri* ABC transporter CydC (cydC) gene, complete cds.] [NT:similar to *E. coli* CydC] [LE:1648] [RE:3369] [DI:direct]

| ORF Name | NT ID | AA ID | NT LN | AA LN | Score | P-Value |
|---|---|---|---|---|---|---|
| AI7503001001_33628441_f3_645 | 3549 | 7321 | 255 | 84 | | |

Description
NO-HIT

| ORF Name | NT ID | AA ID | NT LN | AA LN | Score | P-Value |
|---|---|---|---|---|---|---|
| AI7503001001_33645967_f1_18 | 3550 | 7322 | 282 | 93 | 73 | 0.019 |

Description
gp:[GI:g2444074] [LN:CPU88070] [AC:U88070] [GN:scc1] [FN:putative chaperone of type III secretory] [OR:*Chlamydophila caviae*] [DB:genpept-bct2]

-continued

[DE:*Chlamydophila caviae* cds1, cds2, copN and scc1 genes, complete cds.]
[NT:similar to SycE of Yersinia] [LE:4766] [RE:5206] [DI:direct]

| ORF Name | NT ID | AA ID | NT LN | AA LN | Score | P-Value |
|---|---|---|---|---|---|---|
| AI7503001001__34069680__c1__1125 | 3551 | 7323 | 213 | 70 | | |

Description
NO-HIT

| ORF Name | NT ID | AA ID | NT LN | AA LN | Score | P-Value |
|---|---|---|---|---|---|---|
| AI7503001001__34160625__c3__1368 | 3552 | 7324 | 438 | 145 | | |

Description
NO-HIT

| ORF Name | NT ID | AA ID | NT LN | AA LN | Score | P-Value |
|---|---|---|---|---|---|---|
| AI7503001001__34173262__c3__1497 | 3553 | 7325 | 141 | 46 | | |

Description
NO-HIT

| ORF Name | NT ID | AA ID | NT LN | AA LN | Score | P-Value |
|---|---|---|---|---|---|---|
| AI7503001001__34173385__c1__975 | 3554 | 7326 | 621 | 206 | 151 | 7.4e−11 |

Description
pir:[LN:E71040] [AC:E71040] [PN:hypothetical protein PH1613] [GN:PH1613]
[OR:*Pyrococcus horikoshii*] [DB:pir2] >gp:[GI:d1031668:g3258042]
[LN:AP000006]
[AC:AP000006:AB005215:AB009510:AB009511:AB009512:AB009513:AB009514]
[PN:166aa long hypothetical protein] [GN:PH1613] [OR:*Pyrococcus horikoshii*]
[SR:*Pyrococcus horikoshii* (strain:OT3) DNA, clone:*Pyrococcus horikoshi*]
[DB:genpept-bct1] [DE:*Pyrococcus horikoshii* OT3 genomic DNA, 1166001-1485000
nt. position(6/7).] [LE:263709] [RE:264209] [DI:complement]

| ORF Name | NT ID | AA ID | NT LN | AA LN | Score | P-Value |
|---|---|---|---|---|---|---|
| AI7503001001__34173750__c3__1485 | 3555 | 7327 | 480 | 159 | | |

Description
NO-HIT

| ORF Name | NT ID | AA ID | NT LN | AA LN | Score | P-Value |
|---|---|---|---|---|---|---|
| AI7503001001__34176550__f1__24 | 3556 | 7328 | 132 | 43 | | |

Description
NO-HIT

| ORF Name | NT ID | AA ID | NT LN | AA LN | Score | P-Value |
|---|---|---|---|---|---|---|
| AI7503001001__34189817__c1__945 | 3557 | 7329 | 2052 | 683 | 888 | 5.9e−89 |

Description
pir:[LN:E70040] [AC:E70040] [PN:conserved hypothetical protein yvgP]
[GN:yvgP] [CL:hypothetical protein yvgP] [OR:*Bacillus subtilis*] [DB:pir2]
>gp:[GI:e1186030:g2635855] [LN:BSUB0018] [AC:Z99121:AL009126] [GN:yvgP]
[FN:unknown] [OR:*Bacillus subtilis*] [DB:genpept-bct1] [DE:*Bacillus subtilis*
complete genome (section 18 of 21):from 3399551 to 3609060.] [NT:similar to
hypothetical proteins] [LE:27843] [RE:29855] [DI:complement]

| ORF Name | NT ID | AA ID | NT LN | AA LN | Score | P-Value |
|---|---|---|---|---|---|---|
| AI7503001001__3424162__c3__1511 | 3558 | 7330 | 489 | 162 | 529 | 6.5e−51 |

Description
pir:[LN:E70019] [AC:E70019] [PN:NifU protein homolog homolog yurV] [GN:yurV]
[CL:Yeast nitrogen fixation protein:nitrogen fixation protein homology]
[OR:*Bacillus subtilis*] [DB:pir2] >gp:[GI:e1184346:g2635764] [LN:BSUB0017]
[AC:Z99120:AL009126] [GN:yurV] [FN:unknown] [OR:*Bacillus subtilis*]
[DB:genpept-bct1] [DE:*Bacillus subtilis* complete genome (section 17 of 21):
from 3197001 to 3414420.] [NT:similar to NifU protein homolog] [LE:159070]
[RE:159513] [DI:complement]

-continued

| ORF Name | NT ID | AA ID | NT LN | AA LN | Score | P-Value |
|---|---|---|---|---|---|---|
| AI7503001001__34251887__c2__1322 | 3559 | 7331 | 1266 | 421 | 1649 | 1.3e−169 |

Description
gp:[GI:g4530244] [LN:AF101234] [AC:AF101234] [PN:putative exoprotein DltD]
[GN:dltD] [FN:involved in D-alanine transfer into teichoic]
[OR:*Staphylococcus aureus*] [DB:genpept-bct2] [DE:*Staphylococcus aureus*
dltABCD operon, complete sequence; and unknown gene.] [LE:4509] [RE:5684]
[DI:direct]

| ORF Name | NT ID | AA ID | NT LN | AA LN | Score | P-Value |
|---|---|---|---|---|---|---|
| AI7503001001__34254581__c1__954 | 3560 | 7332 | 147 | 48 | | |

Description
NO-HIT

| ORF Name | NT ID | AA ID | NT LN | AA LN | Score | P-Value |
|---|---|---|---|---|---|---|
| AI7503001001__34261088__c3__1387 | 3561 | 7333 | 312 | 103 | 75 | 0.018 |

Description
gp:[GI:g488925] [LN:A13473] [AC:
A13473] [PN:41 kd antigen] [OR:*Plas-
modium
falciparum*] [SR:malaria parasite P. falci-
parum] [DB:genpept-pat]
[DE:*P. falciparum* gene for 41 kd anti-
gen, clone 41-14.] [LE:<1] [RE:>532]
[DI:direct]

| ORF Name | NT ID | AA ID | NT LN | AA LN | Score | P-Value |
|---|---|---|---|---|---|---|
| AI7503001001__34562762__c3__1336 | 3562 | 7334 | 750 | 249 | 230 | 3.2e−19 |

Description
pir:[LN:D71157] [AC:D71157] [PN:hypothetical protein PH0459] [GN:PH0459]
[OR:*Pyrococcus horikoshii*] [DB:pir2] >gp:[GI:d1030488:g3256862]
[LN:AP000002]
[AC:AP000002:AB009475:AB009476:AB009477:AB009478:AB009479:AB009480]
[PN:232aa long hypothetical protein] [GN:PH0459] [OR:*Pyrococcus horikoshii*]
[SR:*Pyrococcus horikoshii* (strain:OT3) DNA] [DB:genpept-bct1] [DE:*Pyrococcus
horikoshii* OT3 genomic DNA, 287001-544000 nt. position(2/7).] [LE:132975]
[RE:133673] [DI:direct]

| ORF Name | NT ID | AA ID | NT LN | AA LN | Score | P-Value |
|---|---|---|---|---|---|---|
| AI7503001001__34571000__f1__163 | 3563 | 7335 | 537 | 178 | 393 | 1.7e−35 |

Description
sp:[LN:ADH2__ENTHI] [AC:Q24803:Q27649] [GN:ADH2] [OR:*ENTAMOEBA HISTOLYTICA*]
[EC:1.1.1.1:1.2.1.10] [DE:DEHYDROGENASE, (ACDH)] [SP:Q24803:Q27649]
[DB:swissprot] >gp:[GI:g488430] [LN:EHU04863] [AC:U04863] [PN:alcohol
dehydrogenase 2] [OR:*Entamoeba histolytica*] [DB:genpept-inv1] [DE:*Entamoeba
histolytica* HM1:IMSS alcohol dehydrogenase 2 (EhADH2)mRNA, complete cds.]
[NT:The derived amino acid sequence of EhADH2 is] [LE:3] [RE:2615]
[DI:direct]

| ORF Name | NT ID | AA ID | NT LN | AA LN | Score | P-Value |
|---|---|---|---|---|---|---|
| AI7503001001__34589027__c2__1197 | 3564 | 7336 | 315 | 104 | 98 | 0.00023 |

Description
sp:[LN:Y420__METJA] [AC:Q57863] [GN:MJ0420] [OR:*METHANOCOCCUS JANNASCHII*]
[DE:HYPOTHETICAL PROTEIN MJ0420] [SP:Q57863] [DB:swissprot] >pir:[LN:D64352]
[AC:D64352] [PN:hypothetical protein MJ0420] [OR:*Methanococcus jannaschii*]
[DB:pir2] [MP:FOR378394-379536] >gp:[GI:g1591123] [LN:U67494]
[AC:U67494:L77117] [PN:O-antigen polymerase isolog] [GN:MJ0420]
[OR:*Methanococcus jannaschii*] [DB:genpept-bct2] [DE:*Methanococcus jannaschii*
section 36 of 150 of the complete genome.] [NT:similar to GB:M60066
SP:P26479 PID:154343 percent] [LE:1855] [RE:2997] [DI:direct]

| ORF Name | NT ID | AA ID | NT LN | AA LN | Score | P-Value |
|---|---|---|---|---|---|---|
| AI7503001001__34612887__f2__512 | 3565 | 7337 | 465 | 154 | 260 | 2.1e−22 |

Description
pir:[LN:E69857] [AC:E69857] [PN:conserved hypothetical protein ykmA]

-continued

[GN:ykmA] [OR:*Bacillus subtilis*] [DB:pir2] >gp:[GI:e1181515:g2632035]
[LN:BSAJ2571] [AC:AJ002571] [PN:YkmA] [GN:ykmA] [FN:unknown] [OR:*Bacillus subtilis*] [DB:genpept-bct1] [DE:*Bacillus subtilis* 168 56 kb DNA fragment between xlyA and ykoR.] [LE:33559] [RE:34002] [DI:complement]
>gp:[GI:e1183335:g2633669] [LN:BSUB0007] [AC:Z99110:AL009126] [GN:ykmA] [FN:unknown] [OR:*Bacillus subtilis*] [DB:genpept-bct1] [DE:*Bacillus subtilis* complete genome (section 7 of 21):from 1194391 to 1411140.] [NT:similar to hypothetical proteins] [LE:186508] [RE:186951] [DI:complement]

| ORF Name | NT ID | AA ID | NT LN | AA LN | Score | P-Value |
| --- | --- | --- | --- | --- | --- | --- |
| AI7503001001__34627136__f3__681 | 3566 | 7338 | 306 | 101 | 73 | 0.014 |

Description
pir:[LN:S36690] [AC:S36690] [PN:hypothetical protein] [OR:*Autographa californica* nuclear polyhedrosis virus:AcMNPV] [DB:pir2] >gp:[GI:g296321] [LN:ACNPVDNA] [AC:X71415] [GN:ORF 339] [OR:*Autographa californica* nucleopolyhedrovirus] [DB:genpept-vrl] [DE:*Autographa californica* nuclear polyhedrosis virus DNA.] [SP:Q06669] [LE:<1] [RE:339] [DI:complement]

| ORF Name | NT ID | AA ID | NT LN | AA LN | Score | P-Value |
| --- | --- | --- | --- | --- | --- | --- |
| AI7503001001__34641875__c3__1406 | 3567 | 7339 | 939 | 312 | 704 | 1.9e−69 |

Description
pir:[LN:A69627] [AC:A69627] [PN:fructose 1-phosphate kinase fruB] [GN:fruB] [CL:6-phosphofructokinase 2] [OR:*Bacillus subtilis*] [DB:pir2]
>gp:[GI:e1185029:g2633810] [LN:BSUB0008] [AC:Z99111:AL009126] [PN:fructose-1-phosphate kinase] [GN:fruB] [OR:*Bacillus subtilis*] [DB:genpept-bct1] [EC:2.7.1.56] [DE:*Bacillus subtilis* complete genome (section 8 of 21):from 1394791 to 1603020.] [LE:112945] [RE:113856] [DI:direct] >gp:[GI:g3282124] [LN:AF012285] [AC:AF012285:AF012284:U51911] [PN:fructose-1-phosphate kinase] [GN:fruB] [OR:*Bacillus subtilis*] [DB:genpept-bct2] [DE:*Bacillus subtilis* mobA-nprE gene region.] [NT:similar to *L. lactis* tagatose-6-phosphate kinase,] [LE:13433] [RE:14344] [DI:direct]

| ORF Name | NT ID | AA ID | NT LN | AA LN | Score | P-Value |
| --- | --- | --- | --- | --- | --- | --- |
| AI7503001001__34642567__c1__1089 | 3568 | 7340 | 2406 | 801 | 2175 | 1.0e−228 |

Description
pir:[LN:G70027] [AC:G70027] [PN:conserved hypothetical protein yvaJ] [GN:yvaJ] [CL:virulence-associated protein vacB homolog] [OR:*Bacillus subtilis*] [DB:pir2] >gp:[GI:e1186049:g2635874] [LN:BSUB0018] [AC:Z99121:AL009126] [GN:yvaJ] [FN:unknown] [OR:*Bacillus subtilis*] [DB:genpept-bct1] [DE:*Bacillus subtilis* complete genome (section 18 of 21): from 3399551 to 3609060.] [NT:similar to hypothetical proteins] [LE:51375] [RE:53714] [DI:complement]

| ORF Name | NT ID | AA ID | NT LN | AA LN | Score | P-Value |
| --- | --- | --- | --- | --- | --- | --- |
| AI7503001001__34645311__f3__867 | 3569 | 7341 | 525 | 174 | 186 | 1.4e−14 |

Description
gp:[GI:g4981094] [LN:AE001732] [AC:AE001732:AE000512] [PN:conserved hypothetical protein] [GN:TM0577] [OR:*Thermotoga maritima*] [DB:genpept-bct2] [DE:*Thermotoga maritima* section 44 of 136 of the complete genome.] [NT:similar to SP:P46854 PID:606376 GB:U00096] [LE:9820] [RE:10359] [DI:complement]

| ORF Name | NT ID | AA ID | NT LN | AA LN | Score | P-Value |
| --- | --- | --- | --- | --- | --- | --- |
| AI7503001001__3518__f2__375 | 3570 | 7342 | 159 | 52 | | |

Description
NO-HIT

| ORF Name | NT ID | AA ID | NT LN | AA LN | Score | P-Value |
| --- | --- | --- | --- | --- | --- | --- |
| AI7503001001__35422880__c2__1228 | 3571 | 7343 | 129 | 42 | | |

Description
NO-HIT

| ORF Name | NT ID | AA ID | NT LN | AA LN | Score | P-Value |
| --- | --- | --- | --- | --- | --- | --- |
| AI7503001001__35444127__f2__443 | 3572 | 7344 | 663 | 220 | 514 | 2.5e−49 |

-continued

Description
sp:[LN:YVYE_BACSU] [AC:P32437:P96500] [GN:YVYE:YVHK] [OR:*BACILLUS SUBTILIS*]
[DE:HYPOTHETICAL 24.8 KD PROTEIN IN DEGS-TAGO INTERGENIC REGION]
[SP:P32437:P96500] [DB:swissprot] >pir:[LN:A70049] [AC:A70049:A30191]
[PN:conserved hypothetical protein yvyE] [GN:yvyE] [CL:hypothetical protein
HI0722] [OR:*Bacillus subtilis*] [DB:pir2] >gp:[GI:e1184457:g2636077]
[LN:BSUB0019] [AC:Z99122:AL009126] [GN:yvyE] [FN:unknown] [OR:*Bacillus
subtilis*] [DB:genpept-bct1] [DE:*Bacillus subtilis* complete genome (section
19 of 21):from 3597091 to 3809700.] [NT:alternate gene name:yvhK; similar
to hypothetical] [SP:P32437] [LE:48723] [RE:49376] [DI:direct]
>gp:[GI:g1762328] [LN:BSU56901] [AC:U56901] [PN:Ycr59c/YigZ homolog]
[GN:yvhK] [OR:*Bacillus subtilis*] [DB:genpept-bct2] [DE:*Bacillus subtilis*
putative transcriptional regulator (yvhJ), Ycr59c/YigZ homolog (yvhK),
histidine kinase (degS), transcriptional regulator of degradation enzyme
(degU), (degV), (comFA), (comFB), (comFC), flagellar protein (yviB), negative
regulator of flagellin (flgM), flagellar protein (yviC), flagellar-hook
associated protein1 (flgK), flagellar-hook associated protein 3 (flgL),
(yviE), transmembrane protein (yviF), (csrA), flagellin (hag),
flagellar protein (yviH), flagellar hook-associated protein 2
(fliD), flagellar protein (fliS), flagellar protein (fliT), sigma-54 modulator
homolog (yviI), and (secA) genes, complete cds.] [LE:1217] [RE:1870]
[DI:complement] >gp:[GI:e1184457:g2636077] [LN:BSUB0019]
[AC:Z99122:AL009126] [GN:yvyE] [FN:unknown] [OR:*Bacillus subtilis*]
[DB:genpept] [DE:*Bacillus subtilis* complete genome (section 19 of 21):from
3597091 to 3809700.] [NT:alternate gene name:yvhK; similar to hypothetical]
[SP:P32437] [LE:48723] [RE:49376] [DI:direct]

| ORF Name | NT ID | AA ID | NT LN | AA LN | Score | P-Value |
|---|---|---|---|---|---|---|
| AI7503001001_35945277_c3_1463 | 3573 | 7345 | 1065 | 354 | 1275 | 5.8e−130 |

Description
sp:[LN:RF2_BACSU] [AC:P28367:O34444] [GN:PRFB] [OR:*BACILLUS SUBTILIS*]
[DE:PEPTIDE CHAIN RELEASE FACTOR 2 (RF-2)] [SP:P28367:O34444] [DB:swissprot]
>pir:[LN:JN0146] [AC:H69681:JN0146] [PN:translation releasing factor
RF-2:peptide chain release factor 2:prfB] [GN:prfB] [CL:translation
releasing factor] [OR:*Bacillus subtilis*] [DB:pir1]
>gp:[GI:e1184435:g2636055] [LN:BSUB0019] [AC:Z99122:AL009126] [PN:peptide
chain release factor 2] [GN:prfB] [OR:*Bacillus subtilis*] [DB:genpept-bct1]
[DE:*Bacillus subtilis* complete genome (section 19 of 21):from 3597091 to
3809700.] [SP:P28367] [LE:29109:30139] [RE:30137:30210] [DI:complementJoin]
>gp:[GI:g2331287] [LN:AF013188] [AC:AF013188] [PN:release factor 2]
[GN:prfB] [OR:*Bacillus subtilis*] [DB:genpept-bct2] [DE:*Bacillus subtilis*
release factor 2 (prfB) gene, complete cds.] [NT:orf3; naturally occurring
frame-shift] [LE:75:148] [RE:146:1176] [DI:directJoin] >gp:[GI:g2618874]
[LN:AF017113] [AC:AF017113] [PN:putative peptide chain release factor RF-2]
[GN:prfB] [OR:*Bacillus subtilis*] [DB:genpept-bct2] [DE:*Bacillus subtilis*
300–304 degree genomic sequence.] [LE:83:156] [RE:154:1184] [DI:directJoin]
>gp:[GI:e1184435:g2636055] [LN:BSUB0019] [AC:Z99122:AL009126] [PN:peptide
chain release factor 2] [GN:prfB] [OR:*Bacillus subtilis*] [DB:genpept]
[DE:*Bacillus subtilis* complete genome (section 19 of 21):from 3597091 to
3809700.] [SP:P28367] [LE:29109:30139] [RE:30137:30210] [DI:complementJoin]

| ORF Name | NT ID | AA ID | NT LN | AA LN | Score | P-Value |
|---|---|---|---|---|---|---|
| AI7503001001_35988961_f2_376 | 3574 | 7346 | 129 | 42 | | |

Description
NO-HIT

| ORF Name | NT ID | AA ID | NT LN | AA LN | Score | P-Value |
|---|---|---|---|---|---|---|
| AI7503001001_36131311_c3_1455 | 3575 | 7347 | 696 | 231 | 194 | 2.1e−15 |

Description
gp:[GI:g451867] [LN:BACFLGMK] [AC:L14437] [OR:*Bacillus subtilis*]
[SR:*Bacillus subtilis* (strain W168) [library:lambda gtWES library]
[DB:genpept-bct1] [DE:*Bacillus subtilis* (clones pDM116 and pDM113] flagellin
synthesis regulatory protein [flgM] and flagellar hook-filament
junction protein [flgK] genes and orf139, orf160, orfx, complete cds's.]
[NT:in Z18629, ORFX is called comForf3; ORFX; putative] [LE:<1] [RE:754]
[DI:direct]

| ORF Name | NT ID | AA ID | NT LN | AA LN | Score | P-Value |
|---|---|---|---|---|---|---|
| AI7503001001_36133385_c3_1377 | 3576 | 7348 | 681 | 226 | 203 | 2.3e−16 |

Description
pir:[LN:G69798] [AC:G69798] [PN:hypothetical protein yetJ] [GN:yetJ]
[CL:hypothetical protein yetJ] [OR:*Bacillus subtilis*] [DB:pir2]

-continued

>gp:[GI:e1182699:g2633033] [LN:BSUB0004] [AC:Z99107:AL009126] [GN:yetJ]
[FN:unknown] [OR:*Bacillus subtilis*] [DB:genpept-bct1] [DE:*Bacillus subtilis*
complete genome (section 4 of 21):from 600701 to 813890.] [LE:186800]
[RE:187444] [DI:direct]

| ORF Name | NT ID | AA ID | NT LN | AA LN | Score | P-Value |
|---|---|---|---|---|---|---|
| AI7503001001__36229676__c1__936 | 3577 | 7349 | 795 | 264 | 238 | 4.5e−20 |

Description
gp:[GI:g3172115] [LN:ACCPCAOP]
[AC:L05770:U04359:M33798:U20284:U11554:L13114:L03407] [PN:beta-ketoadipate
enol-lactone hydrolase] [GN:pcaD] [OR:*Acinetobacter* sp. ADP1]
[DB:genpept-bct2] [EC:3.1.1.24] [DE:*Acinetobacter* sp. ADP1 pca-qui-pob
supraoperonic cluster, complete sequence.] [NT:ELH] [LE:6843] [RE:7643]
[DI:direct]

| ORF Name | NT ID | AA ID | NT LN | AA LN | Score | P-Value |
|---|---|---|---|---|---|---|
| AI7503001001__36230252__c1__1000 | 3578 | 7350 | 777 | 258 | 480 | 1.0e−45 |

Description
pir:[LN:B69627] [AC:B69627] [PN:transcription repressor of fructose operon
fruR] [GN:fruR] [CL:regulatory protein gutR] [OR:*Bacillus subtilis*]
[DB:pir2] >gp:[GI:e1185028:g2633809] [LN:BSUB0008] [AC:Z99111:AL009126]
[PN:transcriptional regulator (DeoR family)] [GN:fruR] [FN:negative
regulation of the fructose operon] OR:*Bacillus subtilis*] [DB:genpept-bct1]
[DE:*Bacillus subtilis* complete genome (section 8 of 21):from 1394791 to
1603020.] [LE:112193] [RE:112948] [DI:direct] >gp:[GI:g3282123]
[LN:AF012285] [AC:AF012285:AF012284:U51911] [PN:FruR] [GN:fruR] [OR:*Bacillus
subtilis*] [DB:genpept-bct2] [DE:*Bacillus subtilis* mobA-nprE gene region.]
[NT:similar to *L. lactis* lactose PTS system repressor,] [LE:12681]
[RE:13436] [DI:direct]

| ORF Name | NT ID | AA ID | NT LN | AA LN | Score | P-Value |
|---|---|---|---|---|---|---|
| AI7503001001__36367302__c3__1330 | 3579 | 7351 | 564 | 187 | 122 | 2.7e−06 |

Description
sp:[LN:Y359__METJA] [AC:Q57805] [GN:MJ0359] [OR:*METHANOCOCCUS JANNASCHII*]
[DE:HYPOTHETICAL PROTEIN MJ0359] [SP:Q57805] [DB:swissprot] >pir:[LN:G64344]
[AC:G64344] [PN:hypothetical protein MJ0359] [OR:*Methanococcus jannaschii*]
[DB:pir2] [MP:REV327449-326805] >gp:[GI:g1591068] [LN:U67489]
[AC:U67489:L77117] [PN:*M. jannaschii* predicted coding region MJ0359]
[GN:MJ0359] [OR:*Methanococcus jannaschii*] [DB:genpept-bct2]
[DE:*Methanococcus jannaschii* section 31 of 150 of the complete genome.]
[NT:hypothetical protein; identified by GeneMark;] [LE:2497] [RE:3141]
[DI:complement]

| ORF Name | NT ID | AA ID | NT LN | AA LN | Score | P-Value |
|---|---|---|---|---|---|---|
| AI7503001001__336563__c2__1302 | 3580 | 7352 | 1074 | 357 | 908 | 4.5e−91 |

Description
pir:[LN:D70020] [AC:D70020] [PN:ABC transporter (ATP-binding protein)
homolog yusC] [GN:yusC] [CL:ATP-binding cassette homology] [OR:*Bacillus
subtilis*] [DB:pir2] >gp:[GI:e1184353:g2635771] [LN:BSUB0017]
[AC:Z99120:AL009126] [GN:yusC] [FN:unknown] [OR:*Bacillus subtilis*]
[DB:genpept-bct1] [DE:*Bacillus subtilis* complete genome (section 17 of 21):
from 3197001 to 3414420.] [NT:similar to ABC transporter (ATP-binding
protein)] LE:165325] [RE:166350] [DI:complement]

| ORF Name | NT ID | AA ID | NT LN | AA LN | Score | P-Value |
|---|---|---|---|---|---|---|
| AI7503001001__36601562__c3__1403 | 3581 | 7353 | 1182 | 393 | 1669 | 1.0e−171 |

Description
sp:[LN:NORA__STAAU] [AC:P21191] [GN:NORA] [OR:*STAPHYLOCOCCUS AUREUS*]
[DE:QUINOLONE RESISTANCE NORA PROTEIN] [SP:P21191] [DB:swissprot]
>pir:[LN:A37838] [AC:A37838] [PN:norA protein] [OR:*Staphylococcus aureus*]
[DB:pir2] >gp:[GI:d1014850:g216975] [LN:STANORA] [AC:D90119] [PN:ORF for
norA] [GN:norA] [OR:*Staphylococcus aureus*] [SR:*Staphylococcus aureus* (strain
TK2566) genomic DNA] [DB:genpept-bct1] [DE:*S. aureus* norA gene.] [LE:478]
[RE:1644] [DI:direct]

| ORF Name | NT ID | AA ID | NT LN | AA LN | Score | P-Value |
|---|---|---|---|---|---|---|
| AI7503001001__37927__f1__282 | 3582 | 7354 | 123 | 40 | | |

-continued

| Description |
|---|
| NO-HIT |

| ORF Name | NT ID | AA ID | NT LN | AA LN | Score | P-Value |
|---|---|---|---|---|---|---|
| AI7503001001_391527_f3_880 | 3583 | 7355 | 930 | 309 | 700 | 4.9e−69 |

Description
sp:[LN:TAGH_BACSU] [AC:P42954] [GN:TAGH] [OR:*BACILLUS SUBTILIS*] [DE:TEICHOIC
ACID TRANSLOCATION ATP-BINDING PROTEIN TAGH] [SP:P42954] [DB:swissprot]
>pir:[LN:S69203] [AC:S69203:A69721] [PN:teichoic acid translocation
ATP-binding protein tagH] [GN:tagH] [CL:ATP-binding cassette homology]
[OR:*Bacillus subtilis*] [DB:pir2] >gp:[GI:g755153] [LN:BSU13832] [AC:U13832]
[PN:ATP-binding protein] [GN:tagH] [FN:teichoic acid translocation]
[OR:*Bacillus subtilis*] [DB:genpept-bct1] [DE:*Bacillus subtilis* 168 highly
hydrophobic integral membrane protein[tagG] gene and ATP-binding protein
(tagH) gene, complete cds.] [LE:1134] [RE:2717] [DI:direct]
>gp:[GI:e1184476:g2636096] [LN:BSUB0019] [AC:Z99122:AL009126]
[PN:ATP-binding protein] [GN:tagH] [FN:teichoic acid translocation]
[OR:*Bacillus subtilis*] [DB:genpept-bct1] [DE:*Bacillus subtilis* complete
genome (section 19 of 21):from 3597091 to 3809700.] [SP:P42954] [LE:75534]
[RE:77117] [DI:complement] >gp:[GI:e1184476:g2636096] [LN:BSUB0019]
[AC:Z99122:AL009126] [PN:ATP-binding protein] [GN:tagH] [FN:teichoic acid
translocation] [OR:*Bacillus subtilis*] [DB:genpept] [DE:*Bacillus subtilis*
complete genome (section 19 of 21):from 3597091 to 3809700.] [SP:P42954]
[LE:75534] [RE:77117] [DI:complement]

| ORF Name | NT ID | AA ID | NT LN | AA LN | Score | P-Value |
|---|---|---|---|---|---|---|
| AI7503001001_3922550_f1_67 | 3584 | 7356 | 138 | 45 | | |

| Description |
|---|
| NO-HIT |

| ORF Name | NT ID | AA ID | NT LN | AA LN | Score | P-Value |
|---|---|---|---|---|---|---|
| AI7503001001_3928762_f2_369 | 3585 | 7357 | 1368 | 455 | 839 | 9.2e−84 |

Description
pir:[LN:B70007] [AC:B70007] [PN:Na+−transporting ATP synthase homolog yubG]
[GN:yubG] [CL:Na+−ATP synthase chain J] [OR:*Bacillus subtilis*] [DB:pir2]
>gp:[GI:e1185983:g2635594] [LN:BSUB0016] [AC:Z99119:AL009126] [GN:yubG]
[FN:unknown] [OR:*Bacillus subtilis*] [DB:genpept-bct1] [DE:*Bacillus subtilis*
complete genome (section 16 of 21):from 2997771 to 3213410.] [NT:similar to
Na+−transporting ATP synthase] [LE:190389] [RE:191726] [DI:direct]

| ORF Name | NT ID | AA ID | NT LN | AA LN | Score | P-Value |
|---|---|---|---|---|---|---|
| AI7503001001_3939218_c1_922 | 3586 | 7358 | 135 | 44 | | |

| Description |
|---|
| NO-HIT |

| ORF Name | NT ID | AA ID | NT LN | AA LN | Score | P-Value |
|---|---|---|---|---|---|---|
| AI7503001001_3942263_c3_1381 | 3587 | 7359 | 726 | 241 | 913 | 1.3e−91 |

Description
pir:[LN:C69793] [AC:C69793] [PN:conserved hypothetical protein yeeI]
[GN:yeeI] [CL:hypothetical protein MG332] [OR:*Bacillus subtilis*] [DB:pir2]
>gp:[GI:e1182664:g2632998] [LN:BSUB0004] [AC:Z99107:AL009126] [GN:yeeI]
[FN:unknown] [OR:*Bacillus subtilis*] [DB:genpept-bct1] [DE:*Bacillus subtilis*
complete genome (section 4 of 21):from 600701 to 813890.] [NT:similar to
hypothetical proteins] [LE:151216] [RE:151938] [DI:direct]

| ORF Name | NT ID | AA ID | NT LN | AA LN | Score | P-Value |
|---|---|---|---|---|---|---|
| AI7503001001_3944001_c1_1130 | 3588 | 7360 | 1524 | 507 | 684 | 2.4e−67 |

Description
pir:[LN:F70012] [AC:F70012] [PN:leucyl aminopeptidase homolog yuiE]
[GN:yuiE] [CL:cytosol aminopeptidase] [OR:*Bacillus subtilis*] [DB:pir2]
>gp:[GI:e1184284:g2635702] [LN:BSUB0017] [AC:Z99120:AL009126] [GN:yuiE]
[FN:unknown] [OR:*Bacillus subtilis*] [DB:genpept-bct1] [DE:*Bacillus subtilis*
complete genome (section 17 of 21):from 3197001 to 3414420.] [NT:similar to
leucyl aminopeptidase] [LE:98474] [RE:99976] [DI:complement]

| ORF Name | NT ID | AA ID | NT LN | AA LN | Score | P-Value |
|---|---|---|---|---|---|---|
| AI7503001001_3948587_f2_340 | 3589 | 7361 | 873 | 290 | 378 | 6.5e−35 |

Description

-continued gp:[GI:g4980658] [LN:AE001701] [AC:AE001701:AE000512] [PN:conserved
hypothetical protein] [GN:TM0164] [OR:*Thermotoga maritima*] [DB:genpept-bct2]
[DE:*Thermotoga maritima* section 13 of 136 of the complete genome.]
[NT:similar to GB:AE000666 percent identity:61.11;] [LE:9393] [RE:10187]
[DI:direct]

| ORF Name | NT ID | AA ID | NT LN | AA LN | Score | P-Value |
|---|---|---|---|---|---|---|
| AI7503001001__3953452__c2__1201 | 3590 | 7362 | 507 | 168 | 328 | 1.3e−29 |

Description
pir:[LN:D69849] [AC:D69849] [PN:transcription regulation homolog yjdI]
[GN:yjdI] [CL:conserved hypothetical protein HI1434] [OR:*Bacillus subtilis*]
[DB:pir2] >gp:[GI:e1183226:g2633560] [LN:BSUB0007] [AC:Z99110:AL009126]
[GN:yjdI] [FN:unknown] [OR:*Bacillus subtilis*] [DB:genpept-bct1] [DE:*Bacillus subtilis* complete genome (section 7 of 21):from 1194391 to 1411140.]
[NT:similar to transcription regulation] [LE:82766] [RE:83245] [DI:direct]

| ORF Name | NT ID | AA ID | NT LN | AA LN | Score | P-Value |
|---|---|---|---|---|---|---|
| AI7503001001__3955067__c2__1278 | 3591 | 7363 | 126 | 41 | | |

Description
NO-HIT

| ORF Name | NT ID | AA ID | NT LN | AA LN | Score | P-Value |
|---|---|---|---|---|---|---|
| AI7503001001__3959377__f3__886 | 3592 | 7364 | 126 | 41 | 149 | 1.7e−10 |

Description
gp:[GI:e255528:g1617429] [LN:SEABCTS] [AC:X99127] [PN:membrane protein]
[FN:iron repressible ABC transport system] [OR:*Staphylococcus epidermidis*]
[DB:genpept-bct1] [DE:*S. epidermidis* gene encoding ABC transport system.]
[LE:878] [RE:1624] [DI:direct]

| ORF Name | NT ID | AA ID | NT LN | AA LN | Score | P-Value |
|---|---|---|---|---|---|---|
| AI7503001001__3962915__f2__507 | 3593 | 7365 | 627 | 208 | 139 | 1.1e−08 |

Description
pir:[LN:C71375] [AC:C71375] [PN:conserved hypothetical integral membrane
protein TP0033] [GN:TP0033] [OR:*Treponema pallidum* subsp. *pallidum*] [SR:,
syphilis spirochete] [DB:pir2] >gp:[GI:g3322288] [LN:AE001188]
[AC:AE001188:AE000520] [PN:conserved hypothetical integral membrane]
[GN:TP0033] [OR:*Treponema pallidum*] [DB:genpept-bct2] [DE:*Treponema pallidum*
section 4 of 87 of the complete genome.] [NT:similar to PID:1001613
PID:1001643 percent] [LE:7016] [RE:7627] [DI:complement]

| ORF Name | NT ID | AA ID | NT LN | AA LN | Score | P-Value |
|---|---|---|---|---|---|---|
| AI7503001001__39818__f2__530 | 3594 | 7366 | 240 | 79 | 234 | 1.2e−19 |

Description
gp:[GI:g1575061] [LN:SAU57060] [AC:U57060] [PN:ScdA] [GN:scdA]
[OR:*Staphylococcus aureus*] [DB:genpept-bct1] [DE:*Staphylococcus aureus* scdA
gene, complete cds.] [NT:*S. aureus* cells containing a scdA disruption have]
[LE:361] [RE:1035] [DI:direct]

| ORF Name | NT ID | AA ID | NT LN | AA LN | Score | P-Value |
|---|---|---|---|---|---|---|
| AI7503001001__3994027__f1__193 | 3595 | 7367 | 141 | 46 | | |

Description
NO-HIT

| ORF Name | NT ID | AA ID | NT LN | AA LN | Score | P-Value |
|---|---|---|---|---|---|---|
| AI7503001001__4023518__f2__400 | 3596 | 7368 | 909 | 302 | 579 | 3.3e−56 |

Description
pir:[LN:G69800] [AC:G69800] [PN:cell-division inhibitor homolog yfhF]
[GN:yfhF] [CL:cell division inhibitor yfhF] [OR:*Bacillus subtilis*]
[DB:pir2] >gp:[GI:e1182841:g2633175] [LN:BSUB0005] [AC:Z99108:AL009126]
[GN:yfhF] [FN:unknown] [OR:*Bacillus subtilis*] [DB:genpept-bct1] [DE:*Bacillus subtilis* complete genome (section 5 of 21):from 802821 to 1011250.]
[NT:similar to cell-division inhibitor] [LE:121320] [RE:122231]
[DI:complement] >gp:[GI:d1025388:g2804536] [LN:D85082] [AC:D85082] [PN:YfhF]
[OR:*Bacillus subtilis*] [SR:*Bacillus subtilis* DNA] [DB:genpept-bct1]
[DE:*Bacillus subtilis* DNA, genome sequence, 79 to 81 degree region.]

-continued

[LE:14211] [RE:15122] [DI:complement]

| ORF Name | NT ID | AA ID | NT LN | AA LN | Score | P-Value |
|---|---|---|---|---|---|---|
| AI7503001001_4036093_c3_1384 | 3597 | 7369 | 864 | 287 | 461 | 1.0e-43 |

Description
pir:[LN:B69866] [AC:B69866] [PN:transcription regulator LysR family homolog ykuM] [GN:ykuM] [OR:*Bacillus subtilis*] [DB:pir2] >gp:[GI:e1181918:g2632234] [LN:BS16829KB] [AC:AJ222587] [PN:YkuM protein] [GN:ykuM] [OR:*Bacillus subtilis*] [DB:genpept-bct1] [DE:*Bacillus subtilis* 29 kB DNA fragment from ykwC gene to cse15 gene.] [NT:homologous to LysR type transcriptional regulators] [LE:20403] [RE:21284] [DI:direct] >gp:[GI:e1185004:g2633785] [LN:BSUB0008] [AC:Z99111:AL009126] [GN:ykuM] [FN:unknown] [OR:*Bacillus subtilis*] [DB:genpept-bct1] [DE:*Bacillus subtilis* complete genome (section 8 of 21):from 1394791 to 1603020.] [NT:similar to transcriptional regulator (LysR family)] [LE:90659] [RE:91540] [DI:direct]

| ORF Name | NT ID | AA ID | NT LN | AA LN | Score | P-Value |
|---|---|---|---|---|---|---|
| AI7503001001_4072006_f3_845 | 3598 | 7370 | 201 | 66 | | |

Description
NO-HIT

| ORF Name | NT ID | AA ID | NT LN | AA LN | Score | P-Value |
|---|---|---|---|---|---|---|
| AI7503001001_4095055_f2_463 | 3599 | 7371 | 894 | 297 | 512 | 4.2e-49 |

Description
pir:[LN:B71256] [AC:B71256] [PN:conserved hypothetical integral membrane protein TP0986] [GN:TP0986] [OR:*Treponema pallidum* subsp. *pallidum*] [SR:, syphilis spirochete] [DB:pir2] >gp:[GI:g3323311] [LN:AE001266] [AC:AE001266 :AE000520] [PN:conserved hypothetical integral membrane] [GN:TP0986] [OR:*Treponema pallidum*] [DB:genpept-bct2] [DE:*Treponema pallidum* section 82 of 87 of the complete genome.] [NT:similar to GB:AE000511 PID:2314395 percent] [LE:1967] [RE:2851] [DI:direct]

| ORF Name | NT ID | AA ID | NT LN | AA LN | Score | P-Value |
|---|---|---|---|---|---|---|
| AI7503001001_4096093_c3_1496 | 3600 | 7372 | 354 | 117 | 155 | 2.8e-11 |

Description
pir:[LN:B42573] [AC:B42573] [PN:urf120] [OR:*Paracoccus denitrificans*] [DB:pir2]

| ORF Name | NT ID | AA ID | NT LN | AA LN | Score | P-Value |
|---|---|---|---|---|---|---|
| AI7503001001_4100093_c3_1419 | 3601 | 7373 | 1161 | 386 | 489 | 1.1e-46 |

Description
pir:[LN:E64556] [AC:E64556] [PN:para-aminobenzoate synthetase] [OR:*Helicobacter pylori*] [DB:pir2] >gp:[GI:g2313385] [LN:AE000547] [AC:AE000547:AE000511] [PN:para-aminobenzoate synthetase (pabB)] [GN:HP0293] [OR:*Helicobacter pylori* 26695] [DB:genpept-bct2] [DE:*Helicobacter pylori* 26695 section 25 of 134 of the complete genome.] [NT:similar to GB:K02673 SP:P05041 GB:U07748 GB:U07749] [LE:20379] [RE:22058] [DI:direct]

| ORF Name | NT ID | AA ID | NT LN | AA LN | Score | P-Value |
|---|---|---|---|---|---|---|
| AI7503001001_4101643_c2_1314 | 3602 | 7374 | 399 | 132 | 304 | 4.5e-27 |

Description
pir:[LN:F70023] [AC:F70023] [PN:hypothetical protein yutD] [GN:yutD] [OR:*Bacillus subtilis*] [DB:pir2] >gp:[GI:e1184310:g2635728] [LN:BSUB0017] [AC:Z99120:AL009126] [GN:yutD] [FN:unknown] [OR:*Bacillus subtilis*] [DB:genpept-bct1] [DE:*Bacillus subtilis* complete genome (section 17 of 21): from 3197001 to 3414420.] [LE:121344] [RE:121652] [DI:complement]

| ORF Name | NT ID | AA ID | NT LN | AA LN | Score | P-Value |
|---|---|---|---|---|---|---|
| AI7503001001_4103393_c2_1215 | 3603 | 7375 | 597 | 198 | 436 | 4.7e-41 |

Description
sp:[LN:PABA_SALTY] [AC:P06193] [GN:PABA] OR:*SALMONELLA TYPHIMURIUM*] [EC:4.1.3.—] [DE:(EC 4.1.3.—) (ADC SYNTHASE)] [SP:P06193] [DB:swissprot] >pir:[LN:S09636] [AC:S09636] [PN:pabA protein] [GN:pabA] [CL:glutamine amidotransferase trpG homology] [OR:*Salmonella typhimurium*] [DB:pir2] >gp:[GI:g47816] [LN:STPABA] [AC:X02603] [OR:*Salmonella typhimurium*]

-continued

[DB:genpept-bct1] [DE:*Salmonella typhimurium* pabA gene for
para-aminobenzoate synthase glutamine amidotransferase.] [NT:pabA gene
product (aa 1–187)] [SP:P06193] [LE:1] [RE:564] [DI:direct] >gp:[GI:g154228]
[LN:STYPABAA] [AC:M32355] [OR:*Salmonella typhimurium*] [SR:*S. typhimurium* DNA,
clone pSZD3] [DB:genpept-bct1] [DE:*S. typhimurium* glutamine amidotransferase
subunit of para-aminobenzoate synthase (pabA) and pot. cell division
proteinfic] genes, complete cds.] [NT:glutamine amidotransferase] [LE:970]
[RE:1533] [DI:direct]

| ORF Name | NT ID | AA ID | NT LN | AA LN | Score | P-Value |
| --- | --- | --- | --- | --- | --- | --- |
| AI7503001001__4110888__c3__1380 | 3604 | 7376 | 405 | 134 | 93 | 0.00010 |

Description
gp:[GI:g3283053] [LN:AF054173] [AC:AF054173] [PN:staphylococcal accessory
regulator A homolog] [GN:sarA] [OR:*Staphylococcus epidermidis*]
[DB:genpept-bct2] [DE:*Staphylococcus epidermidis* staphylococcal accessory
regulator A homolog (sarA) gene, complete cds.] [LE:887] [RE:1261]
[DI:direct]

| ORF Name | NT ID | AA ID | NT LN | AA LN | Score | P-Value |
| --- | --- | --- | --- | --- | --- | --- |
| AI7503001001__4111691__c1__1018 | 3605 | 7377 | 744 | 247 | 351 | 1.5e−31 |

Description
sp:[LN:YCSJ_BACSU] [AC:P42967] [GN:YCSJ] [OR:*BACILLUS SUBTILIS*]
[DE:HYPOTHETICAL 63.8 KD PROTEIN IN SIPU-PBPC INTERGENIC REGION] [SP:P42967]
[DB:swissprot] >pir:[LN:G69765] [AC:G69765:I39898] [PN:allophanate
hydrolase homolog ycsJ:probable urea amidolyase] [GN:ycsJ] [OR:*Bacillus
subtilis*] [DB:pir2] >gp:[GI:d1007939:g790943] [LN:BAC39R] [AC:D38161]
[PN:urea amidolyase] [OR:*Bacillus subtilis*] [SR:*Bacillus subtilis*
(strain:168TrpC2) DNA] [DB:genpept-bct1] [DE:*Bacillus subtilis* genome around
39 degrees region encoding 17 ORFs, complete cds.] [LE:10358] [RE:12094]
[DI:direct] >gp:[GI:e1182375:g2632709] [LN:BSUB0003] [AC:Z99106:AL009126]
[GN:ycsJ] [FN:unknown] [OR:*Bacillus subtilis*] [DB:genpept-bct1] [DE:*Bacillus
subtilis* complete genome (section 3 of 21):from 402751 to 611850.]
[NT:similar to allophanate hydrolase] [SP:P42967] [LE:56667] [RE:58403]
[DI:direct] >gp:[GI:d1009674:g1805477] [LN:D50453] [AC:D50453]
[PN:homologues to hypothetical protein HI1731 of H.] [GN:ycsJ] [OR:*Bacillus
subtilis*] [SR:*Bacillus subtilis* (strain:168 trpC2) DNA] [DB:genpept-bct1]
[DE:*Bacillus subtilis* DNA for 25–36 degree region containing theamyE-srfA
region, complete cds.] [LE:139065] [RE:140801] [DI:direct]

| ORF Name | NT ID | AA ID | NT LN | AA LN | Score | P-Value |
| --- | --- | --- | --- | --- | --- | --- |
| AI7503001001__4195817__c1__955 | 3606 | 7378 | 1743 | 580 | 2597 | 4.7e−270 |

Description
gp:[GI:e264711:g1262136] [LN:SAPBP4GEN] [AC:X91786] [PN:ATP-binding cassette
transporter A] [GN:abcA] [OR:*Staphylococcus aureus*] [DB:genpept-bct1]
[DE:*S. aureus* abcA, pbp4, and tagD genes.] [LE:311] [RE:2038] [DI:complement]

| ORF Name | NT ID | AA ID | NT LN | AA LN | Score | P-Value |
| --- | --- | --- | --- | --- | --- | --- |
| AI7503001001__42167__c1__959 | 3607 | 7379 | 834 | 277 | 1083 | 1.3e−109 |

Description
gp:[GI:g4928292] [LN:AF132117] [AC:AF132117] [PN:FhuA] [GN:fhuA]
[OR:*Staphylococcus aureus*] [DB:genpept-bct2] [DE:*Staphylococcus aureus*
ferrichrome uptake operon, complete sequence and unknown genes.] [NT:ATP
binding protein.] [LE:2780] [RE:3514] [DI:complement]

| ORF Name | NT ID | AA ID | NT LN | AA LN | Score | P-Value |
| --- | --- | --- | --- | --- | --- | --- |
| AI7503001001__422162__f3__795 | 3608 | 7380 | 456 | 151 | 439 | 2.2e−41 |

Description
pir:[LN:B69868] [AC:B69868] [PN:6-pyruvoyl tetrahydrobiopterin synthase
homolog ykvK] [GN:ykvK] [OR:*Bacillus subtilis*] [DB:pir2]
>gp:[GI:e1184963:g2633744] [LN:BSUB0008] [AC:Z99111:AL009126] [GN:ykvK]
[FN:unknown] [OR:*Bacillus subtilis*] [DB:genpept-bct1] [DE:*Bacillus subtilis*
complete genome (section 8 of 21):from 1394791 to 1603020.] [NT:similar to
6-pyruvoyl tetrahydrobiopterin synthase] [LE:44776] [RE:45225] [DI:direct]

| ORF Name | NT ID | AA ID | NT LN | AA LN | Score | P-Value |
| --- | --- | --- | --- | --- | --- | --- |
| AI7503001001__422800__f3__903 | 3609 | 7381 | 447 | 148 | 627 | 2.7e−61 |

Description

-continued gp:[GI:g3283053] [LN:AF054173] [AC:AF054173] [PN:staphylococcal accessory
regulator A homolog] [GN:sarA] [OR:*Staphylococcus epidermidis*]
[DB:genpept-bct2] DE:*Staphylococcus epidermidis* staphylococcal accessory
regulator A homolog (sarA) gene, complete cds.] [LE:887] [RE:1261]
[DI:direct]

| ORF Name | NT ID | AA ID | NT LN | AA LN | Score | P-Value |
|---|---|---|---|---|---|---|
| AI7503001001__425927__f1__232 | 3610 | 7382 | 144 | 47 | | |

Description
NO-HIT

| ORF Name | NT ID | AA ID | NT LN | AA LN | Score | P-Value |
|---|---|---|---|---|---|---|
| AI7503001001__429675__f2__558 | 3611 | 7383 | 216 | 71 | | |

Description
NO-HIT

| ORF Name | NT ID | AA ID | NT LN | AA LN | Score | P-Value |
|---|---|---|---|---|---|---|
| AI7503001001__4330390__c3__1517 | 3612 | 7384 | 876 | 291 | 787 | 3.0e−78 |

Description
pir:[LN:A70016] [AC:A70016] [PN:hypothetical protein yunF] [GN:yunF]
[OR:*Bacillus subtilis*] [DB:pir2] >gp:[GI:e1184318:g2635736] [LN:BSUB0017]
[AC:Z99120:AL009126] [GN:yunF] [FN:unknown] [OR:*Bacillus subtilis*]
[DB:genpept-bct1] [DE:*Bacillus subtilis* complete genome (section 17 of 21):
from 3197001 to 3414420.] [LE:127975] [RE:128829] [DI:complement]

| ORF Name | NT ID | AA ID | NT LN | AA LN | Score | P-Value |
|---|---|---|---|---|---|---|
| AI7503001001__4351465__c2__1159 | 3613 | 7385 | 129 | 42 | | |

Description
NO-HIT

| ORF Name | NT ID | AA ID | NT LN | AA LN | Score | P-Value |
|---|---|---|---|---|---|---|
| AI7503001001__4461693__f2__596 | 3614 | 7386 | 240 | 79 | | |

Description
NO-HIT

| ORF Name | NT ID | AA ID | NT LN | AA LN | Score | P-Value |
|---|---|---|---|---|---|---|
| AI7503001001__4487588__f3__797 | 3615 | 7387 | 609 | 202 | 81 | 0.00094 |

Description
pir:[LN:B69478] [AC:B69478] [PN:NADH dehydrogenase (ubiquinone),, 43.2 kDa
subunit homolog] [OR:*Archaeoglobus fulgidus*] [EC:1.6.5.3] [DB:pir2]
>gp:[GI:g2648717] [LN:AE000976] [AC:AE000976:AE000782] [PN:F420H2:quinone
oxidoreductase, 43.2 kDa subunit,] [GN:AF1827] [OR:*Archaeoglobus fulgidus*]
[DB:genpept-bct2] [DE:*Archaeoglobus fulgidus* section 131 of 172 of the
complete genome.] [NT:similar to PID:882405 SP:P50973 percent identity:]
[LE:4241] [RE:5455] [DI:direct]

| ORF Name | NT ID | AA ID | NT LN | AA LN | Score | P-Value |
|---|---|---|---|---|---|---|
| AI7503001001__4501250__c1__1097 | 3616 | 7388 | 1080 | 359 | 871 | 3.7e−87 |

Description
gp:[GI:d1020364:g1944409] [LN:D87026] [AC:D87026:D28136] [PN:membrane
protein] [OR:*Bacillus stearothermophilus*] [SR:*Bacillus stearothermophilus*
(strain:TRBE14) DNA] [DB:genpept-bct1] [DE:*Bacillus stearothermophilus*
glycogen operon genes, complete cds.] [NT:The ORF is similar to the
Alkaligenes eutrophus] [LE:144] [RE:1097] [DI:complement]

| ORF Name | NT ID | AA ID | NT LN | AA LN | Score | P-Value |
|---|---|---|---|---|---|---|
| AI7503001001__4511550__c2__1247 | 3617 | 7389 | 1278 | 425 | 318 | 1.5e−28 |

Description
sp:[LN:YHAD_*ECOLI*] [AC:P23524] [GN:YHAD] [OR:*ESCHERICHIA COLI*]
[DE:HYPOTHETICAL 39.1 KD PROTEIN IN RNPB-SOHA INTERGENIC REGION (ORF 3)]
[SP:P23524] [DB:swissprot]

-continued

| ORF Name | NT ID | AA ID | NT LN | AA LN | Score | P-Value |
|---|---|---|---|---|---|---|
| AI7503001001_4535652_f1_255 | 3618 | 7390 | 225 | 74 | | |

Description
NO-HIT

| ORF Name | NT ID | AA ID | NT LN | AA LN | Score | P-Value |
|---|---|---|---|---|---|---|
| AI7503001001_4539143_c1_1066 | 3619 | 7391 | 942 | 313 | 970 | 1.2e−97 |

Description
sp:[LN:HPRK_BACSU] [AC:O34483] [GN:PTSK] [OR:*BACILLUS SUBTILIS*] [EC:2.7.1.—]
[DE:HPR(SER) KINASE,] [SP:O34483] [DB:swissprot]

| ORF Name | NT ID | AA ID | NT LN | AA LN | Score | P-Value |
|---|---|---|---|---|---|---|
| AI7503001001_4578956_f1_101 | 3620 | 7392 | 297 | 98 | 79 | 0.021 |

Description
gp:[GI:e1350598:g3881046] [LN:CEY51A2D] [AC:AL021497] [GN:Y51A2D.12]
[OR:*Caenorhabditis elegans*] [DB:genpept-inv1] [DE:*Caenorhabditis elegans*
cosmid Y51A2D, complete sequence.] [LE:83074:83534:84872]
[RE:83208:83768:84978] [DI:complementJoin]

| ORF Name | NT ID | AA ID | NT LN | AA LN | Score | P-Value |
|---|---|---|---|---|---|---|
| AI7503001001_4687843_c2_1324 | 3621 | 7393 | 330 | 109 | 242 | 1.7e−20 |

Description
pir:[LN:C70026] [AC:C70026] [PN:hypothetical protein yuzD] [GN:yuzD]
[OR:*Bacillus subtilis*] [DB:pir2] >gp:[GI:e1184300:g2635718] [LN:BSUB0017]
[AC:Z99120:AL009126] [GN:yuzD] [FN:unknown] [OR:*Bacillus subtilis*]
[DB:genpept-bct1] [DE:*Bacillus subtilis* complete genome (section 17 of 21):
from 3197001 to 3414420.] [LE:112018] [RE:112344] [DI:complement]

| ORF Name | NT ID | AA ID | NT LN | AA LN | Score | P-Value |
|---|---|---|---|---|---|---|
| AI7503001001_4689077_c2_1271 | 3622 | 7394 | 333 | 110 | 466 | 3.1e−44 |

Description
sp:[LN:CLPP_BACSU] [AC:P80244:O08433] [GN:CLPP] [OR:*BACILLUS SUBTILIS*]
[EC:3.4.21.92] [DE:(ENDOPEPTIDASE CLP) (CASEINOLYTIC PROTEASE) (PROTEASE
TI)] [SP:P80244:O08433] [DB:swissprot] >pir:[LN:B69601] [AC:B69601:A47683]
[PN:ATP-dependent clp proteinase, chain P:stress protein G7] CGN:clpP]
[CL:ATP-dependent Clp proteinase chain P] [OR:*Bacillus subtilis*]
[EC:3.4.21.—] [DB:pir2] >gp:[GI:e1186142:g2635967] [LN:BSUB0018]
[AC:Z99121:AL009126] [PN:ATP-dependent Clp protease proteolytic subunit]
[GN:clpP] [OR:*Bacillus subtilis*] [DB:genpept-bct1] [EC:3.4.21.92]
[DE:*Bacillus subtilis* complete genome (section 18 of 21):from 3399551 to
3609060.] [NT:alternate gene name:yvdN] [SP:P80244] [LE:145744] [RE:146337]
[DI:direct] >gp:[GI:e313044:g1945673] [LN:BSZ94043] [AC:Z94043]
[PN:hypothetical protein] [GN:yvdN] [OR:*Bacillus subtilis*] [DB:genpept-bct1]
[DE:*B. subtilis* genomic DNA fragment (88 kb).] [NT:similar to CLPP_*ECOLI*
ATP-dependent clp protease] [SP:P80244] [LE:35334] [RE:35927]
[DI:complement] >gp:[GI:g2668494] [LN:BSU59754] [AC:U59754] [PN:ClpP]
[GN:clpP] [OR:*Bacillus subtilis*] [DB:genpept-bct2] [DE:*Bacillus subtilis* Clp
protease proteolytic component (clpP) gene, complete cds.] [NT:proteolytic
component of Clp protease] [LE:140] [RE:733] [DI:direct]

| ORF Name | NT ID | AA ID | NT LN | AA LN | Score | P-Value |
|---|---|---|---|---|---|---|
| AI7503001001_4689130_f2_614 | 3623 | 7395 | 306 | 101 | 81 | 0.029 |

Description
pir:[LN:A58932] [AC:A58932] [PN:cytochrome C-type biogenesis protein CCMF]
[GN:yejR:ccmF] [OR:*mitochondrion Cyanidioschyzon merolae*] [DB:pir2]
>gp:[GI:d1037513:g4115789] [LN:D89861] [AC:D89861] [PN:cytochrome C-type
biogenesis protein CCMF] [GN:yejR or ccmF] [OR:*Mitochondrion Cyanidioschyzon
merolae*] [SR:*Cyanidioschyzon merolae* (strain:10D) mitochondrion DNA]
[DB:genpept-pln1] [DE:*Cyanidioschyzon merolae* mitochondrial DNA, complete
sequence.] [LE:16296] [RE:18158] [DI:complement]

| ORF Name | NT ID | AA ID | NT LN | AA LN | Score | P-Value |
|---|---|---|---|---|---|---|
| AI7503001001_4695293_c3_1487 | 3624 | 7396 | 171 | 56 | | |

Description
NO-HIT

-continued

| ORF Name | NT ID | AA ID | NT LN | AA LN | Score | P-Value |
|---|---|---|---|---|---|---|
| AI7503001001__4703180__c1__1041 | 3625 | 7397 | 453 | 150 | 541 | 3.5e−52 |

Description
gp:[GI:e1393149:g4490608] [LN:SAU133495] [AC:AJ133495] [PN:NRD1] [GN:nrd1]
[OR:*Staphylococcus aureus*] [DB:genpept-bct1] [DE:*Staphylococcus aureus*
ribonucleotide reductase operon.*] [LE:138] [RE:536] [DI:direct]

| ORF Name | NT ID | AA ID | NT LN | AA LN | Score | P-Value |
|---|---|---|---|---|---|---|
| AI7503001001__4709575__c2__1309 | 3626 | 7398 | 354 | 117 | | |

Description
NO-HIT

| ORF Name | NT ID | AA ID | NT LN | AA LN | Score | P-Value |
|---|---|---|---|---|---|---|
| AI7503001001__4726462__f2__572 | 3627 | 7399 | 168 | 55 | | |

Description
NO-HIT

| ORF Name | NT ID | AA ID | NT LN | AA LN | Score | P-Value |
|---|---|---|---|---|---|---|
| AI7503001001__4726527__f3__774 | 3628 | 7400 | 528 | 175 | 749 | 3.2e−74 |

Description
pir:[LN:D69868] [AC:D69868] [PN:conserved hypothetical protein ykvM]
[GN:ykvM] [CL:hypothetical protein ykvM] [OR:*Bacillus subtilis*] [DB:pir2]
>gp:[GI:e1184965:g2633746] [LN:BSUB0008] [AC:Z99111:AL009126] [GN:ykvM]
[FN:unknown] [OR:*Bacillus subtilis*] [DB:genpept-bct1] [DE:*Bacillus subtilis*
complete genome (section 8 of 21):from 1394791 to 1603020.] [NT:similar to
hypothetical proteins] [LE:45967] [RE:46464] [DI:direct]

| ORF Name | NT ID | AA ID | NT LN | AA LN | Score | P-Value |
|---|---|---|---|---|---|---|
| AI7503001001__4773392__f2__359 | 3629 | 7401 | 288 | 95 | | |

Description
NO-HIT

| ORF Name | NT ID | AA ID | NT LN | AA LN | Score | P-Value |
|---|---|---|---|---|---|---|
| AI7503001001__4775287__c3__1420 | 3630 | 7402 | 1008 | 335 | 238 | 1.3e−34 |

Description
sp:[LN:YBGK__ECOLI] [AC:P75745] [GN:YBGK] [OR:*ESCHERICHIA COLI*]
[DE:HYPOTHETICAL 34.4 KD PROTEIN IN PHRB-NEI INTERGENIC REGION] [SP:P75745]
[DB:swissprot] >pir:[LN:G64806] [AC:G64806] [PN:ybgK protein] [GN:ybgK]
[CL:hypothetical protein HI1730] [OR:*Escherichia coli*] [DB:pir2]
>gp:[GI:d1036362:g4062308] [LN:D90710] [AC:D90710:AB001340] [PN:Hypothetical
protein HI1730] [OR:*Escherichia coli*] [SR:*Escherichia coli* (strain:K12) DNA,
clone:Kohara clone #175] [DB:genpept-bct1] [DE:*Escherichia coli* genomic DNA.
(15.9–16.3 min).] [NT:ORF__ID:o175#7; similar to PIR Accession Number]
[LE:6967] [RE:7899] [DI:direct] >gp:[GI:g1786930] [LN:AE000174]
[AC:AE000174:U00096] [PN:putative carboxylase] [GN:ybgK] [FN:putative
enzyme; Not classified] [OR:*Escherichia coli*] [DB:genpept-bct2]
[DE:*Escherichia coli* K-12 MG1655 section 64 of 400 of the complete genome.]
[NT:o310; This 310 aa ORF is 48 pct identical (1 gap)] [LE:10112] [RE:11044]
[DI:direct]

| ORF Name | NT ID | AA ID | NT LN | AA LN | Score | P-Value |
|---|---|---|---|---|---|---|
| AI7503001001__47763__f3__814 | 3631 | 7403 | 186 | 61 | | |

Description
NO-HIT

| ORF Name | NT ID | AA ID | NT LN | AA LN | Score | P-Value |
|---|---|---|---|---|---|---|
| AI7503001001__4804643__f1__90 | 3632 | 7404 | 246 | 81 | 75 | 0.0026 |

Description
gp:[GI:e1332553:g3764009] [LN:PFMAL3P4] [AC:AL008970] [GN:MAL3P4.11]
[OR:*Plasmodium falciparum*] [SR:malaria parasite *P. falciparum*]

-continued

[DB:genpept-inv1] [DE:*Plasmodium falciparum* MAL3P4, complete sequence.]
[NT:predicted using hexExon; MAL3P4.11 (PFC0510w),] [LE:68636] [RE:71146]
[DI:direct]

| ORF Name | NT ID | AA ID | NT LN | AA LN | Score | P-Value |
|---|---|---|---|---|---|---|
| AI7503001001_4806575_c2_1171 | 3633 | 7405 | 651 | 216 | 503 | 3.7e−48 |

Description
pir:[LN:H69854] [AC:H69854] [PN:hypothetical protein ykaA] [GN:ykaA]
[OR:*Bacillus subtilis*] [DB:pir2] >gp:[GI:e1181486:g2632006] [LN:BSAJ2571]
[AC:AJ002571] [PN:YkaA] [GN:ykaA] [FN:unknown] [OR:*Bacillus subtilis*]
[DB:genpept-bct1] [DE:*Bacillus subtilis* 168 56 kb DNA fragment between xlyA
and ykoR.] [LE:2613] [RE:3230] [DI:complement] >gp:[GI:e1183305:g2633639]
[LN:BSUB0007] [AC:Z99110:AL009126] [GN:ykaA] [FN:unknown] [OR:*Bacillus
subtilis*] [DB:genpept-bct1] [DE:*Bacillus subtilis* complete genome (section 7
of 21):from 1194391 to 1411140.] [LE:155562] [RE:156179] [DI:complement]

| ORF Name | NT ID | AA ID | NT LN | AA LN | Score | P-Value |
|---|---|---|---|---|---|---|
| AI7503001001_4876077_f3_796 | 3634 | 7406 | 714 | 237 | 778 | 2.7e−77 |

Description
pir:[LN:C69868] [AC:C69868] [PN:coenzyme PQQ synthesis homolog ykvL]
[GN:ykvL] [OR:*Bacillus subtilis*] [DB:pir2] >gp:[GI:e1184964:g2633745]
[LN:BSUB0008] [AC:Z99111:AL009126] [GN:ykvL] [FN:unknown] [OR:*Bacillus
subtilis*] [DB:genpept-bct1] [DE:*Bacillus subtilis* complete genome (section 8
of 21):from 1394791 to 1603020.] [NT:similar to coenzyme PQQ synthesis]
[LE:45218] [RE:45949] [DI:direct]

| ORF Name | NT ID | AA ID | NT LN | AA LN | Score | P-Value |
|---|---|---|---|---|---|---|
| AI7503001001_4885876_c1_1071 | 3635 | 7407 | 918 | 305 | 829 | 1.1e−82 |

Description
sp:[LN:YVCJ_BACSU] [AC:O06973] [GN:YVCJ] [OR:*BACILLUS SUBTILIS*]
[DE:HYPOTHETICAL 33.9 KD PROTEIN IN CRH-TRXB INTERGENIC REGION] [SP:O06973]
[DB:swissprot] >pir:[LN:H70031] [AC:H70031] [PN:conserved hypothetical
protein yvcJ] [GN:yvcJ] [CL:*Bacillus subtilis* conserved hypothetical
protein yvcJ] [OR:*Bacillus subtilis*] [DB:pir2] >gp:[GI:e1186165:g2635990]
[LN:BSUB0018] [AC:Z99121:AL009126] [GN:yvcJ] [FN:unknown] [OR:*Bacillus
subtilis*] [DB:genpept-bct1] [DE:*Bacillus subtilis* complete genome (section
18 of 21):from 3399551 to 3609060.] [NT:similar to hypothetical proteins]
[SP:O06973] [LE:171011] [RE:171898] [DI:complement]
>gp:[GI:e313026:g1945650] [LN:BSZ94043] [AC:Z94043] [PN:hypothetical
protein] [GN:yvcJ] [OR:*Bacillus subtilis*] [DB:genpept-bct1] [DE:*B. subtilis*
genomic DNA fragment (88 kb).] [NT:similar to hypothetical MTCY21B4]
[SP:O06973] [LE:9773] [RE:10660] [DI:direct]

| ORF Name | NT ID | AA ID | NT LN | AA LN | Score | P-Value |
|---|---|---|---|---|---|---|
| AI7503001001_4892878_c3_1357 | 3636 | 7408 | 1077 | 358 | 455 | 4.5e−43 |

Description
gp:[GI:g1913906] [LN:SAU91741] [AC:U91741] [PN:TagX] [GN:tagX] [FN:teichoic
acid biosynthesis] [OR:*Staphylococcus aureus*] [DB:genpept-bct1]
[DE:*Staphylococcus aureus* teichoic acid biosynthesis TagB gene, partial cds
and TagX and TagD genes, complete cds.] [LE:632] [RE:1471] [DI:direct]

| ORF Name | NT ID | AA ID | NT LN | AA LN | Score | P-Value |
|---|---|---|---|---|---|---|
| AI7503001001_4898376_f2_574 | 3637 | 7409 | 207 | 68 | 52 | 0.024 |

Description
gp:[GI:g4588017] [LN:AF087657] [AC:AF087657] [PN:NADH-ubiquinone
oxidoreductase chain 6] [GN:ND6] [OR:*Mitochondrion Agrocybe aegerita*]
[SR:*Agrocybe aegerita*] [DB:genpept-pln2] [DE:*Agrocybe aegerita*
NADH-ubiquinone oxidoreductase chain 6 (ND6)gene, mitochondrial gene
encoding mitochondrial protein, complete cds.] [NT:NADH dehydrogenase]
[LE:34] [RE:453] [DI:direct]

| ORF Name | NT ID | AA ID | NT LN | AA LN | Score | P-Value |
|---|---|---|---|---|---|---|
| AI7503001001_5084652_f3_849 | 3638 | 7410 | 507 | 168 | 536 | 1.2e−51 |

Description
gp:[GI:g1575061] [LN:SAU57060] [AC:U57060] [PN:ScdA] [GN:scdA]
[OR:*Staphylococcus aureus*] [DB:genpept-bct1] [DE:*Staphylococcus aureus* scdA
gene, complete cds.] [NT:*S. aureus* cells containing a scdA disruption have]

-continued

[LE:361] [RE:1035] [DI:direct]

| ORF Name | NT ID | AA ID | NT LN | AA LN | Score | P-Value |
|---|---|---|---|---|---|---|
| AI7503001001_5117793_c3_1531 | 3639 | 7411 | 273 | 91 | 197 | 9.9e−16 |

Description
sp:[LN:YRN3_VIBPA] [AC:P46231] [OR:*VIBRIO PARAHAEMOLYTICUS*] [DE:HYPOTHETICAL
PROTEIN IN RNT 5'REGION (ORF3) (FRAGMENT)] [SP:P46231] [DB:swissprot]
>gp:[GI:g497126] [LN:VPU06949] [AC:U06949] [PN:ORF3] [OR:*Vibrio
parahaemolyticus*] [DB:genpept-bct1] [DE:*Vibrio parahaemolyticus* BB22 RNase T
(rnt) gene and flagellar motor component (motY) gene, complete cds.] [LE:<1]
[RE:420] [DI:complement]

| ORF Name | NT ID | AA ID | NT LN | AA LN | Score | P-Value |
|---|---|---|---|---|---|---|
| AI7503001001_5131265_c2_1243 | 3640 | 7412 | 276 | 91 | 80 | 0.0071 |

Description
gp:[GI:g3582235] [LN:AE001272] [AC:AE001272] [PN:*L. lactis* predicted coding
region ORF00014] [GN:ORF00014] [OR:*Lactococcus lactis*] [DB:genpept-bct2]
[DE:*Lactococcus lactis* DPC3147 plasmid pMRC01, complete plasmid sequence.]
[NT:hypothetical protein; identified by GeneMark;] [LE:10983] [RE:11600]
[DI:direct]

| ORF Name | NT ID | AA ID | NT LN | AA LN | Score | P-Value |
|---|---|---|---|---|---|---|
| AI7503001001_5182962_f1_196 | 3641 | 7413 | 1068 | 355 | 295 | 1.3e−30 |

Description
sp:[LN:RESE_BACSU] [AC:P35164] [GN:RESE] [OR:*BACILLUS SUBTILIS*] EC:2.7.3.—]
[DE:SENSOR PROTEIN RESE,] [SP:P35164] [DB:swissprot] >pir:[LN:H69691]
[AC:H69691:S45560] [PN:two-component sensor histidine kinase resE] [GN:resE]
[CL:sensor histidine kinase homology] [:OR:*Bacillus subtilis*] [DB:pir2]
>gp:[GI:g410142] [LN:BACDIA] [AC:L09228] [OR:*Bacillus subtilis*] [SR:*Bacillus
subtilis* (strain 168, sub_species Marburg) DNA] [DB:genpept-bct1]
[DE:*Bacillus subtilis* spoVA to serA region.] [NT:ORFX18] [LE:22425]
[RE:24194] [DI:direct] >gp:[GI:e1185580:g2634746] [LN:BSUB0013]
[AC:Z99116:AL009126] [PN:two-component sensor histidine kinase] [GN:resE]
[FN:involved in global regulation of aerobic and] [OR:*Bacillus subtilis*]
[DB:genpept-bct1] [DE:*Bacillus subtilis* complete genome (section 13 of 21):
from 2395261 to 2613730.] [NT:alternate gene name:ypxE] [SP:P35164]
[LE:19389] [RE:21158] [DI:complement]

| ORF Name | NT ID | AA ID | NT LN | AA LN | Score | P-Value |
|---|---|---|---|---|---|---|
| AI7503001001_5195393_c3_1352 | 3642 | 7414 | 654 | 217 | 1088 | 3.8e−110 |

Description
gp:[GI:e255543:g1617434] [LN:SESIRR] [AC:X99128] [PN:putative iron dependant
repressor] [GN:sirR] [OR:*Staphylococcus epidermidis*] [DB:genpept-bct1]
[DE:*S. epidermidis* sirR gene.] [LE:14] [RE:658] [DI:direct]

| ORF Name | NT ID | AA ID | NT LN | AA LN | Score | P-Value |
|---|---|---|---|---|---|---|
| AI7503001001_5276677_c1_1026 | 3643 | 7415 | 1566 | 521 | 703 | 2.4e−69 |

Description
pir:[LN:B64622] [AC:B64622] [PN:osmoprotection protein] [OR:*Helicobacter
pylori*] [DB:pir2] >gp:[GI:g2313949] [LN:AE000593] [AC:AE000593:AE000511]
[PN:osmoprotection protein (proWX)] [GN:HP0818] [OR:*Helicobacter pylori*
26695] [DB:genpept-bct2] [DE:*Helicobacter pylori* 26695 section 71 of 134 of
the complete genome.] [NT:similar to PID:1109685 SP:Q45461 GB:AL009126]
[LE:4862] [RE:6523] [DI:direct]

| ORF Name | NT ID | AA ID | NT LN | AA LN | Score | P-Value |
|---|---|---|---|---|---|---|
| AI7503001001_5283592_f1_215 | 3644 | 7416 | 288 | 95 | 73 | 0.014 |

Description
gp:[GI:g1054677] [LN:CCCOX3] [AC:X92734] [PN:cytochrome oxidase] [GN:coxIII]
[OR:*Mitochondrion Chara corallina*] [SR:*Chara corallina*] [DB:genpept-pln1]
[DE:*C. corallina* mitochondrial cox3 gene.] [NT:subunit III] [LE:<1] [RE:>381]
[DI:direct]

| ORF Name | NT ID | AA ID | NT LN | AA LN | Score | P-Value |
|---|---|---|---|---|---|---|
| AI7503001001_5292175_c3_1484 | 3645 | 7417 | 1323 | 440 | 2112 | 1.2e−218 |

-continued

Description
gp:[GI:g3152725] [LN:AF065394] [AC:AF065394] [PN:enolase] [GN:eno]
[OR:*Staphylococcus aureus*] [DB:genpept-bct2] [DE:*Staphylococcus aureus*
enolase (eno) gene, complete cds.] [NT:ENO; laminin binding protein]
[LE:103] [RE:1407] [DI:direct]

| ORF Name | NT ID | AA ID | NT LN | AA LN | Score | P-Value |
|---|---|---|---|---|---|---|
| AI7503001001__53552__f2__450 | 3646 | 7418 | 660 | 219 | 179 | 8.0e−14 |

Description
sp:[LN:GRPB__BACFI] [AC:Q45133] [GN:GRPB] [OR:*BACILLUS FIRMUS*]
[DE:GLUTAMATE-RICH PROTEIN GRPB] [SP:Q45133] [DB:swissprot]
>gp:[GI:g1209681] [LN:BFU39410] [AC:U39410] [PN:glutamate-rich protein]
[GN:grpB] [OR:*Bacillus firmus*] [SR:*Bacillus firmus* strain=OF4]
[DB:genpept-bct1] [DE:*Bacillus firmus* OrfA, OrfB, glutamate-rich protein
(grpA), OrfC, and glutamate-rich protein (grpB) genes, complete cds.]
[LE:2695] [RE:3219] [DI:direct]

| ORF Name | NT ID | AA ID | NT LN | AA LN | Score | P-Value |
|---|---|---|---|---|---|---|
| AI7503001001__5355325__c3__1454 | 3647 | 7419 | 888 | 295 | 526 | 1.4e−50 |

Description
sp:[LN:DEGV__BACSU] [AC:P32436] [GN:DEGV] [OR:*BACILLUS SUBTILIS*] [DE:DEGV
PROTEIN] [SP:P32436] [DB:swissprot] >pir:[LN:D30191]
[AC:I40386:D30191:A70042:S28596] [PN:conserved hypothetical protein yviA]
[GN:yviA] [OR:*Bacillus subtilis*] [DB:pir2] >gp:[GI:g39848] [LN:BSCOMFG]
[AC:Z18629] [PN:U3] [GN:degUorf3] [OR:*Bacillus subtilis*] [DB:genpept-bct1]
[DE:*B. subtilis* comF gene.] [SP:P32436] [LE:1] [RE:846] [DI:direct]
>gp:[GI:e1184454:g2636074] [LN:BSUB0019] [AC:Z99122:AL009126] [GN:yviA]
[FN:unknown] [OR:*Bacillus subtilis*] [DB:genpept-bct1] [DE:*Bacillus subtilis*
complete genome (section 19 of 21):from 3597091 to 3809700.] [NT:alternate
gene name:degV, sacU; similar to] [LE:45634] [RE:46479] [DI:complement]
>gp:[GI:g1762331] [LN:BSU56901] [AC:U56901] [GN:degV] [OR:*Bacillus subtilis*]
[DB:genpept-bct2] [DE:*Bacillus subtilis* putative transcriptional regulator
(yvhJ), Ycr59c/YigZ homolog (yvhK), histidine kinase
(degS), transcriptional regulator of degradation enzyme (degU), (degV),
(comFA), (comFB), (comFC), flagellar protein (yviB), negative regulator of
flagellin (flgM), flagellar protein (yviC), flagellar-hook associated
protein1 (flgK), flagellar-hook associated protein 3 (flgL),
(yviE), transmembrane protein (yviF), (csrA), flagellin (hag),
flagellar protein (yviH), flagellar hook-associated protein 2
(fliD), flagellar protein (fliS), flagellar protein (fliT), sigma-54 modulator
homolog (yviI), and (secA) genes, complete cds.] [LE:4114] [RE:4959]
[DI:direct] >gp:[GI:e1184454:g2636074] [LN:BSUB0019] [AC:Z99122:AL009126]
[GN:yviA] [FN:unknown] [OR:*Bacillus subtilis*] [DB:genpept] [DE:*Bacillus
subtilis* complete genome (section 19 of 21):from 3597091 to 3809700.]
[NT:alternate gene name:degV, sacU; similar to] [SP:P32436] [LE:45634]
[RE:46479] [DI:complement]

| ORF Name | NT ID | AA ID | NT LN | AA LN | Score | P-Value |
|---|---|---|---|---|---|---|
| AI7503001001__5367843__c3__1488 | 3648 | 7420 | 759 | 252 | 791 | 1.1e−78 |

Description
sp:[LN:EST__BACST] [AC:Q06174] [GN:EST] [OR:*BACILLUS STEAROTHERMOPHILUS*]
[EC:3.1.1.1] [DE:CARBOXYLESTERASE PRECURSOR,] [SP:Q06174] [DB:swissprot]
>pir:[LN:JC1374] [AC:JC1374] [PN:carboxylesterase,] [GN:Est] [OR:*Bacillus
stearothermophilus*] [EC:3.1.1.1] [DB:pir2] >gp:[GI:d1002674:g216314]
[LN:BACPBH7] [AC:D12681] [PN:esterase] [OR:*Bacillus stearothermophilus*]
[SR:*Bacillus stearothermophilus* DNA, clone pBH7] [DB:genpept-bct1]
[DE:*Bacillus stearothermophilus* esterase gene.] [LE:181] [RE:924]
[DI:direct]

| ORF Name | NT ID | AA ID | NT LN | AA LN | Score | P-Value |
|---|---|---|---|---|---|---|
| AI7503001001__57800__c3__1494 | 3649 | 7421 | 147 | 48 | | |

Description
NO-HIT

| ORF Name | NT ID | AA ID | NT LN | AA LN | Score | P-Value |
|---|---|---|---|---|---|---|
| AI7503001001__5869433__f2__542 | 3650 | 7422 | 129 | 42 | | |

Description
NO-HIT

-continued

| ORF Name | NT ID | AA ID | NT LN | AA LN | Score | P-Value |
|---|---|---|---|---|---|---|
| AI7503001001__5869702__f2__595 | 3651 | 7423 | 309 | 102 | 87 | 0.015 |

Description
sp:[LN:YMW6__YEAST] [AC:Q04264:Q04780] [GN:YMR076C:YM9582.01C:YM9916.15C]
[OR:*SACCHAROMYCES CEREVISIAE*] [SR:,BAKER'S YEAST] [DE:HYPOTHETICAL 147.0 KD
PROTEIN IN ABF2-CHL12 INTERGENIC REGION] [SP:Q04264:Q04780] [DB:swissprot]
>pir:[LN:554451] [AC:554451:552836] [PN:hypothetical protein
YMR076c:hypothetical protein YM9582.01c:hypothetical protein YM9916.15c]
[GN:PDS5] [OR:*Saccharomyces cerevisiae*] [DB:pir2] [MP:13R]

| ORF Name | NT ID | AA ID | NT LN | AA LN | Score | P-Value |
|---|---|---|---|---|---|---|
| AI7503001001__5938762__c1__987 | 3652 | 7424 | 1704 | 567 | 566 | 7.8e−55 |

Description
sp:[LN:CYDD__HAEIN] [AC:P45082] [GN:CYDD:HI1157] [OR:*HAEMOPHILUS INFLUENZAE*]
[DE:TRANSPORT ATP-BINDING PROTEIN CYDD] [SP:P45082] [DB:swissprot]
>pir:[LN:F64186] [AC:F64186] [PN:ABC-type transport protein cydD] [GN:cydD]
[CL:unassigned ATP-binding cassette proteins:ATP-binding cassette
homology] [OR:*Haemophilus influenzae*] [DB:pir2] >gp:[GI:g1574714]
[LN:U32795] [AC:U32795:L42023] [PN:ATP-binding protein protein (cydD)]
[GN:HI1157] [OR:*Haemophilus influenzae* Rd] [DB:genpept-bct2] [DE:*Haemophilus influenzae* Rd section 110 of 163 of the complete genome.] [NT:similar to
GB:L21749 SP:P29018 GB:L25859 PID:146416] [LE:6353] [RE:8113]
[DI:complement]

| ORF Name | NT ID | AA ID | NT LN | AA LN | Score | P-Value |
|---|---|---|---|---|---|---|
| AI7503001001__6023915__c2__1313 | 3653 | 7425 | 969 | 322 | 1144 | 4.4e−116 |

Description
pir:[LN:D70023] [AC:D70023 ] [PN:lipoic acid synthetase, yutB] [GN:yutB]
[CL:lipoic acid synthase] [OR:*Bacillus subtilis*] [EC:2.8.1.—] [DB:pir2]
>gp:[GI:e1184312:g2635730] [LN:BSUB0017] [AC:Z99120:AL009126] [GN:yutB]
[FN:unknown] [OR:*Bacillus subtilis*] [DB:genpept-bct1] [DE:*Bacillus subtilis*
complete genome (section 17 of 21):from 3197001 to 3414420.] [NT:similar to
lipoic acid synthetase] [LE:122382] [RE:123188] [DI:complement]

| ORF Name | NT ID | AA ID | NT LN | AA LN | Score | P-Value |
|---|---|---|---|---|---|---|
| AI7503001001__6037756__f3__682 | 3654 | 7426 | 150 | 49 | | |

Description
NO-HIT

| ORF Name | NT ID | AA ID | NT LN | AA LN | Score | P-Value |
|---|---|---|---|---|---|---|
| AI7503001001__6050010__f1__177 | 3655 | 7427 | 132 | 43 | | |

Description
NO-HIT

| ORF Name | NT ID | AA ID | NT LN | AA LN | Score | P-Value |
|---|---|---|---|---|---|---|
| AI7503001001__6051500__c1__972 | 3656 | 7428 | 189 | 62 | | |

Description
NO-HIT

| ORF Name | NT ID | AA ID | NT LN | AA LN | Score | P-Value |
|---|---|---|---|---|---|---|
| AI7503001001__6051537__c1__1063 | 3657 | 7429 | 276 | 91 | 112 | 1.0e−06 |

Description
sp:[LN:CSBA__BACSU] [AC:P37953] [GN:CSBA] [OR:*BACILLUS SUBTILIS*] [DE:CSBA
PROTEIN] [SP:P37953] [DB:swissprot] >gp:[GI:g142780] [LN:BACCSBA]
[AC:M80473] [GN:csbA] [OR:*Bacillus subtilis*] [SR:*Bacillus subtilis* (strain
168, sub__species *Marburg*) DNA] [DB:genpept-bct1] [DE:*Bacillus subtilis* csbA
and uvr/dinA genes, complete cds.] [NT:putative membrane protein; putative]
[LE:380] [RE:610] [DI:direct] >gp:[GI:g142842] [LN:BACDINA76] [AC:M64048]
[PN:DNase inhibitor] [GN:dinA] [OR:*Bacillus subtilis*] [SR:*Bacillus subtilis*
DNA] [DB:genpept-bct1] [DE:*Bacillus subtilis* DNase inhibitor (dinA76) gene,
complete cds and promoter region.] [LE:64] [RE:294] [DI:direct]
>gp:[GI:e1184424:g2636044] [LN:BSUB0019] [AC:Z99122:AL009126] [PN:putative
membrane protein] [GN:csbA] [FN:unknown] [OR:*Bacillus subtilis*]
[DB:genpept-bct1] [DE:*Bacillus subtilis* complete genome (section 19 of 21):
from 3597091 to 3809700.] [SP:P37953] [LE:17086] [RE:17316] [DI:complement]
>gp:[GI:g2618840] [LN:AF017113] [AC:AF017113] [PN:CsbA] [GN:csbA]

-continued

[OR:*Bacillus subtilis*] [DB:genpept-bct2] [DE:*Bacillus subtilis* 300–304
degree genomic sequence.] [LE:12977] [RE:13207] [DI:direct]
>gp:[GI:e1184424:g2636044] [LN:BSUB0019] [AC:Z99122:AL009126] [PN:putative
membrane protein] [GN:csbA] [FN:unknown] [OR:*Bacillus subtilis*] [DB:genpept]
[DE:*Bacillus subtilis* complete genome (section 19 of 21):from 3597091 to
3809700.] [SP:P37953] [LE:17086] [RE:17316] [DI:complement]

| ORF Name | NT ID | AA ID | NT LN | AA LN | Score | P-Value |
|---|---|---|---|---|---|---|
| AI7503001001_6053176_f1_195 | 3658 | 7430 | 519 | 172 | | |

Description
NO-HIT

| ORF Name | NT ID | AA ID | NT LN | AA LN | Score | P-Value |
|---|---|---|---|---|---|---|
| AI7503001001_6056628_c3_1339 | 3659 | 7431 | 150 | 49 | | |

Description
NO-HIT

| ORF Name | NT ID | AA ID | NT LN | AA LN | Score | P-Value |
|---|---|---|---|---|---|---|
| AI7503001001_6057338_c3_1518 | 3660 | 7432 | 840 | 279 | 622 | 9.1e−61 |

Description
pir:[LN:H70015] [AC:H70015] [PN:hypothetical protein yunE] [GN:yunE]
OR:*Bacillus subtilis*] [DB:pir2] >gp:[GI:e1184317:g2635735] [LN:BSUB0017]
[AC:Z99120:AL009126] [GN:yunE] [FN:unknown] [OR:*Bacillus subtilis*]
[DB:genpept-bct1] [DE:*Bacillus subtilis* complete genome (section 17 of 21):
from 3197001 to 3414420.] [LE:127136] [RE:127957] [DI:complement]

| ORF Name | NT ID | AA ID | NT LN | AA LN | Score | P-Value |
|---|---|---|---|---|---|---|
| AI7503001001_6094177_c2_1235 | 3661 | 7433 | 123 | 40 | | |

Description
NO-HIT

| ORF Name | NT ID | AA ID | NT LN | AA LN | Score | P-Value |
|---|---|---|---|---|---|---|
| AI7503001001_6101581_f1_74 | 3662 | 7434 | 180 | 59 | | |

Description
NO-HIT

| ORF Name | NT ID | AA ID | NT LN | AA LN | Score | P-Value |
|---|---|---|---|---|---|---|
| AI7503001001_6257763_c3_1479 | 3663 | 7435 | 660 | 219 | 189 | 1.7e−13 |

Description
gp:[GI:g2246532] [LN:U93872] [AC:U93872] [OR:Kaposi's sarcoma-associated
herpesvirus] [SR:Kaposi's sarcoma-associated herpesvirus - Human herpesvirus
8] [DB:genpept-vrl] [DE:Kaposi's sarcoma-associated herpesvirus glycoprotein
M, DNA replication protein, glycoprotein, DNA replication protein,
FLICE inhibitory protein and v-cyclin genes, complete cds, and
tegument protein gene, partial cds.] [NT:ORF 73, contains large complex
repeat CR 73] [LE:124324] [RE:127593] [DI:complement]

| ORF Name | NT ID | AA ID | NT LN | AA LN | Score | P-Value |
|---|---|---|---|---|---|---|
| AI7503001001_626592_c1_935 | 3664 | 7436 | 852 | 283 | 233 | 1.5e−19 |

Description
pir:[LN:A69463] [AC:A69463] [PN:2-hydroxy-6-oxo-6-phenylhexa-2,4-dienoic
acid hydrolase (pcbD) homolog] [OR:*Archaeoglobus fulgidus*] [DB:pir2]
>gp:[GI:g2648849] [LN:AE000986] [AC:AE000986:AE000782]
[PN:2-hydroxy-6-oxo-6-phenylhexa-2,4-dienoic acid] [GN:AF1706]
[OR:*Archaeoglobus fulgidus*] [DB:genpept-bct2] [DE:*Archaeoglobus fulgidus*
section 121 of 172 of the complete genome.] [NT:similar to GP:1395174
percent identity:29.41;] [LE:11775] [RE:12491] [DI:complement]

| ORF Name | NT ID | AA ID | NT LN | AA LN | Score | P-Value |
|---|---|---|---|---|---|---|
| AI7503001001_6423376_f3_670 | 3665 | 7437 | 261 | 86 | | |

Description
NO-HIT

-continued

| ORF Name | NT ID | AA ID | NT LN | AA LN | Score | P-Value |
|---|---|---|---|---|---|---|
| AI7503001001__6437525__f3__862 | 3666 | 7438 | 294 | 97 | | |

Description
NO-HIT

| ORF Name | NT ID | AA ID | NT LN | AA LN | Score | P-Value |
|---|---|---|---|---|---|---|
| AI7503001001__6440640__c3__1379 | 3667 | 7439 | 1278 | 425 | 139 | 6.0e−06 |

Description
pir:[LN:D71621] [AC:D71621] [PN:hypothetical protein PFB0185w] [GN:PFB0185w]
[OR:*Plasmodium falciparum*] [DB:pir2] >gp:[GI:g3845117] [LN:AE001378]
[AC:AE001378:AE001362] [PN:hypothetical protein] [GN:PFB0185w]
[OR:*Plasmodium falciparum*] [SR:malaria parasite *P. falciparum*]
[DB:genpept-inv2] [DE:*Plasmodium falciparum* chromosome 2, section 15 of 73
of the complete sequence.] [NT:predicted by GlimmerM] [LE:6504:8652]
[RE:8473:9075] [DI:directJoin]

| ORF Name | NT ID | AA ID | NT LN | AA LN | Score | P-Value |
|---|---|---|---|---|---|---|
| AI7503001001__6444037__c2__1180 | 3668 | 7440 | 144 | 47 | | |

Description
NO-HIT

| ORF Name | NT ID | AA ID | NT LN | AA LN | Score | P-Value |
|---|---|---|---|---|---|---|
| AI7503001001__6642827__c3__1342 | 3669 | 7441 | 2403 | 800 | 1527 | 1.1e−156 |

Description
pir:[LN:A70010] [AC:A70010] [PN:NADH dehydrogenase homolog yufT] [GN:yufT]
[OR:*Bacillus subtilis*] [DB:pir2] >gp:[GI:e1184238:g2635656] [LN:BSUB0017]
[AC:Z99120:AL009126] [GN:yufT] [FN:unknown] [OR:*Bacillus subtilis*]
[DB:genpept-bct1] [DE:*Bacillus subtilis* complete genome (section 17 of 21):
from 3197001 to 3414420.] [NT:similar to NADH dehydrogenase] [LE:48758]
[RE:51082] [DI:direct] >gp:[GI:e311455:g1934817] [LN:BSZ93937] [AC:Z93937]
[PN:unknown] [GN:yufT] [OR:*Bacillus subtilis*] [DB:genpept-bct1]
[DE:*B. subtilis* genomic DNA fragment from yufK to yufV.] [NT:potential Na/H
antiporter/phaA homologue/NADH] [LE:10546] [RE:12870] [DI:direct]

| ORF Name | NT ID | AA ID | NT LN | AA LN | Score | P-Value |
|---|---|---|---|---|---|---|
| AI7503001001__6650312__f2__600 | 3670 | 7442 | 141 | 46 | | |

Description
NO-HIT

| ORF Name | NT ID | AA ID | NT LN | AA LN | Score | P-Value |
|---|---|---|---|---|---|---|
| AI7503001001__6675016__c1__1077 | 3671 | 7443 | 132 | 43 | | |

Description
NO-HIT

| ORF Name | NT ID | AA ID | NT LN | AA LN | Score | P-Value |
|---|---|---|---|---|---|---|
| AI7503001001__6680312__f2__518 | 3672 | 7444 | 714 | 237 | 211 | 4.7e−17 |

Description
gp:[GI:g3329623] [LN:CELF36H12] [AC:AF078790] [GN:F36H12.3]
[OR:*Caenorhabditis elegans*] [DB:genpept-inv2] [DE:*Caenorhabditis elegans*
cosmid F36H12.] [NT:coded for by *C. elegans* cDNA CEMSF30F]
[LE:21606:21872:22500:22677] [RE:21701:22454:22629:22875] [DI:directJoin]

| ORF Name | NT ID | AA ID | NT LN | AA LN | Score | P-Value |
|---|---|---|---|---|---|---|
| AI7503001001__6681577__c1__1110 | 3673 | 7445 | 432 | 143 | 277 | 3.3e−24 |

Description
pir:[LN:G70020] [AC:G70020] [PN:hypothetical protein yusF] [GN:yusF]
[OR:*Bacillus subtilis*] [DB:pir2] >gp:[GI:e1184356:g2635774] [LN:BSUB0017]
[AC:Z99120:AL009126] [GN:yusF] [FN:unknown] [OR:*Bacillus subtilis*]
[DB:genpept-bct1] [DE:*Bacillus subtilis* complete genome (section 17 of 21):
from 3197001 to 3414420.] [LE:167450] [RE:167890] [DI:complement]

| ORF Name | NT ID | AA ID | NT LN | AA LN | Score | P-Value |
|---|---|---|---|---|---|---|

-continued

| | | | | | | |
|---|---|---|---|---|---|---|
| AI7503001001__6695968__c2__1320 | 3674 | 7446 | 1470 | 489 | 2005 | 2.5e−207 |

Description
gp:[GI:g4530241] [LN:AF101234] [AC:AF101234] [PN:D-alanine-D-alanyl carrier
protein ligase DltA] [GN:dltA] [OR:*Staphylococcus aureus*] [DB:genpept-bct2]
[DE:*Staphylococcus aureus* dltABCD operon, complete sequence; and unknown
gene.] [LE:1590] [RE:3047] [DI:direct]

| ORF Name | NT ID | AA ID | NT LN | AA LN | Score | P-Value |
|---|---|---|---|---|---|---|
| AI7503001001__6822175__c2__1222 | 3675 | 7447 | 1914 | 637 | 1229 | 4.3e−125 |

Description
pir:[LN:F69901] [AC:F69901] [PN:DNA helicase recQ:ATP-dependent DNA
helicase homolog yocI] [GN:yocI] [CL:recQ protein:DEAD/H box helicase
homology:recQ helicase homology] [OR:*Bacillus subtilis*] [DB:pir2]
>gp:[GI:g2619051] [LN:AF027868] [AC:AF027868] [PN:RecQ homolog] [GN:yocI]
[OR:*Bacillus subtilis*] [DB:genpept-bct1] [DE:*Bacillus subtilis* chromosome
region between terC and odhAB.] [NT:similar to *E. coli* RecQ protein (607 aa)]
[LE:74004] [RE:75779] [DI:complement] >gp:[GI:e1185394:g2634315]
[LN:BSUB0011] [AC:Z99114:AL009126] [GN:yocI] [FN:unknown] [OR:*Bacillus
subtilis*] [DB:genpept-bct1] [DE:*Bacillus subtilis* complete genome (section
11 of 21):from 2000171 to 2207900.] [NT:similar to ATP-dependent DNA
helicase] [LE:93095] [RE:94870] [DI:complement]

| ORF Name | NT ID | AA ID | NT LN | AA LN | Score | P-Value |
|---|---|---|---|---|---|---|
| AI7503001001__6823453__c3__1346 | 3676 | 7448 | 483 | 160 | 270 | 1.8e−23 |

Description
gp:[GI:d1036085:g4001729] [LN:AB015981] [AC:AB015981] [PN:MnhE] [GN:mnhE]
[OR:*Staphylococcus aureus*] [SR:*Staphylococcus aureus* (strain:209P) DNA]
[DB:genpept-bct1] [DE:*Staphylococcus aureus* genes for OrfA, MnhA, MnhB,
MnhC, MnhD, MnhE, MnhF and MnhG, complete cds.] [LE:5474] [RE:5953]
[DI:direct]

| ORF Name | NT ID | AA ID | NT LN | AA LN | Score | P-Value |
|---|---|---|---|---|---|---|
| AI7503001001__6829638__c3__1402 | 3677 | 7449 | 186 | 61 | | |

Description
NO-HIT

| ORF Name | NT ID | AA ID | NT LN | AA LN | Score | P-Value |
|---|---|---|---|---|---|---|
| AI7503001001__6833313__c3__1371 | 3678 | 7450 | 1920 | 639 | 550 | 3.9e−53 |

Description
pir:[LN:B70001] [AC:B70001] [PN:ABC transporter (permease) homolog ytsD]
[GN:ytsD] [OR:*Bacillus subtilis*] [DB:pir2] >gp:[GI:e1185910:g2635521]
[LN:BSUB0016] [AC:Z99119:AL009126] [GN:ytsD] [FN:unknown] [OR:*Bacillus
subtilis*] [DB:genpept-bct1] [DE:*Bacillus subtilis* complete genome (section
16 of 21):from 2997771 to 3213410.] [NT:similar to ABC transporter
(permease)] [LE:110708] [RE:112648] [DI:complement] >gp:[GI:g2293178]
[LN:AF008220] [AC:AF008220] [PN:YtsD] [GN:ytsD] [OR:*Bacillus subtilis*]
[DB:genpept-bct2] [DE:*Bacillus subtilis* rrnB-dnaB genomic region.]
[NT:similarity to NADH dehydrogenase] [LE:67779] [RE:69719] [DI:direct]

| ORF Name | NT ID | AA ID | NT LN | AA LN | Score | P-Value |
|---|---|---|---|---|---|---|
| AI7503001001__6836088__c1__1118 | 3679 | 7451 | 1320 | 439 | 1260 | 2.2e−128 |

Description
pir:[LN:G70019] [AC:G70019] [PN:conserved hypothetical protein yurX]
[GN:yurX] [OR:*Bacillus subtilis*] [DB:pir2] >gp:[GI:e1184348:g2635766]
[LN:BSUB0017] [AC:Z99120:AL009126] [GN:yurX] [FN:unknown] [OR:*Bacillus
subtilis*] [DB:genpept-bct1] [DE:*Bacillus subtilis* complete genome (section
17 of 21):from 3197001 to 3414420.] [NT:similar to hypothetical proteins]
[LE:160723] [RE:162036] [DI:complement]

| ORF Name | NT ID | AA ID | NT LN | AA LN | Score | P-Value |
|---|---|---|---|---|---|---|
| AI7503001001__6929512__c1__1119 | 3680 | 7452 | 1416 | 471 | 2098 | 3.6e−217 |

Description
pir:[LN:D70019] [AC:D70019] [PN:conserved hypothetical protein yurU]
[GN:yurU] [CL:*Methanobacterium thermoautotrophicum* ABC transporter chain
Ycf24] [OR:*Bacillus subtilis*] [DB:pir2] >gp:[GI:e1184345:g2635763]
[LN:BSUB0017] [AC:Z99120:AL009126] [GN:yurU] [FN:unknown] [OR:*Bacillus -continued

*subtilis*] DB:genpept-bct1] [DE:*Bacillus subtilis* complete genome (section 17 of 21):from 3197001 to 3414420.] [NT:similar to hypothetical proteins] [LE:157652] [RE:159049] [DI:complement]

| ORF Name | NT ID | AA ID | NT LN | AA LN | Score | P-Value |
|---|---|---|---|---|---|---|
| AI7503001001__7042878__f1__40 | 3681 | 7453 | 177 | 58 | | |

Description
NO-HIT

| ORF Name | NT ID | AA ID | NT LN | AA LN | Score | P-Value |
|---|---|---|---|---|---|---|
| AI7503001001__7239188__f2__519 | 3682 | 7454 | 675 | 224 | 491 | 6.9e−47 |

Description
pir:[LN:D70033] [AC:D70033] [PN:conserved hypothetical protein yvdD] [GN:yvdD] [CL:yeast conserved hypothetical protein YJL055w] [OR:*Bacillus subtilis*] [DB:pir2] >gp:[GI:e1186152:g2635977] [LN:BSUB0018] [AC:Z99121:AL009126] [GN:yvdD] [FN:unknown] [OR:*Bacillus subtilis*] [DB:genpept-bct1] [DE:*Bacillus subtilis* complete genome (section 18 of 21): from 3399551 to 3609060.] [NT:similar to hypothetical proteins] [LE:158450] [RE:159025] [DI:complement] >gp:[GI:e313036:g1945663] [LN:BSZ94043] [AC:Z94043] [PN:hypothetical protein] [GN:yvdD] [OR:*Bacillus subtilis*] [DB:genpept-bct1] [DE:*B. subtilis* genomic DNA fragment (88 kb).] [NT:similar to YJF5__YEAST hypothetical 26.9 kd protein] [LE:22646] [RE:23221] [DI:direct]

| ORF Name | NT ID | AA ID | NT LN | AA LN | Score | P-Value |
|---|---|---|---|---|---|---|
| AI7503001001__7800__c1__1093 | 3683 | 7455 | 198 | 65 | 54 | 0.033 |

Description
gp:[GI:g3789915] [LN:AF083442] [AC:AF083442] [PN:G protein-coupled receptor G2A] [OR:*Mus musculus*] [SR:house mouse] [DB:genpept-rod] [DE:*Mus musculus* G protein-coupled receptor G2A mRNA, complete cds.] [LE:147] [RE:1295] [DI:direct]

| ORF Name | NT ID | AA ID | NT LN | AA LN | Score | P-Value |
|---|---|---|---|---|---|---|
| AI7503001001__781415__c3__1393 | 3684 | 7456 | 165 | 54 | | |

Description
NO-HIT

| ORF Name | NT ID | AA ID | NT LN | AA LN | Score | P-Value |
|---|---|---|---|---|---|---|
| AI7503001001__783375__c2__1236 | 3685 | 7457 | 180 | 59 | | |

Description
NO-HIT

| ORF Name | NT ID | AA ID | NT LN | AA LN | Score | P-Value |
|---|---|---|---|---|---|---|
| AI7503001001__788950__c3__1347 | 3686 | 7458 | 531 | 176 | 219 | 4.6e−18 |

Description
pir:[LN:E70008] [AC:E70008 ] [PN:conserved hypothetical protein yufB] [GN:yufB] [OR:*Bacillus subtilis*] [DB:pir2] >gp:[GI:e1184243:g2635661] [LN:BSUB0017] [AC:Z99120:AL009126] [GN:yufB] [FN:unknown] [OR:*Bacillus subtilis*] [DB:genpept-bct1] [DE:*Bacillus subtilis* complete genome (section 17 of 21):from 3197001 to 3414420.] [NT:similar to hypothetical proteins] [LE:54068] [RE:54442] [DI:direct] >gp:[GI:e311512:g1934774] [LN:BSZ93932] [AC:Z93932] [PN:unknown] [GN:yufB] [OR:*Bacillus subtilis*] [DB:genpept-bct1] [DE:*B. subtilis* genomic DNA fragment from yufA to yufE.] [LE:7086] [RE:7460] [DI:complement]

| ORF Name | NT ID | AA ID | NT LN | AA LN | Score | P-Value |
|---|---|---|---|---|---|---|
| AI7503001001__821963__c2__1165 | 3687 | 7459 | 546 | 181 | 103 | 0.0018 |

Description
gp:[GI:g4731376] [LN:AF135127] [AC:AF135127:AF047896] [PN:isoflavone reductase homolog Bet v 5] [GN:BETV5] [OR:*Betula pendula*] [SR:European white birch] [DB:genpept-pln2] [DE:*Betula pendula* isoflavone reductase homolog Bet V 5 (BETV5) mRNA, partial cds.] [NT:allergen; IgE binding protein] [LE:1] [RE:>900] [DI:direct]

-continued

| ORF Name | NT ID | AA ID | NT LN | AA LN | Score | P-Value |
|---|---|---|---|---|---|---|
| AI7503001001__822777__c3__1397 | 3688 | 7460 | 159 | 52 | | |

Description
NO-HIT

| ORF Name | NT ID | AA ID | NT LN | AA LN | Score | P-Value |
|---|---|---|---|---|---|---|
| AI7503001001__870300__c1__958 | 3689 | 7461 | 153 | 50 | | |

Description
NO-HIT

| ORF Name | NT ID | AA ID | NT LN | AA LN | Score | P-Value |
|---|---|---|---|---|---|---|
| AI7503001001__899177__c3__1335 | 3690 | 7462 | 930 | 309 | 596 | 5.2e−58 |

Description
pir:[LN:G70046] [AC:G70046] [PN:iron-binding protein homolog yvrC] [GN:yvrC]
[OR:*Bacillus subtilis*] [DB:pir2] >gp:[GI:e1249807:g2832811] [LN:BS43KBDNA]
[AC:AJ223978] [PN:putative metal binding protein, YvrC] [GN:yvrC]
[OR:*Bacillus subtilis*] [DB:genpept-bct1] [DE:*Bacillus subtilis* 42.7 kB DNA
fragment from yvsA to yvqA.] [LE:23792] [RE:24736] [DI:direct]
>gp:[GI:e1184397:g2635815] [LN:BSUB0017] [AC:Z99120:AL009126] [GN:yvrC]
[FN:unknown] [OR:*Bacillus subtilis*] [DB:genpept-bct1] [DE:*Bacillus subtilis*
complete genome (section 17 of 21):from 3197001 to 3414420.] [NT:similar to
iron-binding protein] [LE:205551] [RE:206495] [DI:complement]
>gp:[GI:e1186006:g2635831] [LN:BSUB0018] [AC:Z99121:AL009126] [GN:yvrC]
[FN:unknown] [OR:*Bacillus subtilis*] [DB:genpept-bct1] [DE:*Bacillus subtilis*
complete genome (section 18 of 21):from 3399551 to 3609060.] [NT:similar to
iron-binding protein] [LE:3001] [RE:3945] [DI:complement]

| ORF Name | NT ID | AA ID | NT LN | AA LN | Score | P-Value |
|---|---|---|---|---|---|---|
| AI7503001001__900256__c1__1017 | 3691 | 7463 | 210 | 69 | | |

Description
NO-HIT

| ORF Name | NT ID | AA ID | NT LN | AA LN | Score | P-Value |
|---|---|---|---|---|---|---|
| AI7503001001__959437__c1__965 | 3692 | 7464 | 159 | 52 | | |

Description
NO-HIT

| ORF Name | NT ID | AA ID | NT LN | AA LN | Score | P-Value |
|---|---|---|---|---|---|---|
| AI7503001001__9642__f1__227 | 3693 | 7465 | 876 | 291 | 769 | 2.4e−76 |

Description
pir:[LN:E70006] [AC:E70006] [PN:probable bacitracin resistance protein
(undecapreno) yubB] [GN:yubB] [CL:*Escherichia coli* bacitracin resistance
protein bacA] [OR:*Bacillus subtilis*] [DB:pir2] >gp:[GI:e1185988:g2635599]
[LN:BSUB0016] [AC:Z99119:AL009126] [GN:yubB] [FN:unknown] [OR:*Bacillus
subtilis*] [DB:genpept-bct1] [DE:*Bacillus subtilis* complete genome (section
16 of 21):from 2997771 to 3213410.] [NT:similar to bacitracin resistance
protein] [LE:195935] [RE:196765] [DI:complement]

| ORF Name | NT ID | AA ID | NT LN | AA LN | Score | P-Value |
|---|---|---|---|---|---|---|
| AI7503001001__969075__c1__1109 | 3694 | 7466 | 354 | 117 | 359 | 6.7e−33 |

Description
pir:[LN:B70021] [AC:B70021] [PN:arsenate reductase homolog yusI] [GN:yusI]
[CL:hypothetical protein yjbD] [OR:*Bacillus subtilis*] [DB:pir2]
>gp:[GI:e1184359:g2635777] [LN:BSUB0017] [AC:Z99120:AL009126] [GN:yusI]
[FN:unknown] [OR:*Bacillus subtilis*] [DB:genpept-bct1] [DE:*Bacillus subtilis*
complete genome (section 17 of 21):from 3197001 to 3414420.] [NT:similar to
arsenate reductase] [LE:168632] [RE:168988] [DI:complement]

| ORF Name | NT ID | AA ID | NT LN | AA LN | Score | P-Value |
|---|---|---|---|---|---|---|
| AI7503001001__969555__f1__218 | 3695 | 7467 | 168 | 55 | | |

Description
NO-HIT

-continued

| ORF Name | NT ID | AA ID | NT LN | AA LN | Score | P-Value |
|---|---|---|---|---|---|---|
| AI7503001001_969812_f1_63 | 3696 | 7468 | 123 | 40 | | |

Description
NO-HIT

| ORF Name | NT ID | AA ID | NT LN | AA LN | Score | P-Value |
|---|---|---|---|---|---|---|
| AI7503001001_970327_c2_1301 | 3697 | 7469 | 297 | 98 | 167 | 1.5e−12 |

Description
pir:[LN:F70020] [AC:F70020] [PU:thioredoxin homolog yusE] [GN:yusE]
[OR:*Bacillus subtilis*] [DB:pir2] >gp:[GI:e1184355:g2635773] [LN:BSUB0017]
[AC:Z99120:AL009126] [GN:yusE] [FN:unknown] [OR:*Bacillus subtilis*]
[DB:genpept-bct1] [DE:*Bacillus subtilis* complete genome (section 17 of 21):
from 3197001 to 3414420.] [NT:similar to thioredoxin] [LE:167128] [RE:167448]
[DI:complement]

| ORF Name | NT ID | AA ID | NT LN | AA LN | Score | P-Value |
|---|---|---|---|---|---|---|
| AI7503001001_973400_f3_690 | 3698 | 7470 | 180 | 59 | 43 | 0.013 |

Description
gp:[GI:e1363550:g4127809] [LN:EFAJ3161] [AC:AJ223161] [PN:hypothetical
protein] [GN:orf6] [OR:*Enterococcus faecalis*] [DB:genpept-bct1]
[DE:*Enterococcus faecalis* plasmid pS86, rep86 and mob86 genes.] [LE:4421]
[RE:4732] [DI:direct]

| ORF Name | NT ID | AA ID | NT LN | AA LN | Score | P-Value |
|---|---|---|---|---|---|---|
| AI7503001001_978426_c1_1043 | 3699 | 7471 | 978 | 325 | 1338 | 1.2e−136 |

Description
gp:[GI:e1330452:g3724155] [LN:SAA005352] [AC:AJ005352] [PN:membrane protein]
[GN:sstA] [FN:iron transport protein] [OR:*Staphylococcus aureus*]
[DB:genpept-bct1] [DE:*Staphylococcus aureus*, Sst putative iron transport
operon.] [LE:273] [RE:1245] [DI:direct]

| ORF Name | NT ID | AA ID | NT LN | AA LN | Score | P-Value |
|---|---|---|---|---|---|---|
| AI7503001001_9882950_c2_1204 | 3700 | 7472 | 1350 | 449 | 1090 | 2.3e−110 |

Description
sp:[LN:YHDP_BACSU] [AC:O07585] [GN:YHDP] [OR:*BACILLUS SUBTILIS*]
[DE:HYPOTHETICAL 49.9 KD PROTEIN IN CITA-SSPB INTERGENIC REGION] [SP:O07585]
[DB:swissprot] >pir:[LN:F69826] [AC:F69826] [PN:hemolysin homolog yhdP]
[GN:yhdP] [CL:hypothetical protein HI0107] [OR:*Bacillus subtilis*] [DB:pir2]
>gp:[GI:e1182956:g2633290] [LN:BSUB0006] [AC:Z99109:AL009126] [GN:yhdP]
[FN:unknown] [OR:*Bacillus subtilis*] [DB:genpept-bct1] [DE:*Bacillus subtilis*
complete genome (section 6 of 21):from 999501 to 1209940.] [NT:similar to
hemolysin] [SP:O07585] [LE:32043] [RE:33377] [DI:complement]
>gp:[GI:e1191881:g2226211] [LN:BSY14082] [AC:Y14082] [PN:hypothetical
protein] [GN:yhdP] [OR:*Bacillus subtilis*] [DB:genpept-bct1] [DE:*Bacillus
subtilis* chromosomal DNA, region 72 to 75 degrees:spoVR to sspB.]
[NT:Similarity to yhdT, this submission, and to] [SP:O07585] [LE:18691]
[RE:20025] [DI:complement]

| ORF Name | NT ID | AA ID | NT LN | AA LN | Score | P-Value |
|---|---|---|---|---|---|---|
| AI7503001001_9884625_f2_464 | 3701 | 7473 | 1509 | 502 | 1226 | 9.0e−125 |

Description
sp:[LN:YCLF_BACSU] [AC:P94408] [GN:YCLF] [OR:*BACILLUS SUBTILIS*]
[DE:HYPOTHETICAL 53.3 KD PROTEIN IN SFP-GERKA INTERGENIC REGION] [SP:P94408]
[DB:swissprot] >pir:[LN:C69762] [AC:C69762] [PN:di-tripeptide ABC
transporter (membrane pr) homolog yclF] [GN:yclF] [CL:peptide transporter
protein] [OR:*Bacillus subtilis*] [DB:pir2] >gp:[GI:e1182334:g2632668]
[LN:BSUB0003] [AC:Z99106:AL009126] [GN:yclF] [FN:unknown] [OR:*Bacillus
subtilis*] [DB:genpept-bct1] [DE:*Bacillus subtilis* complete genome (section 3
of 21):from 402751 to 611850.] [NT:similar to di-tripeptide ABC transporter
(membrane) [SP:P94408] [LE:13065] [RE:14543] [DI:complement]
>gp:[GI:d1009635:g1805438] [LN:D50453] [AC:D50453] [PN:homologue of
Di-tripeptide transporter Dtp of L.] [GN:yclF] [OR:*Bacillus subtilis*]
[SR:*Bacillus subtilis* (strain:168 trpC2) DNA] [DB:genpept-bct1] [DE:*Bacillus
subtilis* DNA for 25–36 degree region containing theamyE-srfA region,
complete cds.] [LE:95468] [RE:96946] [DI:complement]

-continued

| ORF Name | NT ID | AA ID | NT LN | AA LN | Score | P-Value |
| --- | --- | --- | --- | --- | --- | --- |
| AI7503001001_989010_c1_1128 | 3702 | 7474 | 408 | 135 | 371 | 3.6e−34 |

Description
pir:[LN:G70024] [AC:G70024] [PN:conserved hypothetical protein yutM]
[GN:yutM] [CL:conserved hypothetical protein HI0376] [OR:*Bacillus subtilis*]
[DB:pir2] >gp:[GI:e1184295:g2635713] [LN:BSUB0017] [AC:Z99120:AL009126]
[GN:yutM] [FN:unknown] [OR:*Bacillus subtilis*] [DB:genpept-bct1] [DE:*Bacillus subtilis* complete genome (section 17 of 21):from 3197001 to 3414420.]
[NT:similar to hypothetical proteins] [LE:107656] [RE:108018]
[DI:complement]

| ORF Name | NT ID | AA ID | NT LN | AA LN | Score | P-Value |
| --- | --- | --- | --- | --- | --- | --- |
| AI7503012391_11291_c2_183 | 3703 | 7475 | 153 | 50 | | |

Description
NO-HIT

| ORF Name | NT ID | AA ID | NT LN | AA LN | Score | P-Value |
| --- | --- | --- | --- | --- | --- | --- |
| AI7503012391_1369012_c2_207 | 3704 | 7476 | 126 | 41 | | |

Description
NO-HIT

| ORF Name | NT ID | AA ID | NT LN | AA LN | Score | P-Value |
| --- | --- | --- | --- | --- | --- | --- |
| AI7503012391_13790943_c1_161 | 3705 | 7477 | 1644 | 547 | 2797 | 3.0e−291 |

Description
pir:[LN:C56976] [AC:C56976] [PN:transfer complex protein TrsK] [GN:trsK]
[OR:*Staphylococcus aureus*] [DB:pir2] >gp:[GI:g310618] [LN:STATRSC]
[AC:L11998] [GN:trsK] [OR:*Staphylococcus aureus*] [SR:*Staphylococcus aureus* (individual_isolate pG01) DNA] [DB:genpept-bct1] [DE:*Staphylococcus aureus* conjugative transfer gene complex (trs).] [NT:putative] [LE:10475]
[RE:12115] [DI:direct] >gp:[GI:g3676445] [LN:AF051917] [AC:AF051917:L19570]
[PN:putative membrane protein TraK] [GN:traK] [OR:*Staphylococcus aureus*]
[DB:genpept-bct2] [DE:*Staphylococcus aureus* plasmid pSK41, complete sequence.] [NT:similar to transfer-associated proteins of] [LE:34078]
[RE:35718] [DI:direct]

| ORF Name | NT ID | AA ID | NT LN | AA LN | Score | P-Value |
| --- | --- | --- | --- | --- | --- | --- |
| AI7503012391_14507827_c3_220 | 3706 | 7478 | 168 | 55 | 273 | 8.7e−24 |

Description
pir:[LN:F56976] [AC:F56976] [PN:transfer complex protein TrsO']
[OR:*Staphylococcus aureus*] [DB:pir2] >gp:[GI:g3676448] [LN:AF051917]
[AC:AF051917:L19570] [PN:unknown] [OR:*Staphylococcus aureus*]
[DB:genpept-bct2] [DE:*Staphylococcus aureus* plasmid pSK41, complete sequence.] [NT:Orf55; possibly truncated by IS257 transposon] [LE:37179]
[RE:37346] [DI:direct]

| ORF Name | NT ID | AA ID | NT LN | AA LN | Score | P-Value |
| --- | --- | --- | --- | --- | --- | --- |
| AI7503012391_14844187_c2_195 | 3707 | 7479 | 3081 | 1026 | 5411 | 0.0 |

Description
sp:[LN:SYIP_STAAU] [AC:P41368] [GN:MUPR] [OR:*STAPHYLOCOCCUS AUREUS*]
[EC:6.1.1.5] [DE:(ISOLEUCINE--TRNA LIGASE) (ILERS) (MUPIROCIN RESISTANCE PROTEIN)] [SP:P41368] [DB:swissprot] >gp:[GI:g581558] [LN:SADNAMUPR]
[AC:X75439] [PN:isoleucyl tRNA synthetase] [GN:ileS] [OR:*Staphylococcus aureus*] [DB:genpept-bct1] [DE:*S. aureus* plasmid encoded DNA, mup R gene.]
[SP:P41368] [LE:477] [RE:3551] [DI:direct]

| ORF Name | NT ID | AA ID | NT LN | AA LN | Score | P-Value |
| --- | --- | --- | --- | --- | --- | --- |
| AI7503012391_15631901_c3_234 | 3708 | 7480 | 645 | 214 | 943 | 8.8e−95 |

Description
gp:[GI:g3676416] [LN:AF051917] [AC:AF051917:L19570] [PN:putative resolvase
Res] [GN:res] [OR:*Staphylococcus aureus*] [DB:genpept-bct2]
[DE:*Staphylococcus aureus* plasmid pSK41, complete sequence.] [LE:2779]
[RE:3336] [DI:direct]

| ORF Name | NT ID | AA ID | NT LN | AA LN | Score | P-Value |
| --- | --- | --- | --- | --- | --- | --- |

-continued

| | | | | | | |
|---|---|---|---|---|---|---|
| AI7503012391__156910__f2__62 | 3709 | 7481 | 483 | 160 | 729 | 4.2e−72 |

Description
gp:[GI:g3676415] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf149] [LE:2068] [RE:2484]
[DI:complement]

| ORF Name | NT ID | AA ID | NT LN | AA LN | Score | P-Value |
|---|---|---|---|---|---|---|
| AI7503012391__19625062__c3__225 | 3710 | 7482 | 165 | 54 | | |

Description
NO-HIT

| ORF Name | NT ID | AA ID | NT LN | AA LN | Score | P-Value |
|---|---|---|---|---|---|---|
| AI7503012391__19665885__c1__175 | 3711 | 7483 | 1728 | 575 | 2999 | 0.0 |

Description
gp:[GI:g3676419] [LN:AF051917] [AC:AF051917:L19570] [PN:LtrC-like protein]
[OR:*Staphylococcus aureus*] [DB:genpept-bct2] [DE:*Staphylococcus aureus*
plasmid pSK41, complete sequence.] [NT:Orf575; similar to *Lactococcus lactis*
pRS01 LtrC] [LE:6350] [RE:8074] [DI:direct]

| ORF Name | NT ID | AA ID | NT LN | AA LN | Score | P-Value |
|---|---|---|---|---|---|---|
| AI7503012391__19744010__c3__232 | 3712 | 7484 | 288 | 95 | 466 | 3.1e−44 |

Description
gp:[GI:g3676414] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf423] [LE:755] [RE:2026]
[DI:direct]

| ORF Name | NT ID | AA ID | NT LN | AA LN | Score | P-Value |
|---|---|---|---|---|---|---|
| AI7503012391__2115625__f2__61 | 3713 | 7485 | 195 | 64 | | |

Description
NO-HIT

| ORF Name | NT ID | AA ID | NT LN | AA LN | Score | P-Value |
|---|---|---|---|---|---|---|
| AI7503012391__2150037__c1__180 | 3714 | 7486 | 336 | 111 | 464 | 5.0e−44 |

Description
gp:[GI:g3676421] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf90] [LE:10316] [RE:10588]
[DI:direct]

| ORF Name | NT ID | AA ID | NT LN | AA LN | Score | P-Value |
|---|---|---|---|---|---|---|
| AI7503012391__21754035__f3__110 | 3715 | 7487 | 141 | 46 | | |

Description
NO-HIT

| ORF Name | NT ID | AA ID | NT LN | AA LN | Score | P-Value |
|---|---|---|---|---|---|---|
| AI7503012391__23468753__c3__236 | 3716 | 7488 | 1647 | 548 | 2838 | 1.4e−295 |

Description
gp:[GI:g3676418] [LN:AF051917] [AC:AF051917:L19570] [PN:unknown]
[OR:*Staphylococcus aureus*] [DB:genpept-bct2] [DE:*Staphylococcus aureus*
plasmid phSK41, complete sequence.] [NT:Orf538] [LE:4531] [RE:6147]
[DI:direct]

| ORF Name | NT ID | AA ID | NT LN | AA LN | Score | P-Value |
|---|---|---|---|---|---|---|
| AI7503012391__2359417__c2__211 | 3717 | 7489 | 309 | 102 | 392 | 2.1e−36 |

Description
gp:[GI:g3676422] [LN:AF051917] [AC:AF051917:L19570] [PN:putative membrane
protein] [OR:*Staphylococcus aureus*] [DB:genpept-bct2] [DE:*Staphylococcus
aureus* plasmid pSK41, complete sequence.] [NT:Orf77] [LE:10692] [RE:10925]
[DI:direct]

| ORF Name | NT ID | AA ID | NT LN | AA LN | Score | P-Value |
|---|---|---|---|---|---|---|
| AI7503012391_23603382_c2_196 | 3718 | 7490 | 603 | 200 | 688 | 9.2e−68 |

Description
sp:[LN:YIL2_STAAU] [AC:P41370] [OR:*STAPHYLOCOCCUS AUREUS*] [DE:HYPOTHETICAL PROTEIN IN ILES 3'REGION (ORF C) (FRAGMENT)] [SP:P41370] [DB:swissprot] >pir:[LN:S40262] [AC:S40262] [PN:hypothetical protein C] [OR:*Staphylococcus aureus*] [DB:pir2] >gp:[GI:g438228] [LN:SADNAMUPR] [AC:X75439] [OR:*Staphylococcus aureus*] [DB:genpept-bct1] [DE:*S. aureus* plasmid encoded DNA, mup R gene.] [NT:ORF C] [SP:P41370] [LE:3621] [RE:>4013] [DI:direct]

| ORF Name | NT ID | AA ID | NT LN | AA LN | Score | P-Value |
|---|---|---|---|---|---|---|
| AI7503012391_23651712_c2_191 | 3719 | 7491 | 480 | 159 | 779 | 2.1e−77 |

Description
pir:[LN:B56976] [AC:B56976] [PN:transfer protein complex TrsJ] [GN:trsJ] [OR:*Staphylococcus aureus*] [DB:pir2] >gp:[GI:g310617] [LN:STATRSC] [AC:L11998] [GN:trsJ] [OR:*Staphylococcus aureus*] [SR:*Staphylococcus aureus* (individual_isolate pG01) DNA] [DB:genpept-bct1] [DE:*Staphylococcus aureus* conjugative transfer gene complex (trs).] [NT:putative] [LE:10014] [RE:10478] [DI:direct] >gp:[GI:g3676444] [LN:AF051917] [AC:AF051917:L19570] [PN:putative membrane protein TraJ] [GN:traJ] [OR:*Staphylococcus aureus*] [DB:genpept-bct2] [DE:*Staphylococcus aureus* plasmid pSK41, complete sequence.] [LE:33617] [RE:34081] [DI:direct]

| ORF Name | NT ID | AA ID | NT LN | AA LN | Score | P-Value |
|---|---|---|---|---|---|---|
| AI7503012391_23727302_c3_215 | 3720 | 7492 | 1296 | 431 | 2175 | 2.5e−225 |

Description
pir:[LN:G36891] [AC:G36891] [PN:transfer complex protein TrsF] [GN:trsF] [OR:*Staphylococcus aureus*] [DB:pir2] >gp:[GI:g310613] [LN:STATRSC] [AC:L11998] [GN:trsF] [OR:*Staphylococcus aureus*] [SR:*Staphylococcus aureus* (individual_isolate pG01) DNA] [DB:genpept-bct1] [DE:*Staphylococcus aureus* conjugative transfer gene complex (trs).] [NT:putative] [LE:5011] [RE:6291] [DI:direct] >gp:[GI:g3676440] [LN:AF051917] [AC:AF051917:L19570] [PN:putative membrane protein TraF] [GN:traF] [OR:*Staphylococcus aureus*] [DB:genpept-bct2] [DE:*Staphylococcus aureus* plasmid pSK41, complete sequence.] [LE:28614] [RE:29894] [DI:direct]

| ORF Name | NT ID | AA ID | NT LN | AA LN | Score | P-Value |
|---|---|---|---|---|---|---|
| AI7503012391_23959802_c2_201 | 3721 | 7493 | 234 | 77 | | |

Description
NO-HIT

| ORF Name | NT ID | AA ID | NT LN | AA LN | Score | P-Value |
|---|---|---|---|---|---|---|
| AI7503012391_23959802_f1_16 | 3722 | 7494 | 162 | 53 | | |

Description
NO-HIT

| ORF Name | NT ID | AA ID | NT LN | AA LN | Score | P-Value |
|---|---|---|---|---|---|---|
| AI7503012391_23959802_f1_32 | 3723 | 7495 | 135 | 44 | | |

Description
NO-HIT

| ORF Name | NT ID | AA ID | NT LN | AA LN | Score | P-Value |
|---|---|---|---|---|---|---|
| AI7503012391_23959802_f1_51 | 3724 | 7496 | 123 | 40 | | |

Description
NO-HIT

| ORF Name | NT ID | AA ID | NT LN | AA LN | Score | P-Value |
|---|---|---|---|---|---|---|
| AI7503012391_23959802_f2_70 | 3725 | 7497 | 174 | 57 | | |

Description
NO-HIT

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503012391__23959802__f3__119 | 3726 | 7498 | 123 | 40 | | |

Description
NO-HIT

| ORF Name | NT ID | AA ID | NT LN | AA LN | Score | P-Value |
|---|---|---|---|---|---|---|
| AI7503012391__24001537__c2__187 | 3727 | 7499 | 750 | 249 | 1184 | 2.5e−120 |

Description
pir:[LN:E36891] [AC:E36891] [PN:transfer complex protein TrsD] [GN:trsD]
[OR:*Staphylococcus aureus*] [DB:pir2] >gp:[GI:g310611] [LN:STATRSC]
[AC:L11998] [GN:trsD] [OR:*Staphylococcus aureus*] [SR:*Staphylococcus aureus*
(individual__isolate pG01) DNA] [DB:genpept-bct1] [DE:*Staphylococcus aureus*
conjugative transfer gene complex (trs).] [NT:putative] [LE:2283] [RE:2966]
[DI:direct] >gp:[GI:g3676438] [LN:AF0519171 [AC:AF051917:L19570] [PN:TraD]
[GN:traD] [OR:*Staphylococcus aureus*] [DB:genpept-bct2] [DE:*Staphylococcus
aureus* plasmid pSK41, complete sequence.] [LE:25886] [RE:26569] [DI:direct]

| ORF Name | NT ID | AA ID | NT LN | AA LN | Score | P-Value |
|---|---|---|---|---|---|---|
| AI7503012391__24298387__c1__171 | 3728 | 7500 | 147 | 48 | 68 | 0.045 |

Description
sp:[LN:PSBH__CHLVU] [AC:P56323] [GN:PSBH] [OR:*CHLORELLA VULGARIS*]
[DE:PHOTOSYSTEM II 10 KD PHOSPHOPROTEIN] [SP:P56323] [DB:swissprot]

| ORF Name | NT ID | AA ID | NT LN | AA LN | Score | P-Value |
|---|---|---|---|---|---|---|
| AI7503012391__24393803__f1__28 | 3729 | 7501 | 171 | 56 | | |

Description
NO-HIT

| ORF Name | NT ID | AA ID | NT LN | AA LN | Score | P-Value |
|---|---|---|---|---|---|---|
| AI7503012391__24415937__c2__189 | 3730 | 7502 | 489 | 162 | 819 | 1.2e−81 |

Description
pir:[LN:I36891] [AC:I36891] [PN:transfer complex protein TrsH] [GN:trsH]
[OR:*Staphylococcus aureus*] [DB:pir2] >gp:[GI:g310615] [LN:STATRSC]
[AC:L11998] [GN:trsH] [OR:*Staphylococcus aureus*] [SR:*Staphylococcus aureus*
(individual__isolate pG01) DNA] [DB:genpept-bct1] [DE:*Staphylococcus aureus*
conjugative transfer gene complex (trs).] [NT:putative] [LE:7395] [RE:7880]
[DI:direct] >gp:[GI:g3676442] [LN:AF051917] [AC:AF051917:L19570]
[PN:lipoprotein TraH] [GN:traH] [OR:*Staphylococcus aureus*] [DB:genpept-bct2]
[DE:*Staphylococcus aureus* plasmid pSK41, complete sequence.] [NT:signal
peptide recognized as a pheromone by the] [LE:30998] [RE:31483] [DI:direct]

| ORF Name | NT ID | AA ID | NT LN | AA LN | Score | P-Value |
|---|---|---|---|---|---|---|
| AI7503012391__24664812__c1__155 | 3731 | 7503 | 423 | 140 | 671 | 5.8e−66 |

Description
pir:[LN:D36891] [AC:D36891] [PN:transfer complex protein TrsC] [GN:trsC]
[OR:*Staphylococcus aureus*] [DB:pir2] >gp:[GI:g310610] [LN:STATRSC]
[AC:L11998] [GN:trsC] [OR:*Staphylococcus aureus*] [SR:*Staphylococcus aureus*
(individual__isolate pG01) DNA] [DB:genpept-bct1] [DE:*Staphylococcus aureus*
conjugative transfer gene complex (trs).] [NT:putative] [LE:1889] [RE:2296]
[DI:direct] >gp:[GI:g3676437] [LN:AF051917] [AC:AF051917:L19570]
[PN:putative membrane protein TraC] [GN:traC] [OR:*Staphylococcus aureus*]
[DB:genpept-bct2] [DE:*Staphylococcus aureus* plasmid pSK41, complete
sequence.] [LE:25492] [RE:25899] [DI:direct]

| ORF Name | NT ID | AA ID | NT LN | AA LN | Score | P-Value |
|---|---|---|---|---|---|---|
| AI7503012391__24723137__f1__49 | 3732 | 7504 | 225 | 74 | 315 | 3.1e−28 |

Description
pir:[LN:A36891] [AC:A36891] [PN:transfer complex protein TrsN] [GN:trsN]
[OR:*Staphylococcus aureus*] [DB:pir2] >gp:[GI:g3676434] [LN:AF051917]
[AC:AF051917:L19570] [PN:putative regulator of transfer genes ArtA]
[GN:artA] [OR:*Staphylococcus aureus*] [DB:genpept-bct2] [DE:*Staphylococcus
aureus* plasmid pSK41, complete sequence.] [LE:23764] [RE:23952]
[DI:complement]

| ORF Name | NT ID | AA ID | NT LN | AA LN | Score | P-Value |
|---|---|---|---|---|---|---|

-continued

| ORF Name | NT ID | AA ID | NT LN | AA LN | Score | P-Value |
|---|---|---|---|---|---|---|
| AI7503012391__24792033__c2__192 | 3733 | 7505 | 138 | 45 | | |

Description
NO-HIT

| ORF Name | NT ID | AA ID | NT LN | AA LN | Score | P-Value |
|---|---|---|---|---|---|---|
| AI7503012391__25587777__f1__52 | 3734 | 7506 | 264 | 87 | 444 | 6.6e−42 |

Description
gp:[GI:g3676425] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf86] [LE:12564] [RE:12824]
[DI:complement]

| ORF Name | NT ID | AA ID | NT LN | AA LN | Score | P-Value |
|---|---|---|---|---|---|---|
| AI7503012391__26594052__c1__150 | 3735 | 7507 | 336 | 111 | 567 | 6.1e−55 |

Description
gp:[GI:g3676424] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf109] [LE:12231] [RE:12560]
[DI:direct]

| ORF Name | NT ID | AA ID | NT LN | AA LN | Score | P-Value |
|---|---|---|---|---|---|---|
| AI7503012391__26600927__c2__206 | 3736 | 7508 | 786 | 261 | 1347 | 1.4e−137 |

Description
gp:[GI:g3676417] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf259] [LE:3618] [RE:4397]
[DI:direct]

| ORF Name | NT ID | AA ID | NT LN | AA LN | Score | P-Value |
|---|---|---|---|---|---|---|
| AI7503012391__29558262__c2__205 | 3737 | 7509 | 129 | 42 | | |

Description
NO-HIT

| ORF Name | NT ID | AA ID | NT LN | AA LN | Score | P-Value |
|---|---|---|---|---|---|---|
| AI7503012391__30273550__c1__162 | 3738 | 7510 | 432 | 143 | 671 | 5.8e−66 |

Description
pir:[LN:E56976] [AC:E56976] [PN:transfer complex protein TrsM] [GN:trsM]
[CL:single-stranded DNA-binding protein homology] [OR:*Staphylococcus aureus*]
[DB:pir2] >gp:[GI:g310620] [LN:STATRSC] [AC:L11998] [GN:trsM]
[OR:*Staphylococcus aureus*] [SR:*Staphylococcus aureus* (individual__isolate
pG01) DNA] [DB:genpept-bct1] [DE:*Staphylococcus aureus* conjugative transfer
gene complex (trs).] [NT:putative] [LE:13127] [RE:13519] [DI:direct]
>gp:[GI:g3676447] [LN:AF051917] [AC:AF051917:L19570] [PN:putative
single-stranded DNA binding protein] [GN:traM] [OR:*Staphylococcus aureus*]
[DB:genpept-bct2] [DE:*Staphylococcus aureus* plasmid pSK41, complete
sequence.] [LE:36730] [RE:37122] [DI:direct]

| ORF Name | NT ID | AA ID | NT LN | AA LN | Score | P-Value |
|---|---|---|---|---|---|---|
| AI7503012391__30503392__c2__188 | 3739 | 7511 | 1083 | 360 | 1889 | 5.0e−195 |

Description
gp:[GI:g3676441] [LN:AF051917] [AC:AF051917:L19570] [PN:putative membrane
protein TraG] [GN:traG] [OR:*Staphylococcus aureus*] [DB:genpept-bct2]
[DE:*Staphylococcus aureus* plasmid pSK41, complete sequence.] [LE:29912]
[RE:30988] [DI:direct]

| ORF Name | NT ID | AA ID | NT LN | AA LN | Score | P-Value |
|---|---|---|---|---|---|---|
| AI7503012391__33786251__c3__230 | 3740 | 7512 | 1113 | 370 | 1926 | 6.0e−199 |

Description
sp:[LN:AACA__STAAU] [AC:P14507] [GN:AACA-APHD] [OR:*STAPHYLOCOCCUS
AUREUS:ENTEROCOCCUS FAECALIS*] [SR:,*STREPTOCOCCUS FAECALIS*]
[EC:2.3.1.—:2.7.1.—] [DE:AMINOGLYCOSIDE PHOSPHOTRANSFERASE, [APH[2″))]
[SP:P14507] [DB:swissprot] >pir:[LN:S26353] [AC:S26353] [PN:aminoglycoside
resistance protein aacA-aphD] [OR:*Staphylococcus aureus*] [DB:pir2]
>pir:[LN:A26048] [AC:A26048] [PN:aminoglycoside acetyltransferase]

-continued

[OR:*Enterococcus faecalis*] [DB:pir2] >gp:[GI:g152948] [LN:STAAGLSRA]
[AC:M18086:M29261] [PN:aminoglycoside resistance protein] [OR:*Staphylococcus aureus*] [SR:*Staphylococcus aureus* (strain SK982) DNA] [DB:genpept-bct1]
[DE:*S. aureus* transposon 4001 aacA-aphD aminoglycoside resistance
gene, complete cds, and right and left IS256 transposase genes.] [LE:1725]
[RE:3164] [DI:direct] >gp:[GI:g153586] [LN:STRBRP] [AC:M13771]
[OR:*Enterococcus faecalis*] [SR:*S. faecalis* DNA, clone pSF815A]
[DB:genpept-bct1] [DE:*Streptococcus faecalis* 6'-aminoglycoside
acetyltransferasephosphotransferase (AAC(6')-APH(2')) bifunctional
resistance protein, complete cds.] [NT:AAC(6')-APH(2') bifunctional
resistance protein] [LE:304] [RE:1743] [DI:direct] >gp:[GI:g3676454]
[LN:AF051917] [AC:AF051917:L19570] [PN:bifunctional aminoglycoside modifying
enzyme] [GN:aacA-aphD] [OR:*Staphylococcus aureus*] [DB:genpept-bct2]
[DE:*Staphylococcus aureus* plasmid pSK41, complete sequence.] [LE:42505]
[RE:43944] [DI:direct]

| ORF Name | NT ID | AA ID | NT LN | AA LN | Score | P-Value |
|---|---|---|---|---|---|---|
| AI7503012391__33786251__f2__66 | 3741 | 7513 | 390 | 129 | 644 | 4.2e−63 |

Description
sp:[LN:TRA6__STAAU] [AC:P19775] [GN:TNP] [OR:*STAPHYLOCOCCUS AUREUS*]
[DE:TRANSPOSASE FOR INSERTION SEQUENCE ELEMENT IS256 IN TRANSPOSON TN4001]
[SP:P19775] [DB:swissprot] >pir:[LN:JS0296] [AC:JS0296] [PN:transposase]
[GN:tnp] [OR:*Staphylococcus aureus*] [DB:pir2] >gp:[GI:g152947]
[LN:STAAGLSRA] [AC:M18086:M29261] [PN:transposase] [OR:*Staphylococcus aureus*] [SR:*Staphylococcus aureus* (strain SK982) DNA] [DB:genpept-bct1]
[DE:*S. aureus* transposon 4001 aacA-aphD aminoglycoside resistance
gene, complete cds, and right and left IS256 transposase genes.] [LE:102]
[RE:1274] [DI:direct]

| ORF Name | NT ID | AA ID | NT LN | AA LN | Score | P-Value |
|---|---|---|---|---|---|---|
| AI7503012391__34242300__c1__158 | 3742 | 7514 | 2037 | 678 | 3430 | 0.0 |

Description
pir:[LN:F36891] [AC:F36891] [PN:transfer complex protein TrsE]
[OR:*Staphylococcus aureus*] [DB:pir2] >gp:[GI:g310612] [LN:STATRSC]
[AC:L11998] [GN:trsE] [OR:*Staphylococcus aureus*] [SR:*Staphylococcus aureus*
(individual__isolate pG01) DNA] [DB:genpept-bct1] [DE:*Staphylococcus aureus*
conjugative transfer gene complex (trs).] [NT:putative] [LE:2981] [RE:4999]
[DI:direct] >gp:[GI:g3676439] [LN:AF051917] [AC:AF051917:L19570]
[PN:putative ATPase TraE] [GN:traE] [OR:*Staphylococcus aureus*]
[DB:genpept-bct2] [DE:*Staphylococcus aureus* plasmid pSK41, complete
sequence.] [LE:26584] [RE:28602] [DI:direct]

| ORF Name | NT ID | AA ID | NT LN | AA LN | Score | P-Value |
|---|---|---|---|---|---|---|
| AI7503012391__34642562__c1__174 | 3743 | 7515 | 207 | 68 | | |

Description
NO-HIT

| ORF Name | NT ID | AA ID | NT LN | AA LN | Score | P-Value |
|---|---|---|---|---|---|---|
| AI7503012391__35397177__c2__182 | 3744 | 7516 | 1062 | 353 | 1760 | 2.3e−181 |

Description
gp:[GI:g3676423] [LN:AF051917] [AC:AF051917:L19570] [PN:unknown]
[OR:*Staphylococcus aureus*] [DB:genpept-bct2] [DE:*Staphylococcus aureus*
plasmid pSK41, complete sequence.] [NT:Orf346] [LE:11188] [RE:12228]
[DI:direct]

| ORF Name | NT ID | AA ID | NT LN | AA LN | Score | P-Value |
|---|---|---|---|---|---|---|
| AI7503012391__35397177__c3__241 | 3745 | 7517 | 132 | 44 | 142 | 3.1e−09 |

Description
gp:[GI:g3676423] [LN:AF051917] [AC:AF051917:L19570] [PN:unknown]
[OR:*Staphylococcus aureus*] [DB:genpept-bct2] [DE:Staphylococcus aureus
plasmid pSK41, complete sequence.] [NT:Orf346] [LE:11188] [RE:12228]
[DI:direct]

| ORF Name | NT ID | AA ID | NT LN | AA LN | Score | P-Value |
|---|---|---|---|---|---|---|
| AI7503012391__36048212__c3__221 | 3746 | 7518 | 774 | 257 | 783 | 7.9e−78 |

Description
sp:[LN:YIL1__STAAU] [AC:P41369] [OR:*STAPHYLOCOCCUS AUREUS*] [DE:HYPOTHETICAL -continued PROTEIN IN ILES 5'REGION (ORF B) (FRAGMENT)] [SP:P41369] [DB:swissprot]
>pir:[LN:S40261] [AC:S40261] [PN:hypothetical protein B] [OR:*Staphylococcus aureus*] [DB:pir2] >gp:[GI:g438227] [LN:SADNAMUPR] [AC:X75439]
[OR:*Staphylococcus aureus*] [DB:genpept-bct1] [DE:*S. aureus* plasmid encoded DNA, mup R gene.] [NT:ORF B] [SP:P41369] [LE:<1] [RE:450] [DI:direct]

| ORF Name | NT ID | AA ID | NT LN | AA LN | Score | P-Value |
|---|---|---|---|---|---|---|
| AI7503012391__36605260__c1__169 | 3747 | 7519 | 630 | 209 | 1077 | 5.5e−109 |

Description
gp:[GI:g3676413] [LN:AF051917] [AC:AF051917:L19570] [PN:unknown]
[OR:*Staphylococcus aureus*] [DB:genpept-bct2] [DE:*Staphylococcus aureus* plasmid pSK41, complete sequence.] [NT:Orf204] [LE:72] [RE:686] [DI:direct]

| ORF Name | NT ID | AA ID | NT LN | AA LN | Score | P-Value |
|---|---|---|---|---|---|---|
| AI7503012391__3907943__f3__103 | 3748 | 7520 | 2010 | 669 | 3498 | 0.0 |

Description
gp:[GI:g3676420] [LN:AF051917] [AC:AF051917:L19570] [PN:oriT nickase Nes]
[GN:nes] [OR:*Staphylococcus aureus*] [DB:genpept-bct2] [DE:*Staphylococcus aureus* plasmid pSK41, complete sequence.] [LE:8115] [RE:10112]
[DI:complement]

| ORF Name | NT ID | AA ID | NT LN | AA LN | Score | P-Value |
|---|---|---|---|---|---|---|
| AI7503012391__3908407__c3__214 | 3749 | 7521 | 123 | 40 | | |

Description
NO-HIT

| ORF Name | NT ID | AA ID | NT LN | AA LN | Score | P-Value |
|---|---|---|---|---|---|---|
| AI7503012391__4300002__c1__153 | 3750 | 7522 | 126 | 41 | | |

Description
NO-HIT

| ORF Name | NT ID | AA ID | NT LN | AA LN | Score | P-Value |
|---|---|---|---|---|---|---|
| AI7503012391__4428802__f2__57 | 3751 | 7523 | 168 | 55 | | |

Description
NO-HIT

| ORF Name | NT ID | AA ID | NT LN | AA LN | Score | P-Value |
|---|---|---|---|---|---|---|
| AI7503012391__4486075__c1__154 | 3752 | 7524 | 975 | 324 | 1640 | 1.2e−168 |

Description
pir:[LN:B36891] [AC:B36891] [PN:transfer complex protein TrsA] [GN:trsA]
[OR:*Staphylococcus aureus*] [DB:pir2] >gp:[GI:g310608] [LN:STATRSC]
[AC:L11998] [GN:trsA] [OR:*Staphylococcus aureus*] [SR:*Staphylococcus aureus* (individual_isolate pG01) DNA] [DB:genpept-bct1] [DE:*Staphylococcus aureus* conjugative transfer gene complex (trs).] [NT:putative] [LE:521] [RE:1495]
[DI:direct] >gp:[GI:g3676435] [LN:AF051917] [AC:AF051917:L19570] [PN:TraA]
[GN:traA] [OR:*Staphylococcus aureus*] [DB:genpept-bct2] [DE:*Staphylococcus aureus* plasmid pSK41, complete sequence.] [LE:24124] [RE:25098] [DI:direct]

| ORF Name | NT ID | AA ID | NT LN | AA LN | Score | P-Value |
|---|---|---|---|---|---|---|
| AI7503012391__4586062__c1__176 | 3753 | 7525 | 141 | 46 | | |

Description
NO-HIT

| ORF Name | NT ID | AA ID | NT LN | AA LN | Score | P-Value |
|---|---|---|---|---|---|---|
| AI7503012391__4724035__c1__170 | 3754 | 7526 | 1134 | 377 | 1728 | 5.7e−178 |

Description
gp:[GI:g3676414] [LN:AF051917] [AC:AF051917:L19570] [PN:unknown]
[OR:*Staphylococcus aureus*] [DB:genpept-bct2] [DE:*Staphylococcus aureus* plasmid pSK41, complete sequence.] [NT:Orf423] [LE:755] [RE:2026]
[DI:direct]

| ORF Name | NT ID | AA ID | NT LN | AA LN | Score | P-Value |
|---|---|---|---|---|---|---|

-continued

| | | | | | | |
|---|---|---|---|---|---|---|
| AI7503012391_4745437_c2_190 | 3755 | 7527 | 2118 | 705 | 3603 | 0.0 |

Description
pir:[LN:A56976] [AC:A56976] [PN:transfer complex protein TrsI] [GN:trsI]
[OR:*Staphylococcus aureus*] [DB:pir2] >gp:[GI:g310616] [LN:STATRSC]
[AC:L11998] [GN:trsI] [OR:*Staphylococcus aureus*] [SR:*Staphylococcus aureus*
(individual_isolate pG01) DNA] [DB:genpept-bct1] [DE:*Staphylococcus aureus*
conjugative transfer gene complex (trs).] [NT:putative] [LE:7896] [RE:9998]
[DI:direct] >gp:[GI:g3676443] [LN:AF051917] [AC:AF051917:L19570]
[PN:putative topoisomerase TraI] [GN:traI] [OR:*Staphylococcus aureus*]
[DB:genpept-bct2] [DE:*Staphylococcus aureus* plasmid pSK41, complete
sequence.] [LE:31499] [RE:33601] [DI:direct]

| ORF Name | NT ID | AA ID | NT LN | AA LN | Score | P-Value |
|---|---|---|---|---|---|---|
| AI7503012391_5109675_c2_186 | 3756 | 7528 | 324 | 107 | 535 | 1.5e−51 |

Description
pir:[LN:C36891] [AC:C36891] [PN:transfer complex protein TrsB] [GN:trsB]
[OR:*Staphylococcus aureus*] [DB:pir2] >gp:[GI:g310609] [LN:STATRSC]
[AC:L11998] [GN:trsB] [OR:*Staphylococcus aureus*] [SR:*Staphylococcus aureus*
(individual_isolate pG01) DNA] [DB:genpept-bct1] [DE:*Staphylococcus aureus*
conjugative transfer gene complex (trs).] [NT:putative] [LE:1512] [RE:1829]
[DI:direct] >gp:[GI:g3676436] [LN:AF051917] [AC:AF051917:L19570]
[PN:putative membrane protein TraB] [GN:traB] [OR:*Staphylococcus aureus*]
[DB:genpept-bct2] [DE:*Staphylococcus aureus* plasmid pSK41, complete
sequence.] [LE:25115] [RE:25432] [DI:direct]

| ORF Name | NT ID | AA ID | NT LN | AA LN | Score | P-Value |
|---|---|---|---|---|---|---|
| AI7503012391_5314202_c3_219 | 3757 | 7529 | 918 | 305 | 1524 | 2.4e−156 |

Description
pir:[LN:D56976] [AC:D56976] [PN:transfer complex protein TrsL] [GN:trsL]
[OR:*Staphylococcus aureus*] [DB:pir2] >gp:[GI:g310619] [LN:STATRSC]
[AC:L11998] [GN:trsL] [OR:*Staphylococcus aureus*] [SR:*Staphylococcus aureus*
(individual_isolate pG01) DNA] [DB:genpept-bct1] [DE:*Staphylococcus aureus*
conjugative transfer gene complex (trs).] [NT:putative] [LE:12193]
[RE:13110] [DI:direct]

| ORF Name | NT ID | AA ID | NT LN | AA LN | Score | P-Value |
|---|---|---|---|---|---|---|
| AI7503012391_6929686_c1_152 | 3758 | 7530 | 693 | 230 | 1199 | 6.5e−122 |

Description
gp:[GI:g1762100] [LN:SEU40385] [AC:U40385] [PN:transposase] [GN:tnp]
[OR:*Staphylococcus epidermidis*] [DB:genpept-bct1] [DE:*Staphyloccous
epidermidis* plasmid pSK818 insertion sequence IS257 (818B) putative
transposase gene, complete cds.] [NT:Tnp; putative transposase] [LE:57]
[RE:731] [DI:direct] >gp:[GI:g1762102] [LN:SEU40386] [AC:U40386]
[PN:transposase] [GN:tnp] [OR:*Staphylococcus epidermidis*] [DB:genpept-bct1]
[DE:*Staphyloccous epidermidis* plasmid pSK818 insertion sequence IS257 (818C)
putative transposase gene, complete cds.] [NT:Tnp; putative transposase]
[LE:57] [RE:731] [DI:direct]

| ORF Name | NT ID | AA ID | NT LN | AA LN | Score | P-Value |
|---|---|---|---|---|---|---|
| AI7503012391_6929686_c1_163 | 3759 | 7531 | 693 | 230 | 1201 | 4.0e−122 |

Description
pir:[LN:A60634] [AC:A60634:C30471:S26349] [PN:probable transposase]
[OR:*Staphylococcus aureus*] [DB:pir2] >gp:[GI:g46597] [LN:SAIS2571]
[AC:X53952] [PN:transposase] [OR:*Staphylococcus aureus*] [DB:genpept-bct1]
[DE:*S. aureus* plasmid pSH6 DNA for insertion sequences IS257-1 and IS256.]
[LE:188] [RE:862] [DI:direct] >gp:[GI:g3676452] [LN:AF051917]
[AC:AF051917:L19570] [PN:putative transposase TnpE] [GN:tnpE]
[OR:*Staphylococcus aureus*] [DB:genpept-bct2] [DE:*Staphylococcus aureus*
plasmid pSK41, complete sequence.] [LE:40946] [RE:41620] [DI:direct]

| ORF Name | NT ID | AA ID | NT LN | AA LN | Score | P-Value |
|---|---|---|---|---|---|---|
| AI7503012391_6929686_c1_168 | 3760 | 7532 | 693 | 230 | 1205 | 1.5e−122 |

Description
pir:[LN:C60634] [AC:C60634:S26351] [PN:probable transposase]
[OR:*Staphylococcus aureus*] [DB:pir2] >gp:[GI:g46600] [LN:SAIS2572]
[AC:X53951] [PN:putative transposase] [OR:*Staphylococcus aureus*]
[DB:genpept-bct1] [DE:*S. aureus* plasmid pSH6 DNA for insertion sequences
IS257-2, IS257-3 and IS256.] [LE:1752] [RE:2426] [DI:direct]

-continued

>gp:[GI:g3676456] [LN:AF051917] [AC:AF051917:L19570] [PN:putative transposase TnpG] [GN:tnpG] [OR:*Staphylococcus aureus*] [DB:genpept-bct2] [DE:*Staphylococcus aureus* plasmid pSK41, complete sequence.] [LE:45713] [RE:46387] [DI:direct]

| ORF Name | NT ID | AA ID | NT LN | AA LN | Score | P-Value |
|---|---|---|---|---|---|---|
| AI7503012391__6929686__c2__197 | 3761 | 7533 | 660 | 219 | 1116 | 4.1e−113 |

Description
pir:[LN:A60634] [AC:A60634:C30471:S26349] [PN:probable transposase] [OR:*Staphylococcus aureus*] [DB:pir2] >gp:[GI:g46597] [LN:SAIS2571] [AC:X53952] [PN:transposase] [OR:*Staphylococcus aureus*] [DB:genpept-bct1] [DE:*S. aureus* plasmid pSH6 DNA for insertion sequences IS257-1 and IS256.] [LE:188] [RE:862] [DI:direct] >gp:[GI:g3676452] [LN:AF051917] [AC:AF051917:L19570] [PN:putative transposase TnpE] [GN:tnpE] [OR:*Staphylococcus aureus*] [DB:genpept-bct2] [DE:*Staphylococcus aureus* plasmid pSK41, complete sequence.] [LE:40946] [RE:41620] [DI:direct]

| ORF Name | NT ID | AA ID | NT LN | AA LN | Score | P-Value |
|---|---|---|---|---|---|---|
| AI7503012391__6929686__c3__229 | 3762 | 7534 | 693 | 230 | 1201 | 4.0e−122 |

Description
pir:[LN:A60634] [AC:A60634:C30471:S26349] [PN:probable transposase] [OR:*Staphylococcus aureus*] [DB:pir2] >gp:[GI:g46597] [LN:SAIS2571] [AC:X53952] [PN:transposase] [OR:*Staphylococcus aureus*] [DB:genpept-bct1] [DE:*S. aureus* plasmid pSH6 DNA for insertion sequences IS257-1 and IS256.] [LE:188] [RE:862] [DI:direct] >gp:[GI:g3676452] [LN:AF051917] [AC:AF051917:L19570] [PN:putative transposase TnpE] [GN:tnpE] [OR:*Staphylococcus aureus*] [DB:genpept-bct2] [DE:*Staphylococcus aureus* plasmid pSK41, complete sequence.] [LE:40946] [RE:41620] [DI:direct]

| ORF Name | NT ID | AA ID | NT LN | AA LN | Score | P-Value |
|---|---|---|---|---|---|---|
| AI7503012391__6929686__f3__115 | 3763 | 7535 | 684 | 227 | 1196 | 1.4e−121 |

Description
pir:[LN:B60634] [AC:B60634:S26350] [PN:probable transposase] [OR:*Staphylococcus aureus*] [DB:pir2] >gp:[GI:g46599] [LN:SAIS2572] [AC:X53951] [PN:putative transposase] [OR:*Staphylococcus aureus*] [DB:genpept-bct1] [DE:*S. aureus* plasmid pSH6 DNA for insertion sequences IS257-2, IS257-3 and IS256.] [LE:556] [RE:1221] [DI:complement] >gp:[GI:g3676455] [LN:AF051917] [AC:AF051917:L19570] [PN:putative transposase TnpF] [GN:tnpF] [OR:*Staphylococcus aureus*] [DB:genpept-bct2] [DE:*Staphylococcus aureus* plasmid pSK41, complete sequence.] [LE:44517] [RE:45182] [DI:complement]

| ORF Name | NT ID | AA ID | NT LN | AA LN | Score | P-Value |
|---|---|---|---|---|---|---|
| AI7503012391__822802__c3__213 | 3764 | 7536 | 1011 | 336 | 1647 | 2.2e−169 |

Description
gp:[GI:g3676426] [LN:AF051917] [AC:AF051917:L19570] [PN:putative replication initiation protein Rep] [GN:rep] [OR:*Staphylococcus aureus*] [DB:genpept-bct2] [DE:*Staphylococcus aureus* plasmid pSK41, complete sequence.] [LE:13205] [RE:14164] [DI:direct]

| ORF Name | NT ID | AA ID | NT LN | AA LN | Score | P-Value |
|---|---|---|---|---|---|---|
| AI7503012392__1442583__c1__19 | 3765 | 7537 | 144 | 47 | | |

Description
NO-HIT

| ORF Name | NT ID | AA ID | NT LN | AA LN | Score | P-Value |
|---|---|---|---|---|---|---|
| AI7503012392__1442583__c3__25 | 3766 | 7538 | 144 | 47 | | |

Description
NO-HIT

| ORF Name | NT ID | AA ID | NT LN | AA LN | Score | P-Value |
|---|---|---|---|---|---|---|
| AI7503012392__23671885__c1__18 | 3767 | 7539 | 159 | 52 | | |

Description
NO-HIT

-continued

| ORF Name | NT ID | AA ID | NT LN | AA LN | Score | P-Value |
|---|---|---|---|---|---|---|
| AI7503012392_2776391_f3_12 | 3768 | 7540 | 207 | 68 | | |

Description
NO-HIT

| ORF Name | NT ID | AA ID | NT LN | AA LN | Score | P-Value |
|---|---|---|---|---|---|---|
| AI7503012392_29323431_f3_15 | 3769 | 7541 | 123 | 40 | | |

Description
NO-HIT

| ORF Name | NT ID | AA ID | NT LN | AA LN | Score | P-Value |
|---|---|---|---|---|---|---|
| AI7503012392_30495306_f2_6 | 3770 | 7542 | 123 | 40 | | |

Description
NO-HIT

| ORF Name | NT ID | AA ID | NT LN | AA LN | Score | P-Value |
|---|---|---|---|---|---|---|
| AI7503012392_34023375_c2_23 | 3771 | 7543 | 501 | 166 | 790 | 1.4e−78 |

Description
sp:[LN:REMA_STAAU] [AC:P13969] [GN:REPL:REP] [OR:*STAPHYLOCOCCUS AUREUS:STAPHYLOCOCCUS SIMULANS*] [DE:REPLICATION AND MAINTENANCE PROTEIN (PLASMID REPLICATION PROTEIN)] [SP:P13969] [DB:swissprot] >pir:[LN:A29827] [AC:A29827:C46568] [PN:replication protein REP] [OR:*Staphylococcus aureus*] [DB:pir2] >gp:[GI:g153064] [LN:PE5PE5A] [AC:M17990] [GN:repL] [OR:Plasmid pE5] [SR:Plasmid pE5 DNA] [DB:genpept-bct1] [DE:Plasmid pE5 (from *Staphylococcus aureus*, strain RN451) repL protein and ermC protein, complete cds.] [LE:389] [RE:865] [DI:direct] >gp:[GI:g506624] [LN:STAPT48CG] [AC:M19652] [OR:Plasmid pT48] [SR:Plasmid pT48 (from *S. aureus* strain T48) DNA] [DB:genpept-bct1] [DE:Plasmid pT48 (from *S. aureus* strain T48) complete genome.] [NT:putative. ORF B.] [LE:64] [RE:540] [DI:complement] >gp:[GI:g2407672] [LN:AF019140] [AC:AF019140] [PN:Rep] [GN:rep] [OR:*Staphylococcus simulans*] [DB:genpept-bct2] [DE:*Staphylococcus simulans* erythromycin resistance plasmid pPV142 rRNAN-6-methyltransferase (ermM) and replication protein (rep) genes, complete cds.] [NT:plasmid replication protein] [LE:1699] [RE:2175] [DI:direct] >gp:[GI:g1791222] [LN:SCU82607] [AC:U82607] [PN:plasmid replication protein] [OR:*Staphylococcus chromogenes*] [DB:genpept-bct2] [DE:*Staphylococcus chromogenes* plasmid pPV141 erythromycin resistance plasmid, rRNA N-6-methyltransferase (ermM) and plasmid replication protein genes, complete cds.] [LE:1583] [RE:2059] [DI:direct]

| ORF Name | NT ID | AA ID | NT LN | AA LN | Score | P-Value |
|---|---|---|---|---|---|---|
| AI7503012392_4304683_c2_21 | 3772 | 7544 | 771 | 256 | 1270 | 2.0e−129 |

Description
sp:[LN:ERM4_STAAU] [AC:P13978] [GN:ERMC] [OR:*STAPHYLOCOCCUS AUREUS*] [EC:2.1.1.48] [DE:RESISTANCE PROTEIN)] [SP:P13978] [DB:swissprot] >pir:[LN:B46568] [AC:B46568] [PN:ermC protein] [CL:rRNA (adenine-N6-)-methyltransferase] [OR:*Staphylococcus aureus*] [DB:pir2] >gp:[GI:g455358] [LN:STAPT48CG] [AC:M19652] [PN:23S RNA methylase] [GN:ermC] [OR:Plasmid pT48] [SR:Plasmid pT48 (from *S. aureus* strain T48) DNA] [DB:genpept-bct1] [DE:Plasmid pT48 (from *S. aureus* strain T48) complete genome.] [LE:988] [RE:1722] [DI:complement]

SEQUENCE LISTING (7544 sequences)

SEQ ID NO: 1 - DNA, 135 bp, S.epidermidis
ataaacatctcctcttctaatcattcattctttgaattagatattaaatgtgattcattgcaatcacaagcttcacactctatcggaaaagcttctgttgctagggagaggtttaaatcggccatttgtgcataa

SEQ ID NO: 2 - DNA, 510 bp, S.epidermidis
agtattatatctaaatctgacataaatttctattattgtattaataaaaaaatttggagaagtgatattatgaaaacttttaaggcagtaagatttcaaattgtgaatgaacatggtgcaatatcagaatacgtcattgaagatggtgtgattataaataaagaaggaagtggcactgggtggttactagaaatagtaatttcaaatgaacactatgaaacatttaagcaatataaggataacaaacaacttttagatattagagtagtcatcacaagacctgctaacgatccagcgttatttaatgcaacagttaaaagcgttaaaaattttaaatattcaatgtcagtcgttttagaatgtcacatctacactttgagacaagaatacgctgagagtttattagaagaattagttgatgaaggacttacaggtgaaaagttgaaaaaaacatttaatcgtatgatgcaatcaaaacctaagttgaaagatgagaaaatcgaaagataa

SEQ ID NO: 3 - DNA, 135 bp, S.epidermidis
gataaatcatctgtattaaaaatatttccgaacacattatttactgataaaaagaaaaaaactgctaatatgagagcgacaaatcttaatccccatttactttcaagcatttatgaattcacacctttcttttga

SEQ ID NO: 4 - DNA, 693 bp, S.epidermidis
gaaaacaaatcacttttaggaggatttttaataatgaaaaaaacattagttgcatcatcattagctataggactaggcgttgtagcaggtaacgcaggtcatgacgcacatgcaagtgagactacaaatgttgataaagcagagttagctcaaaaagcgttaactaatgatcaatcactaaatgaaagccctgttcaagaaggtgcttataatattaattttgattacaatggtaattcatatcattttgaatctgatggttctacttggagttggagttatgaatcaacaaacaatgctacgcaacctgttcaaccaagccaatctcaagtagctacacaacaacaacctgtacaagtatcagcaccacaaaatgagcaaacagcacaaccacaaacaaaatcaacatctacaagtcaaacttcttcaagtaaagcttcaagtggttcatcagtaaatgtaaattcacatttacaacaaattgctcaacgtgaatcaggtggcgatattcatgcaataaacccatcttcaggtgcagcaggtaaatatcaattcttacaatcaacttgggattctgttgctccaagtcaatataaaggtgtttcacctgcaaaagctccagaaagcgtacaagaccgagcagcagtaaaattatataatactggtggcccaggtcattgggtaactgcataa

SEQ ID NO: 5 - DNA, 153 bp, S.epidermidis
atgcgtttgtcgtcccactcttttctaatagctacacttaaaatatttgagatcgtcaatttaaaattaaaatgtaagttattaaaaattaatgacctaaataagattgtaacatccaattatgcttatcaactgaagtttgcatgccgataa

SEQ ID NO: 6 - DNA, 126 bp, S.epidermidis
tctttcatgttgggctttttatattgtaattgcatttttgtgaaaatcctctttaaatattttattaatgctcatgcatataatttaaataagcataatgaaccagttgataaatatataatttaa

SEQ ID NO: 7 - DNA, 426 bp, S.epidermidis
ggtgatttcccacccaattcaagagacacttttttgaagtcttttgcagctttttccataatttttgaacctgtaggaccagaacctgtaaatgacatcattcttacttttggatgttcacttaaaggatttcctactccagatccatcaccattgactaagttaaacacacctttaggtacgcctactttatcaaaaatttctgctaaaataattgcagcaaatggtgtttcttcagatggttttaaaacaacagggctaccagcagcaaacgcagcagctaatttaagtgaagtttggtttgtagggaaattccaaggtgtaacaagtccagcaactccaattgcttctttaacaaccaaatcatcgccacgttgttcttcaaattggaagctatctaaagcatctcttgcagctgtaaaatga

SEQ ID NO: 8 - DNA, 300 bp, S.epidermidis
ggtagtatcccaccaacgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtag

SEQ ID NO: 9 - DNA, 714 bp, S.epidermidis
ttttattttttgaggaggctaattatgacattttcaaaagagttgagggaagcatcaagacctattattgatgacatttacaatgatggttttattcaagatttactagcaggtaagttatctaatcaagctgtaagacaatacttaagagcagacgcttcttatttaaaagagtttacaaatatttatgcaatgctcatacccaaaatgagttctatggaagatgttaaatttctagtagaacaaattgagtttatgttagaaggagaagttgaagcgcatgaggttctagctgatttcattaatgaaccatatgaagaaatagtaaaagaaaaagtatggccaccaagtggtgatcattatattaaacatatgtacttcaatgcatttgcacgtgaaaatgcagccttcacgattgcagcgatggcaccctgtccatacgtctacgctgtcattggtaaacgtgcgatggaagatcccaaattaaataaagaatcagtgacttctaaatggtttcaattttatagtactgaaatggacgaacttgttgatgtgttcgatcaattgatggaccgtttaactaaacattgtagtgagacagaaaaaaaagagattaaagaaaatttcttgcaaagtactattcatgagagacatttcttcaatatggcatatattaatgaaaaatgggaatatgggggaaataacaatgaataa

SEQ ID NO: 10 - DNA, 138 bp, S.epidermidis
catgtgtcacctccttcttatgttctaatcataactgagcttagttcactggtcaaaaccacaattttattgaaattgttagtaaatgacgatgagattttgatatatttaaagaaaatattgaagtattatatctaa

SEQ ID NO: 11 - DNA, 1131 bp, S.epidermidis
acaattacgttaaagaaaaaggctaaaagaactgtaattgtaatggaggaaaacgaaatgacaaaagaaaatatttgtatcgtttttggaggtaaaagtgcagaacacgatgtttcaattttaactgcacaaaatgttttaaacgcaattgataaagaacgatatcaagttgatatcatttatataacaaacgatggtgaatggaagaaaaaagataatattacacaagaaataaaaaatactgatgaactcgtcattaacgatgtagagactggagaaatctcacagttactcagtaaaggtagtttaggaaaatcatatgatgcagtattcccgttattgcatggtccaaatggagaagatggaactatccaaggtctttttgaagtacttgatataccatatgtaggtaatggtgtgttagctgcttcaagctcaatggataaactcgtgatgaaacaattatttgagcatagaggtttacctcaattaccttatattagctttttaagaagtgagtatgaaaaatatgaaaataatatcattaagttagttaatgataagttaacatatcctgtatttgtaaaacctgctaatctcggttcaagtgttggtataagtaaatgtaacaatgaagaagaattaaaatctgggatagctgaagcattccaatttgatcgtaaacttgtcattgaacaagggattaatgctagagagatcgaagtagctgtcttaggtaacgattatcctgaaacgacatggcctggtgaggttgttaaggatgtagctttttatgattataaatcaaagtataaagacggtaagattagattagatattccagcagatttagatcaagatgttcaaatgacattaagaaacatggcattagaggcctttaaagctactgattgttcgggattagttcgtgcagatttctttgttactgatgataatcaaatttatatcaatgaaacaaatgccatgccaggatttactgcatatagtatgtatccaaacttatggaaaaatatgggcttatcttaccctgatttaattgctaaattgattgatttggctaaagaacgttatgaagataaaaagaaaaataaatataaaattgattattag

SEQ ID NO: 12 - DNA, 672 bp, S.epidermidis
aggaggacgtttgaaatgagtattttagttattggagcaaatggaggcgtaggttctaaactagtaagtcaattaaatgaagaacacgttgattttacagctggtgtacgtaaggaagatcaagttaaagaattagaaaataaagggattaaagctacattaatagatgtagaaaaaaatagtattaatgatttaaaaaatatctttacagattatgataaagttatcttttcagttggatctggtggaagcactggagcggataaaacaatcattgttgatttagatggtgctgtaaaaacaattaaagctagtaaagaagcgggtatcaaacattatgttatggtatcaacatacgattctagacgtgaagcattcgatgcgagtggagatttaaaaccgtatacaattgcaaagcattatgctgatgattacttaagaacatcagatcttaattatacaattgtacatccaggttcacttacagatgatgctggaactggaaaaatagaagctgatttatatttcgacaaagcaggatcaattccacgtgaagatgttgctacagttttaaaagaagtagtaacttctgatggttttaataatcaagaattccaaattttaagtggcaatcatggtgttaaagatgcattgaaaaactatgaatcttaa

SEQ ID NO: 13 - DNA, 243 bp, S.epidermidis
aattttttttttcccctaaaaaaaagagttttttgttccgaaaacccttcttcattcaagcggggttgtttcgtcaaggcttttgcccattgcggaagattccctactgctgcctcccgtaggagtatggaccgtgtctcagttccagtgggggccgatcaccctctcaggtcggctacgcatcgttgccttggtaagccgttaccttaccaactagctaatgcggcgcggatccatctataa

SEQ ID NO: 14 - DNA, 1215 bp, S.epidermidis
tacgcaaagtttcaaagggagttagatacaatgcataataaacaaaagatattagattttatagaaaataataaatatgattatgtagaaataagtcatcgtattcatgaacgccctgaattaggcaatgaagaaatttttgcatcgagaacattaattgaccaattaagagcaaatcgattcgaaatcgaaacggatattgcaggacatgcaacaggatttatagcaacgtatgattctgatatgactggaccggttataggatttctagctgaatatgatgctttacctggtcttggtcacgcatgcgggcataatattattggtactgctagcgtacttgctgcagtagcactaaaagaagtcgtcgatgaaattggtggtaaagtagtcgttttgggatgtcctgctgaagaaggtggggaaaatggctccgcaaaagcttcttatgttaaagcaggtgtcattgatgaaattgatgtagcattgatgattcatcctggaaatgaaacctatcgtacaattaatactttagctgtggatgttctagatattaaattctatggacgtagtgcgcatgcatctgaaaatgcagatgaagcattaaacgctttagatgcaatgatttcatattttaatggtatagcacagttaaggcaacacattaaaaaaggacaacgagttcacggggttattttagacggtggtaaagcggctaatattatacctgattttacacatgcgagattttatactcgagctacttcacggaaagaacttgatgttttaactgaaaaagtaaaccaaattgcaagaggtgctgcgattcaaactgggtgtgattttgaatttggtcctatccagaatggtgtaaacgaatttatcaaagcgcctaaacttgatgatttatttgaaaaatatgcaactgaattaggagaagaagtgattgatgatgattttggttatggatctacagatacaggtaatgtaagtcatgttgtaccaactatacatccacatattaaaattggttctcgaaatcttgtaggacatacccaccgctttagagaagcggctgcaagtttacaaggtgatcaggcactcattcgaggtgcaaaaattttagcattaatgggactagaattaatcgaaaataaaccgttgttagacgaaataattgaagagcatacgcatataaaggggcatgttaagtaa

SEQ ID NO: 15 - DNA, 1194 bp, S.epidermidis
atgatgactacaccgttcaaaagaattcatctaatagttatggactcagtaggtataggcgaaggtcctgatgcagcggcattcaatgacgaaggatcacacactttaaagcatactttagaaggatttaagcaaaagttaccacatctagaacaacttggattaggaaatattgcaccgcttcctgttgtttcaaaagttacacatccaggtgcattttataccaaactaagtgaagcttcagtaggtaaggatacaatgactggacattgggaaattatggggttaaatataatgcaaccatttaaggtttatccaaatggtttcccagaagagcttgttaaagagattgaagatatgactggacgaaaggttgtagcaaatagacctgcttcaggaactcagattattgacgagtggggcgaacatcaaatgaaaactggagatttaatagtttatactagtgctgatccagtcttacaaattgctgcacatgaagacgtgattccacttgaagaactttacgagatttgtgaaaaagttcgtgaactaacaaaagatcctaaatatttaatagggagaatcattgctcgaccatatgttggtgaacctggtaacttcactagaacttctaatcgacatgattacgcgttaaaaccatttggacgaacagtgatgaatagccttaaagatagtggttatgatgtaatcgcgattggtaaaattaacgatatttatgacggtgaaggcgtgacagaagctatacgtactaaaaataatatggacggtatggatcaattgattgaagttgtaaaaaaagattttgaaggtatcagtttccttaatttagttgattttgatgcattgtatggccatcgtcgtgataaagaagggtatgctcaagcaattaaagattttgatcttcgtttacctgaattaatgaatcatttaagagaagatgatttagttattattacagctgatcatggtaatgatccaattgctaaaggtacagatcatacacgtgaatacattccacttttaatgtttagtccgaaaattaaagattatcatgaactttcacaagacacgacatttagctctatcggtgttacaatagcagataacttcaacgtagaattacctaaatatggaaaaagttatttaaaagaaatgggggttgagcatcaatga

SEQ ID NO: 16 - DNA, 912 bp, S.epidermidis
attatgtggttttgctttttgaaatccggatttataataattaaacaaattttaagcactccttttttttcatataaatacaatatcaaaattctaataaattttaaattaatatctaacataatagagcacaaaatgttagaatatgctaataagataacattgaagggagataatatcatgaaatttgctgttatcactgatattcatggaaactttgatgcgcttcaaactgttttagatgatattgatagtagagatgatatcgaaaaaatttataacctaggtgataacatagggattggacatgagacaaataaagtactggatactatatttgaccgggatgatatggaaatgattgcaggtaatcatgatgaagctattatgtcactcgtcaatggaacaccttatcctgaagatttaaaagggaaattttatgagcatcatcaatggatagaaggacatttagatgagtcctattacgatgaaattaatcaattgcctagatatattgaaatgaccataaaagggaaaaagattttatttattcattatgaaattgaaaatgataaaatgtcagctcctattgatgaacaaccttttgcacctattacaaaagatgacgaacaagctatttctgaattatttaaagacaaagaagccgatttaattttatttggacataaccataggttgcatatgtttgatgataaatcaacagtatattttaatcctggatcagtaggtttgaacaatggttcaaacaccgtatatggtattattaccgttaatgaaaaaggaatttcagtagagagagtgaaattagcgtacaataatgaagaatttttagcaggatttgaagaaaagcaagtaccagctagagaatttatatttaagaatttcatttaa

SEQ ID NO: 17 - DNA, 162 bp, S.epidermidis
tcggcccccactggaactgagacacggtccatactcctacgggaggcagcagtagggaatcttccgcaatgggcaaaagccttgacgaaacaaccccgcttgaatgaagaagggttttcggaacaaaaaactcttttttttaggggaaaaaaaaaattttaa

SEQ ID NO: 18 - DNA, 1029 bp, S.epidermidis
atgatatacacgtttcaactttacttaaacaagccattcaccactccaaacatcctagtgaaggtggaatttctaatgacaaatcataatcatcaacatcatcattctcatgcacacggacacgttcatacagataataaaaaggtactcatgttttctttcattatcattagtctcttcatgcttgtagaaattataggtgggtttttagcaaatagtctagcattattgtctgatggttttcacatgctaagtgacgctatatccttaggagtagctcttatagcttttatatatgctgaaaagcatgctacaaaaagtaaaacatatggttacaagcgttttgagattttagcagcacttttcaatggagttaccctatttatcatcagtattattataataatcgaagcgatacgaagatttttagaacctcctgaggttcaatcgaaggaaatgttcatcattagtgtgattggtcttatggtaaatatcattgtagcgatacttatgtttaaaggaggagatacctctcacaaccttaatatgagaggcgcatttttacatgtacttggagacttgttcggctctgttggcgcaatcgttgcttctcttttaatttggggctttaattttacaatagcggatcctatagctagtattttagtttcgttaattattttaaaaagtgcttacggcatttctaaatcatcccttaacatattgatggaaggaacgcctaatgatatagatttaaatgctgtaattaaagcaattagtaaagatgaaagaattcaaaatgtacatgattgtcatgtatggaccatttcaaatgatatgaatgcattaagttgtcatgcagttgtaccagaatatttatcagttcaaacgtgtgaaacaatgttaaagtcaatcgaaagtgacctattgcaattaaatattcagcatatgacaatacaacttgaaacaccagaacacaaacacgatgaatcaacattgtgctcaggtatacatgaacactctcattag

SEQ ID NO: 19 - DNA, 1686 bp, S.epidermidis
atacataggttactcacagtttttaatagattttatcaatcattaaatagtttactaaattttacaggaggtcagacaatgacaaagtttatttttgtaacaggcggggttgtgtcatcattaggaaaaggaataacagccgcttctctaggaagattacttaaagatagaggacttaaagttacaatacaaaaattcgatccatatttaaatgtagacccaggcacaatgagtccgtatcaacatggtgaagtgttcgttacagacgatggtgctgagactgatttagacttaggacattatgaacgttttatagatattaatttaaataaatattcaaatgttactgccggaaaagtatattcacatgtgttgaaaaaagaacgccgtggtgattacttgggtggtactgtacaagttattccccatattacaaacgaaattaaagaaagattgctattagctggtgagagtactaatgcggatgttgtaattactgaaattggtggaacaacaggtgatatagagtctttacctttcttggaagccattcgtcaaattagaagcgacttaggtcgtgaaaatgtaatgtatgtacattgtactttgctaccatatattaaagctgctggggaaatgaaaacaaaacctacacagcacagtgttaaagaattacgaggtctaggtattcaacctgatttaatagtagtacgtacagaatacgaaatgacacaagatttgaaagacaaaatcgccctattttgtgatatcaaaaaggaaagtgttatagaatgtagagatgcagattctctttatgaaattccgttacaacttagtaagcaaaatatggacgacattgttattcaacgtttacaattaaatgccaagtatgaaacgcaattggatgagtggaaacatctattaaataccgttaataatttagatggtaaaattacaatcggtttagttggtaaatatgtgagcttacaagatgcttatctatcagttgttgaatcacttaagcatgctggttatccatttaaaaaagacgttgtggtaaaatggattgattcaagtgaggtcaatgatgataatgttgaggcttatttatccgacgttgatggtattttagttcctggtggatttggattcagagcaagtgaaggtaaaattgcagctattcgttatgcccgtgagaataacataccattctttggcatttgtctaggaatgcaattggcaactgttgaatttgcgcgtcatgttttaggctatgaaggtgcgcattcagcagaattagatccaagtacaccatatccaattatagatttattaccagaacaaaaagatattgaagatttaggtggaaccttaagacttggtctttatccttgccacattaaagaaggtacattggcagagaaaatttataataaaaacgatattgaagaacgtcatcgtcatagatatgaattcaataacgagtttagggaacaattagaaagtaacggtatggtattttcaggtacaagtccagatggtcgtttagtagaaattattgaaatacctaaaaatgatttctttattgcatgtcaattccatcctgaattcttatcaagacctaatcgtccacagcctatatttaaatcatttgtagaagcggcgttgaattaccaacaaaaataa

SEQ ID NO: 20 - DNA, 138 bp, S.epidermidis
tacaatttaacctgtaccaaaataagagacactattcacaatgaacagtgtctctctttatatattaatttagataatcaatacataaaatattatattatcatgcaaattattttaattcatgacttacttgattag

SEQ ID NO: 21 - DNA, 126 bp, S.epidermidis
agtaaaataacactaagagacaaaataaataatactttaatttctcaaaacatctgcctaaatgatcttaattttgagcttgttcatcttcttttattatcaattaaattatattttatcaattag

SEQ ID NO: 22 - DNA, 171 bp, S.epidermidis
ttgttgcaaactcatatttatgtgaaagtccgttttgaattaaccaaattgcatagttataacaataaacacaatttccatcataataaattattggcatgtgtatacactcctttttcattgcttaattatttatattcccatttaggtataataaataaaccttattaa

SEQ ID NO: 23 - DNA, 294 bp, S.epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagttggtcccaagggttgggctgttcgcccattaaagcggtacgcgagctgggttcagaacgtcgtgagacagttcggtccctatccgtcgtgggcgtag

SEQ ID NO: 24 - DNA, 471 bp, S.epidermidis
ctatggttgacccaaatgaataatttagcattacaaagccttaccgaaagtatagcgataaagtattttggcaaagcttttaagcacgaggtatattataataagcgtttacgtaccactggcggtagatatatattaagtagtcataatatagaaataaatccaaaacagtatgaaatgtttggagaaaaagcagtcattgatatcataaaacatgaactgtgtcattattttcttcatttagctggtgaaggatatcaacatcgtgataaagcattcaaaattttgagtgccaaagtaggagcacctaggttttgtactccgacagaatcttatcaagatagagctaattataaatataggtgcatctattgtgaacaagaatttattcgtataaagcgtgtgaatcttgaaaaaatgcgttgtggacgatgtggaggtattttaaaacttattcaaacaagaaagtga

SEQ ID NO: 25 - DNA, 123 bp, S.epidermidis
ctccgtcatgcgctggttcgaatccagctagcccagccattagagccattagctcagttggtagagcatctgacttttaatcagagggtcagaggttcgaatcctctatggctcactttctag

SEQ ID NO: 26 - DNA, 786 bp, S.epidermidis
tcatattgcgccctctactacaaagggagtaaaaatttaatagaaagaggtgagtttatggatcacaaatccccactcgttagttggaacgtctttggtttcgatattgtttttaatttggccagtgttttaatggtagtgattacagcaattttagtttttattttagctatagtttgcactcgaaacttaaagaaacgaccaactggaaaacaaaacttcattgaatgggtatttgattttgttagaggtattattgaaagtaatatggcctggaaaaaaggtgggaatttccacttcttagcagtgacattaattcttttcatttttgtggccaacatgcttggtttaccgttcgcaattgtcactcatgaccatacgctatggtggaaatcaccaacagcagacgctacggtaactctaacgttatctacaactatgattttgttaacgcactattacggtattaaaatgcgtggaacaaaagcttatgcagctggatattttaaacctttctggccattagctattattaatgtattcgaagaattcacttctacattaactttaggtctacgtttgtacggtaatatttttgcaggtgaattattactcggtttacttgcatcattgttctttgaacaacctgcatggggttggataattagtattcctggattaattgtttggcaagcgttctctatattcgtgggaacaattcaagcatatatctttgtaatgctttcaatggtttacatgtcacataaagtggcagacggacattaa

SEQ ID NO: 27 - DNA, 156 bp, S.epidermidis
gatatgtatttgaagctaactatctttctcactcgtattgagtgtagcatatatgattatttcacaaactactatatgaatatactatcattttataaactttctatcctgtgtccatttgacgtaggattcttacatattatatcaactgcctaa

SEQ ID NO: 28 - DNA, 165 bp, S.epidermidis
ccgttatattaccattttaagataacatttgtttatcttttttgcgaatttttgtactatataattgaaggtaaatatgttttgttttttaacgatatattaaagttatatgaagatttattatttggagatagtaataaactaaaaaacatggaggaaaaatga

SEQ ID NO: 29 - DNA, 1215 bp, S.epidermidis
gcaatgaattattcttctcgtcaacaacctaaacgtaactggttacgtaaagtagactggatactcgtactagttatatcactattagcactaacaagtgttattttaatcagttccgctatgggtggcggacaatatagtgcaaatttcagtattagacaaattatttattatattttcggagctattattgcatttttaattatgataatttcaccgaagaaaattaaaaataatacttatattttatatagtatattttgcgttctattaatagggttacttattttacctgaaacttcaatcaccccaattattaatggtgctaaaagttggtacagtttcggtcctataagcatccaaccttccgaattcatgaaaattatacttatacttgctttggctaaaacgatatctaaacataatcaatttacatttaataagtcttttcagtctgatttaatgttattttttaaaattttaggtgtatccattatacctatggcattaattctattgcaaaatgacttaggtactactttggtgttatgtgcaattatagctggcgtcatgttagtaagtggaataacatggaggatattagcccctctatttattgttgcatttgtgagtggttctagtattatattagctatcatttataaaccatccttgatagaaaacctattaggaataaaaatgtatcaaatgggacgtatcaattcttggttagatccctattcatacagtagtggggatggatatcacttaacagaatctttaaaagctattggttctggtcaattattaggtaaaggttataaccatggcgaagtttatattcctgagaatcataccgactttattttttcagtgattggagaagaaatgggctttataggttcagtattattgatattacttttcttattcttaatatttcaccttatacgattagctagtaaaattgatagtcagtttaacaaagtatttatcataggatatgtatcgttgattgtttttcacgtgttacaaaatatcggcatgacggttcaattactaccgattacaggtataccacttccgtttattagttacggtggaagttctttatggagtttaatgactggtataggagtagttctttcaatttattatcatgaaccccaacgatatgaaatacccacattatctaaaaaatctaatacaatttaa

SEQ ID NO: 30 - DNA, 636 bp, S.epidermidis
ttaagcgattatgttttgaaaaaggtggaactatcaatgtatgaaacgtaccattcaggttggattgaaaccataacaggaagtatgtttagtgggaaatctgaagaacttatacgtcgcttaagacgtggaatatacgctaaacaaaaggtggttgttttcaaaccagcaattgatgatcgttaccataaagaaaaggtcgtctcacataatggtaatgagatagaagcgattaatatatctacagctcaagaaattttaaatcatatgctagaagaagtaaacgtcatcggaattgacgaagtgcaattttttgaagacgatattgtcaacatagttgaaaaattagctgaaaacgggcatcgtgttattgtagcaggtttagatatggattttagaggagaaccgtttaaacctatgcccaagttgctcgcagttagtgaacatattacaaagttgcaagcagtatgttctgtatgtggttcaccttcgagtcgtacacaacggttaataaatggtgaaccggcgaaagtagatgatcccatcatattggttggtgcaaatgaaagttacgagccacgttgtagagcacatcatatagttgcacctagtgaaaatgagaaggaggaaatgtag

SEQ ID NO: 31 - DNA, 165 bp, S.epidermidis
atctatacctattccataaatcacttgtatcgcctctttagtatatcaccaataatcttttatcaagtcttttatatatcatcgtttaatttttctaatgaagttacatttgtcgttattgatttttgttgtttaatttgttttttcaatctttgtgcttcttga

SEQ ID NO: 32 - DNA, 573 bp, S.epidermidis
caagtttgctatgttccttttttattttatacaaaggggtgggttcaaatgcgtgatttacaacaactgcttgatgaattgaaagatatgtcattctttaatccaggcgaaatgtgtatcattggttgttcaacttccgaagttataggtaaacgtattggttctgttggatcaatggacgtagctaaagaaatttacgaaaatttgaaacaactagagattgatacaggcgtgacatttgcttttcaaggatgtgaacatattaacagggcagtaacgatagaaagagcaaatttcaacccattgactatggaagaagttactgtcgttccagacgttcatgcaggtggtagtttatccacttacgcttatcaacaaatggaagatcctattgttgttgagcatattactgtttcaaaaggtatagatataggtcagaccttaattggaatgcatattaaacatgtgtgtgttcctgtaagaacaagtgttaaacaaattggagaagctatcgttaccatagcgacatctagacctaagaaaattggtggcgaacgagctaaatatcaataa

SEQ ID NO: 33 - DNA, 1587 bp, S.epidermidis
gtgaacatatatgtaaaaaagcatattaagaaatatacacgtaaaaggagaattattttgcaaaattttaaagaactagggatttcggataaaacggttcaaacattagaagcaatgggatttaaagaaccgacacctatccaaaaagatagcatcccttacgcgttagaaggagatgacatccttggacaagcccaaactggtactgggaaaacaggggcgtttggtatacctttaattgagaaagttgtaggccaacagggtgttcaatcattaattcttgcgccaacgagagagcttgctatgcaagtagctgagcaattaagagagttcagtaaaggtcaaaaagtacaagttgttacagtctttggtggtatgcctattgaaagacagattaaagcattaaaaagaggccctcaaattgtagtaggtacgccgggaagagttattgatcatcttaatcgtcgtacacttaaaactcaaggaattcacacgcttattttagatgaagcagatgaaatgatgaatatgggattcatcgatgatatgagatttattatggataaaattccagctgaacaacgtcaaactatgctattttctgctacgatgccaaaagcaatccaagaattggtacagcagtttatgaaagctcctaaaataattaagacaatgaataatgaaatgtcagatcctcaaattgatgaatattatacaatcgttaaagaattagagaaatttgatacatttacaaactttttagatgttcatcagcctgaattggcgattgtctttggtcgtactaagcgtcgcgtagatgaattaacaagcgcgctattatctaaaggatacaaagcagaaggtttacatggggatattacccaagcaaaacgtttagaagtattgaagaaatttaagaacgatcaaatagatattttagttgctacagatgtggctgcacgtggtcttgatatttctggtgtgagtcatgtttataattttgatatccctcaagatacagaaagttatacgcaccgtattggacgtactggtcgagcaggaaaagaaggtattgcagttacttttgtaaatccaattgagatggattatattcgacaaattgaagatgtcaataatcgtcgaatgaaagcattaagacctccacatcgtaaagaggtgcttaaagcgcgtgaagatgatattaaagatagagttcaaaactggatgtcaagagaaaatgagccacgtttacaaagaatatcaagtgaattacttaaagaatatgatagtacagaattagtagcctctttacttcaagaacttgtagaagctaatgatgaagtggaagtacaattaacttttgaaaaaccattagcacgtaaaaatcgcagtaataaaggcggttctagaagaagtaatcataaacgtggtaatggtaagtttgataataaaaatagacgatcaaaagggtctaaaggtcaatcaagcaaaaagaaaaaccaaaagaaatttgaccgtagagataagcaacaaaaaagtggtaatcaatcactaaaaggtcgcacatttgctgatcaccaaaaataa

SEQ ID NO: 34 - DNA, 141 bp, S.epidermidis
aaatatgtatattggcgcaaattgtcattaaaatttagttctatatttagattatcaaatgcaattgaatttaaaaatatgataatattaagtttcagaagccgttatgtacttaaagtagtaaataaaaagatcaattaa

SEQ ID NO: 35 - DNA, 327 bp, S.epidermidis
ataatacgatataatatgaacagaggtgactttatggcagacatggagagtgcacatcactcagagcaaataaaaacaaatttaaaatcaagattaaatagaatagaaggtcaagtaagagcaataaatcgtatgattgatgatgacgtttactgtgatgatgtactaactcaaattagagcaacacgttcagcattgaatagtgtagctactaaattactagaccatcacatgaaaggttgtattatggaaaaaataaacgacggtgcgcaagaagaagcaatggatgaattgctcgtgacattccaaaaattaataaaagattaa

SEQ ID NO: 36 - DNA, 207 bp, S.epidermidis
tctgtgcgatattctttaaataagttttactattttgttatcacaatacgaattattttacctaaagagtttaattatctaagattaagcatcttgaatagcaaaagtaagttcacagctacaagcaagttggccatcaacagtcgctttagccgaacccttaccaataggaccttttattttagttatttcaacttccaacattaa

SEQ ID NO: 37 - DNA, 147 bp, S.epidermidis
aaattgaagtatttaaaaacaaattacaacaattctaacgataataggaacgaactttgtatcaagttgtattataaaagacaaataatttttaatacgtacttaattttaaattttaagattcatagtttttcaatgcatctttaa

SEQ ID NO: 38 - DNA, 129 bp, S.epidermidis
tttaaatatctttgctattggtcattgaacataagttcagtggcctctttttatgctataataatgacagaaatttacattttatggttacaatattcaatttcgggaaggttttatataataaaatag

SEQ ID NO: 39 - DNA, 150 bp, S.epidermidis
aattctcatcttgactacctgtgtcggtttgcggtacgggcacctgttatctatctagaggcttttctcggcagtgtgaaatcaacgactcgaggaaacaatttcctctccccatcacagctcagccttatgagtgccggatttgcctaa

SEQ ID NO: 40 - DNA, 375 bp, S.epidermidis
acaaatattcatatgttggagtgtgaattttcaatgagtggatatcatattaacgttgaaagcaatcaggatacattgattaaagtcactcatattttcaaagctttaagtgattttaatcgtgtgagaataatggagtttcttgaaaacggtgaagcaagtgttggacatatttcacattctttaaatatgactcaatcaaatgtatcacatcaattgaaactacttaaaagcactcatcttgttaaatctaaaagacaagggcaatcaatgatttattctatagatgatatacacgtttcaactttacttaaacaagccattcaccactccaaacatcctagtgaaggtggaatttctaatgacaaatcataa

SEQ ID NO: 41 - DNA, 132 bp, S.epidermidis
atgatttctcatcaaccatttcttttgtgtaatcttgaattttcatataaaaatacttcctttcaaaggattttctttaaattaacgtcaaataatcatttgttaatagtaacaaaaataaattataaatga

SEQ ID NO: 42 - DNA, 672 bp, S.epidermidis
aaatcaagtcaaaaaggtagagatatgaatatgatgtttgattcaaaacaattatcagtctattttatttgcggaacacaagatatacctaaaaataaatcaattgagcaagttctcaaagaggcattagaagctggaatcacgctatatcaatttcgtgaaaaaggtccgaatgcactaaaaggggaaaagaaaaaacagttagccttaaaacttaaacaattatgtcactcatatcacgtacctatgatagttaatgatgatgttcaattagcccaagagattaatgctgatggcattcatgtaggtcaagatgatatggaaattcaacaatttgcaagccaatttaaaaataagattataggtttaagtgttgggaatttgaaagagtatcaacaatctgatttgtctaaagttgattacattggagtaggtccaatgtatacaacatcatcaaaagatgacgctagtaaacctgttggtccatctatgatatctcaattaagattatatattcatgattttcctatagttgccattggaggtataaatgaaactaacgtgcagcctattgttgacgaaggtgcagatggtatttctgtcatctcagctattacacgtagtaccaatatagacaaaacggttaaatatttcttaagatatttcacctaa

SEQ ID NO: 43 - DNA, 669 bp, S.epidermidis
gtaaggagtctatctatgaactcaagaatgaagattaaaaaagcttatgagtatatgaaaagtttccatcaacatgatacaactggacatgatattgcacatgtggaacgtgtctataacaacgcttgttatatcgctaaacgagaaaatataacagatacacttgttatagaactatcatctttattgcatgatactgttgatagtaaattaactgatgaaattttagcatatgatcagcttaaacagttcttatctaccctagatttaagcagtgaaatatcacaacaagttctctatattattaaacatatgagttatcgagctggtaaaaataatcacgttaaactttcaatagatggtgaaatcgttagagatgctgatcgcctagatgcaataggagcaatcggcattgcgagaacattccagttttcaggacactttggtgaacctatgtggactgaaacgaagctttcaaatgaagagttacatacgtctctcgttgaagaattagacaattcagcaataaaacatttttatgaaaaattatttaaattaaaagatttaatgcacactcctactgcaaaaaaacttgctgaagaaagacatcaatttatgattcaatatctcaaacaatttatgtcagagtggaattttaataaagagtaa

SEQ ID NO: 44 - DNA, 687 bp, S.epidermidis
actaaaaaacatggaggaaaaatgatgaataaagcaaaattgatagaccatacattattaaaacctgattcaacaaaggaacaaatagatactattataaatgaagcaaaagcatatcagtttaagtctgtatgtgtgaaccctacacatgtacaatatgcatctgaacaacttaaaggaacagacgttttagtgtgtactgttattggatttccactaggtgcaacaactacagcggttaaatcttatgaaacaaaagatgcgattaacaatggtgcccaagagattgatatggtgataaatattggagcacttaaggatggctgttttgatgaagtgcaaaatgatatcgaagccgtcgttcaagcagccaatggtaaaacagttaaggtaattattgagactgttttattaactgagaaagagaagattaaagcatgtcaattatctgaagcggcaggtgcacattttgttaaaacatccacaggttttgctggtgggggtgcaacagttgaagatgtaaaattaatgaaagatactgttggtgatcgtttagaagtaaaagcgtcaggcggcgtgagaaatctagaagattttaataatatgattgaagcgggtgctacacgtattggtgctagtgccggtgtgcaaattattcaaggacttgaatcaaatactgattactaa

SEQ ID NO: 45 - DNA, 486 bp, S.epidermidis
aataacatgcaatctacacaagattatattgaaatgcggttgccagcttctgcagaatacgtaagtttaatacgtttgacgctttcaggggtgttttcaagagctggcgcatcttacgatgatatagaagattctaaaatagcagtgagtgaagcggtgacaaatgcggttaaacatgcatataaaaaaaattctgaaataggcatgattaatctttgttttgaaatatttgatgatagaattaaaattgttatttcagaccaaggagaaagttttgattatgaagccacaaaatcacatttaggtccatataatgataatgaaaatattgattttctacgtgaaggtggtctaggattatttttaattgagtctttaatggatgaagttactgtttataaagaatctggtgtaacaatcagtatgattaagtatataaaaaaagagcaggtgcgaaataatggcgaaagagtcgaaatcagctag

SEQ ID NO: 46 - DNA, 2187 bp, S.epidermidis
gtaatttttaaagaaaagcgtggtagaaaaaaacaaatggataacagtttaattgaaacaattgtaagtaaatatcaattttcggaaaaacaaattaaagcagttttaaaattgctgaaagaaaacaatacggttccatttatagcgagatatcgtaaagaagctacaggtggacttgatgaagtagaaattaaacaaatcaatgatgaatataactatatgttaaatcttcaaaaacgtaaagaagaagtaatacataatattgatcaacagggtcttttaacttcagatttaaagcaagacatattaacacagacgaagctccaaagagttgaggatttgtatcgtccatataaacaaaaaaagaaaacacgtgcaactgaagctaaaagaaaaggattagaagatttagcagattggttttcacaatcaaaattggatacaaaaattgaagataaagcccaattattcttaaatgatgaagtgactacaattgaagatgcaatagaaggagctaaagatattatagctgaacgtatttcggataatcctcaatatcgctctaaaatacttaaagatgtttttaatcagggactaattgtttcctcgaaaaagaaaaaagccgaagatgagaaacaaacattttctatgtactatgattacaatgaaccaattaaacgtattgctaatcatcgtgttttggcgatgaatcgaggagaaaaagaaaaagtattatcaataaaaattgattttgacacgacacgtattcaaagagaaatagcaaatgttgagataaaaactcaaaatgaggcaactccgtttattaaagaggctattcaggatagtcttaagcgattaattcttccttcaatagaaagagaaattagaggagatttaacacaaaatgcagagtctcatgcaatagatgtattcagtgaaaatcttagaaatttattactacaaccaccaatgaaaggtaaacaaattcttggagtagatccagcatttagaacaggttgcaagcttgctgtcgtcaatccatttggtacctttattgctaaaggtgttatttatcctcatccaccaatatcaaaagttgaggaagcggaaaaagagctagtaaaggtgataagtgactataatattgagcttttagcgattggtaacggtactgcgagtagagaaactgaacaatttgttgctaaagtaataaaaaaatatcaacttcaagctcaatttatcatagtcaatgaagctggcgcatcagtttattcagcatcagaaattgctagacaagaatttccagattttcaagtagaagaacgaagtgcagtttcaattggtagaagagttcaggaccctttaagcgaacttgttaaaatagatcctaaatctataggagtaggacagtaccaacatgatgtcaatcaaaaagatttaagtagtgccttaacgtttgtagtagagactgccgtcaatcaagttggtgtggatgtgaatactgcttctaaatccttgttacaatatgtatcaggtcttacatcaactatcgctcaaaatattattgattatagagaagaaaacggacctataaaacatcataaagaaataagtagtattaaacgattaggtgcaaaaacatttgagcaaagtattggttttttaagaattgttgatggtgaagaacctttagataatactgcaatacatcctgaaagttacgatgttgcatatcgcatgcttcatcaactagatttaactgcacaagatataggttccgttaaactcaaaaatacgttatcaaatgttaatatttcaacacttgtgtctcaattaaatattggtgaacctacattaaaagatataatacaatctttgattgcacctaatagagatccaagagatgaatttgaaacacctattttgaagtccgatgtattatcgattgaagatttatctaaaggcatgaagttgaatggtacagtaagaaatgttgttgactttggagcatttgtagatatcggtgttaaacaagacgggctagtacacatatcaaaattatctaagaaattcgttaaaaatccaatggatatgataagtgtaggagatattgtagaagtttggattttagatatagatgaaaataaaggcaaagtttcattgactatggttgacccaaatgaataa

SEQ ID NO: 47 - DNA, 1404 bp, S.epidermidis
attaattttaagataaggagcattataatgactgaggaaattaactatttttggcttaattgtggttacaatagatggaatcataatgaaccattagtgggacagacagcgttatttgaatctggcgcacattttaatcctacacaaggatatagagcatttaaaaaagctaaagctggagatcaagtgattttctatcaagtacaaacagattctggacttttaggtataggtgaaattataagtgtgcaatccggtgctcaaaataaaataagagtagaatttaaatttaaagaaacgctaaaaccacttacaacggattatcttaaaagaagtgaaacactcgattttcgtatgagtaacatgagggaaacacttttcaaccaaatcagagagtcagaatttgagttaatagttagtttaggtaaaggaaaatcgaaaattcctcgatattttttattagcagaaacagaagcgtttgaacctggtaaaaactatactatatttactcatacatttaatggaatcaaaaggaatggttatcatttttacactcaactagaggtgggtgataacattattatatataataaatatcaaaaccaatcggttatcggtattggcgaagtatcaaagcatatacatgagaaaccacctataccaggtcgaacgaatagtacagctattgaaattttttatgagaaagatatcaagcccatttcattaggtcatttaaataaacatcctaaattgaagaatctgtactttttacaagaaaatgcgaaacagtcaatagcaagtatgtcacaagctcaatacgatgccattttggacatgagtatgaataatggtattaaacatccttttgaaacagtaaaaaaagcagaactatcaactcaaaatgctgaagatgatagtttaaaaccttttgtattattagttgttgaacaaaaaggagaaggcttaaaggcagctgaagaattactccaaaaaacaaatgcaaaccctgtgattactagcggacatccagattttactgaagatatgctttatggtaaatatttacctaatgagtcaggagcgctatattatcgtgaaggattcatcacacatctaatgcctaagaaagataaaagttatttagtcattgataacttcaatcgcatcgatgtagatattttccaaacatatattaatgtacttgaaggctatgaagtgacattaccgagatataataaagatggaagcatgattaagtggtcaaaaaataaagattctttttatcattttaatcctaattggcatattgttggtattacatatgactctatagaaaaaattaagcaaaaatattcgtcacagtttttaaaatatacgcgtatcgtcaaagtgaatcatgactaa

SEQ ID NO: 48 - DNA, 1155 bp, S.epidermidis
aatttgtttaattattataaatccggatttcaaaaagcaaaaccacataatctaaagttaatactactctcattaataacttttgtcatttgctatattacttctaatattgcattctcattagttatattaagagctcaaaggttaccaatgttagctcaactcggtgaatctactacaaaacctataatatctattatttttattttactcattttagctttattatttatttttgtaggttacccattgataactggtacagtatatgcaattcaaaaagctattaataaagagaaagttctttttagtgatttattttttgcttttaaaaaaggcaaatatgctaaatcagtaattttagctttaataactttagttttattcattgtaatcgtacttattctagtgctattaaataaattatatagtttagctcttagcccaatattaatcggcttacaacaatcaataagcggctacgacaatccaatgggaattttaattacaatacaaattgtgttgttactcataacaggtttcatctcatcaattttctattggtttgtaattatattcattattaattatactaccgcttatacagaagattcatctcgtaaagtaatgagtaatttaaaagaaggatttaaaggtattaaaaacggtaagaaaacttggtttaaatttttcattggcgtattacttattagtttacttgcaagtattattaacaaaccgctattattcggtgtacaatacttaacaagcagtatgtctcaaacggtggctcaaactattattataatagctagaatcgtatctatagtattacgcctatgtctttattacattttgatttttggaattattaattatttcgttagacgtggtgacaaaccagtcaaaagcaaaagacgtcataaaaataaagatattaacaaaggtaatgtaaacgacaaagtagatactaaattaaatgcttccaactccaaagatacagaagcagataaaatgaaagatcaacaaacacatatacaacaagacaaaactgatagtcaagaaaataacatatatgattccatcaaagaaaaagtaaatgaaaataaagaaaatgttacagaacaatctaaaaatctatttgataagaaatag

SEQ ID NO: 49 - DNA, 183 bp, S.epidermidis
acaatttataagatattttttatagttgttttgtataagaaaaacgtgactttcgatcagcaacatagcacgggtggaattttaattcaactttttgaaaatgaattaaattctgcccttatttctttacagcatataatcacagaagaggtgaaaacatgcacacacaaatatgggatttaa

SEQ ID NO: 50 - DNA, 501 bp, S.epidermidis
aatcattataatataataaccattgtaaaaatgaggttcgaaggagtgtttgatatgagtcaacaacaagatgtagtcaaagaattaaatcaacaagtcgcaaactggacggtagcttatacaaagttgcataatttccattggtacgttaaaggtcctaatttcttttctttacacacaaaattcgaagaattatacaatgaagctagtcaatatgttgatgatttagcagaaagaattttggcaataggtggtaatccaattggaacactttccgagtgtttagataaatcaatagtaaatgaagcaggaaaacattattcagctgaagaaatggtagaagaattgtctaaagatttttctaaaatctctaaacaattagaacaagcaattgaagtgtcgggaagtgctagtgatgacgtttcagaagatatgtttatcggcatgcaaacttcagttgataagcataattggatgttacaatcttatttaggtcattaa

SEQ ID NO: 51 - DNA, 963 bp, S.epidermidis
gcttttaataatggaggtgtgaacatgccgttatttttaaaacccatttttctggataaagtatggggcagtgataatcttcgtcaatttgggtatcaactacctaataatcacataggtgaatgttggggaatttcagcacatccacacggaaaaagtgtgattgaaaatggtatatttgctggtcaaacattggatcaagtatggaacaatcatagagaaatatttggagattttccaagtaaagattttccattaatggctaaaattgtagatgctgctgcgccattgtctattcatgtacatcccgacgattcttatgcatatgaacacgaagaaggtcaatatggaaaatctgaatgttggtacatcattgaagctgatgaaggtgcaaagattactataggtacgtatgcgaaatctcgtgatgaatttgaagagcaattggagcaaggtacatttgaaaattatttgagaacaatacaagtgcaaccaggtgatttttactttataccagctggaacgatacattctataggtgcaggcattatggcgtatgaagtcatgcaatcatcagatatttcatacagaatttatgattatcatagaaaaactgataatagcgaggaacgtgaattaaatatagataaggcattagatgttattaattattcaaatgaactacctaatatcactcctcaaaatgaagtgatagaaaatcacaattgtacacatattgtatctagtgatttttttactatggttaagtgggatatttctggaactctaaattatatgaagcctagagaattttgtcttgtttctgttttagatggacaaggtaaacttattgtagatggtgatatatatgaaatatctaaaggttcaaactttgtgttaacttccgaagatttagatagtgttttcgaaggagattttaaactaatcattagttacatttaa

SEQ ID NO: 52 - DNA, 219 bp, S.epidermidis
aatgttaataatcataaaaattatatgtttgatgattgttgtcttatgaattttatcattagacgtcttattaattgtaaagtaataatcgatgacttgaatatgatgatgtcacttttttatattattaatgtccatataaaggtaattttagttatccttgacttacgctatggtagtaaaataaataaaaagaacatatttgtattttttaattga

SEQ ID NO: 53 - DNA, 1194 bp, S.epidermidis
gtaatgaataataaagtaaatggtccgtttctcacacttagtgatttgtataatgatgacattgtttacacatctcgaccttcatatgtgtcgaacccatggttgaaaccagatgaacaccaatcaaatttcttaactggaagagaattacttatagctaatcgttttcctgtcattgttcatgaggcaagtgttacaaacaaattagaacaactttttaatatagtgggtagggaaattccaccacatacttataaatttaaagatcaagaaacatatgaaagcttgataaggaatttagctcttcatcaaggtaaaaaaatctactttcaatatattcataatgaagatattttacctaaagaatattatgcacttgataaagatgtttttgttgctcttaataataaagcacgaattccagaatggactaataacaaatatctaccacaaagagaaattgtctcaattaaagattttgaatctcgtattcaagcatggtcgtatccatttgtcataaaaccaggcgatgatttacctacagcaggaggatatggtgttatgatttgttataatgatacagatttagataaagctatcacacgcatcaacaatgcatcagcagagactgaacatttaatcattgagcaaaaaattaatgcagtgaataactattgtgtacaatttgcttattcagatgatattggtatcaaatacttaggaacagcgcaacagttaactaatgactatggattttacaacggaaatgaaaatgttaatgatgtgcctcagaatgtaatagacgctggtagagagattatggaaataggcgtaagcaaaggtttttttggtgtagcaggttttgacttactagtagatgataataatgatgtttatgcgattgatttaaactttaggcaaaacggatcaacgagtatgctacttttagcaaaagatttaactcatggatatcataaattttacagttacttttctaatggagataatacaaaattctataatgctattttaaaatacgtagaattaggtgtactttatccactttcctattacgatggagattggtatggaaagaatcaagttaattctagatttggctgcatttggcatggggaaaataaagaattaattaatcaatatgaacaacaatttatattggaagctggattataa

SEQ ID NO: 54 - DNA, 792 bp, S.epidermidis
atgatgaataatttagaacgattacgttcagaaaatccactcgtaatttgctataccaatgatgttgtgaaaaactttactgcgaatggtttactaagtttaggtgctagtcccgcaatgagtgaggcaccagaagaagctgaagattttactcgaatggctagtgcgcttttaattaacatcggtacactcacacgtgaaaatgaagaagacattatcaaaataggtaaaattgctaatcagcaaggtacaccaatagtttttgatccagtggcagttggtgcttctacatatcgtaaaaatttttgtcaacgttttcttggtgaagttaatgtcacagtaataaaaggcaatgcttcagaaatattgacattaatagattttaatacaactatgaaaggtactgacagtgacagcgaattagattcagtaaatattgcaaaaaaagcggctaatactttaaatactgctattgtcattactggaaaagatgatattattgcaaaaaatgagaaaataattaaattatctaatggttctccgcttcttactaaaatcacgggggctggatgcttgttaggtggtgtattagcaagtttcttgtttagaaatactcaaccttcaattgatttattagttgaagcggtaagtgtctacaacatcgcagcagaatttgctgaacaagcgcctcatgtaaatggacctggtacttttctatctgaactgctagatcaactttatcagatgaatgacattacttataaaaatcaagtcaaaaaggtagagatatga

SEQ ID NO: 55 - DNA, 870 bp, S.epidermidis
atggaggataatatgaaaaatataaaagcaatttttttagatatggatggaacgattttacatgaaaataataaagcctcggaatatactaaacaagtgattaatgaattgagagagcaaaattataaagttttccttgctactgggagatcttattcagaaatcagtcagcttgttcctgatggattcactgtagatggtattatcagttcgaatggaacttcaggtgaaattcatggagataatttgtttagacatagtttaactttagaacgagtacagaaaattgtggaattggctaaaaaacaacatatttattatgaagtttttccttttgaaagtaatcgtatatctcttaaagaagatgaagattggatgaaagaaatgatttccactatagagccacctgacgctgtaagtcaaagtgagtggtcatcgcgaagagaggcaattaaaggaaaaatagattggcgagataccttacctgatgcacacttttctaaaatatatttatttagtcccaacttagataaaataactgattttcgcaaccagcttgttgaaaaccaatcaaatttaggtattaccgtatctaattcttcgcgttataatgctgaaacgatgccatatcatacagataagggtacaggtatcaaggaaatgattgatcactatggtattaagcaagaagaaactttagttattggtgatagtgataatgatagagctatgtttaattttggccatcacactgttgcaatgaaaaatgcaagacaagaaattaaaaatcttacagatgatattaccgaatacacgaacgaagaagatggtgcagcacattacttaaaaagtcatttattagataactag

SEQ ID NO: 56 - DNA, 1026 bp, S.epidermidis
agtggaagtaaggaggcgcatttcgtggaagaattcacaaaaagttataaagcccttgttaaagaaagtttaataactaacaataaaacattattaattaagaaatgtgaagcattcacaaatgaagttataaagaaagatgttttacctgaagatatagttgagatacataaagattatattaatacattagatttaactgaagaagatatattagaaacactcgatgtgttacaagaagtcgttaaaggatttggatatagttaccgagattaccaaagacttgttaataagcttcaagtccacgataaagaaatggatttagcctcaagacttcaacaaactatgctgaaagctgatattccacaatttgatagcattcaaataggagtgatatctgttgctgcacaaaaagtaagtggtgattattttaatcttattgaccataaagatggcacaatgagttttgctgtggcagacgttataggttcaggcataccagcagctttagctatgagtatgataaaatttggcatggatgcttatggacattcacaactacctagtgatggtttgaagcgtttgaaccgtgttgttgaaaagaacgttaaccaaaatatgtttgtcacaatgttttatggactgtatgaagagatgaatcatctactttactgtagctcagctgggcatgaacctggctatatatatcgcgcagaaactgaagcgtttgaggaaattggtgtgcgaggaagagttctaggtgtgagtcccaaaacacgttatagccaacaggaaatccctatttatcttgatgatttaatcataatttttactgatggtgttacagaggcacgtgatgtagagggtaattttattgataaagataagttgttagacttaattcaaaaatataagcatatgcatccacaggatatagttcaaattatttacgaagcgattttaaaattacaaaatcctgcgagaaaagatgatatgactattttaattataaaaagagtaaactaa

SEQ ID NO: 57 - DNA, 225 bp, S.epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccttcgtccaaacagtgctctacctccaataatcatcacttga

SEQ ID NO: 58 - DNA, 399 bp, S.epidermidis
gttcgaatcctacctgcggagccatggctccttggtcaagcggttaagacaccgccctttcacggcggtaacacgggttcgagtcccgtaggagtcattttatggagaattagctcagctgggagagcatctgccttacaagcagagggtcggcggttcgaacccgtcattctccaccatttaattaaatactgcggaggggtagcgaagtggctaaacgcggcggactgtaaatccgctccttcgggttcggcagttcgaatctgcccccctccaccattcttgggctatagccaagcggtaaggcaacggactttgactccgtcatgcgctggttcgaatccagctagcccagccattagagccattagctcagttggtagagcatctgacttttaa

SEQ ID NO: 59 - DNA, 465 bp, S.epidermidis
aaatttaacaagaatttgaatagaattgacaccataccacaggctatattatcatttagattgtatgagtggaacggtttacatgattggtataggacactcggaggctataaaatgcgtcgtttcaacatcattttcaaacaatatttgcaatattatctttatatattggtaataattggaatattgtactcaatttcaccccacccatttctcttgggtcttatgataggtacatgtggttctttagtaaatacatacatctttgagatttatttagctaaatcaatgcataaagaaactacacaaatgtctactggtagtacttggaggtatttagtggcagttattgcatgtgtattatggttattctttaaagaacacattaatattatcggagttttaattgggttaatgatttcttatattgtaatcatattgcgccctctactacaaagggagtaa

SEQ ID NO: 60 - DNA, 1332 bp, S.epidermidis
aatgggtgcaagtctatgcctggtagagaacgaacatctccgcagtatgaatctttccacgaattatataaaaacaatactactaaagagctcactcaaaaagccaaatctttaaaattaactaattacagtaaattaaataaaaaagaattggtacttgccattatggaagcacaaatggaaaaagatggtaattactatatggaaggaatattagatgatattcaacaagatggatatggtttcttaagaaccgttaactattctaaaggtgagaaggatatttatatttctgcaagccaaattcgacgttttgaaataaaacgtggtgataaagtaacgggtaaagttcgtaaaccaaaagataatgaaaaatattatggtctacttcaagttgattttgtaaacgaccataatgcagaagaagtcaaaaaacgtcctcacttccaagctttaacacctctttatccggaagaaagaatcctattagaaacgcaatctacaaattattccactcgtattatggatttagtcacaccaataggtcttggtcaacgtggtcttatagttgcaccacctaaagctggtaagacaagtttattaaaagaaatcgctaacgcaatagcgagtaataaaccggaagcgaatttgtttatattactagtaggtgagcgtccagaagaagtgacggatattgaaagatcggttgaatctgcagaagtcgttcattcgactttcgatgaaccaccagaacaccatgttaaagttgctgaattattattagagcgtgcaaaacgattagttgaaattggagaagatgtaattatacttatggactccataacacgtttggcacgagcatataatctagtcataccacctagtggacgtacattgtcaggtgggcttgatcccgcttcattacacaaacctaaagcgtttttcggtgcagcacgtaacattgaagctgggggaagtttgacaattttagctactgctttagttgagacaggatctcgtatggatgatatgatctatgaagagttcaagggtacaggtaatatggaattacatcttgatcgtaagttatcagaacgtagaatattcccagcgatagacataggtcgtagttcaacacgaaaagaagagctattaatcactaaagcggaattagattcattatggcaattacgaaatttatttactgattcaacagactctacagacgttttattagaaaacttaagcgttcgaaaagtaatgaagaattgtttaagcaattgccaaaaagcagttgaagagagtactaaaactggaagaccaattatttaa

SEQ ID NO: 61 - DNA, 399 bp, S.epidermidis
cacatgttaaataaaatagtcattgttggtagaatgacgaaagatgctcaaatctatgaaaaggaggataacaaaatagcaacattttgcgttgctacagaaagaaactacaaagatgataataatgaaatttctacagattatttactttgtaaagctttcggtaaaactgccactaatattgaaaagtacactagtcaaggtactttagtaggtataactggacaaatgcgttcaagaaaatatgaaaaagaaggccaaacacattttgttacagaattatacgttgaaacaataaaattcatgtccccaaaaaataaaaacaatgaaactccctctgataatcaatttgaaaacaacacttatcaacctgatgatttagaaataattcatatttaa

SEQ ID NO: 62 - DNA, 327 bp, S.epidermidis
atgaatctaaatattgaaacaataactcatgatgatttttatgaggttaaagttggtggagaattggacgtatatactgtacctgaattagaagaggtactagtaccaatgagacaagaaggcacacatgatgttcacgttaacttagctaatgtgagctatatggattcaacaggtctcggtttattcgtaggcacgttaaaagcattaaatcaaaatgataaaaatctctatatcttaggtgtttcagagcggataggtagattgtttgatattacaggtttaaaagatttaatgcatgttaatgaaggaacggaggtagaataa

SEQ ID NO: 63 - DNA, 714 bp, S.epidermidis
atgaagctaaagagagagttcacgcactcacatctaaatatccattatataattaatagacatacacattggaggaaaatgattatgagtaaagtacatgtttttgatcacccattaatacaacacaaactaagttatattagagatgctcgcactggaacaaaagagtttagggaacttgtagatgaagtcggtatgttaatggcttatgaagtaactagagacttagaactgcaagatgttgaaatacaaacacctgtgactaaaatgacagctaaacgtttggcgggtaaaaagttagcaattgtacctattttaagagctggtctaggcatgacagatggtgtgttaagtcttgttcctgctgctagggtaggacatataggactatatagagatccagagactcttgaagcggtagagtactttgcgaaaatgcctcaagacatcgatgaacgtcaaattattgtggttgatcctatgcttgctactggtgcttcagctattgaagcaatttcttcattaaaaaaacgtggagctaaaagtatacgttttatgtgtttaatagctgcccctgaaggcgttgaaaaaatgcaagaagcacacccagatgtagatatatatattgcggcattagatgaaaaattaaatgacaaagcgtatattacaccaggtttaggtgatgcaggggatagattattcggtactaaataa

SEQ ID NO: 64 - DNA, 1512 bp, S.epidermidis
atggccataaaagctgaagaaatcagtgcattgcttcgctcacaaattgaaaattatgagtcagaaatgtccgttacagatgttggtacagtactccaaattggtgacggtatcgcattaattcacggacttaacgacgttatggctggtgagctagtagaattccataacggtgttcttggtttagcacaaaaccttgaagaatctaatgtgggtgtggttattttaggaccatatgaagaaattagtgaaggtgacgaagttaaacgtactggccgaattatggaagtaccagtcggagaggaaatgataggaagagttgttaatcctcttggacaacccattgacggacaaggtccaatcaatgcgactaaaactcgtcctgtagagaaaaaagcaactggcgtaatggatcgtaaatctgtagatgaaccattacaaacaggtatcaaagcaattgatgctttagtaccaattggccgtggtcaacgtgaattaatcattggtgaccgtcaaactggtaaaacaactgttgcaattgattcaatcttaaaccaaaaagatcaagatacaatttgtatttatgttgcaataggtcaaaaagattcaacagttcgtgcaaatgttgaaaaattaagacaagcaggtgctttagactacacaatcgttgtatctgcatccgcagctgatccagcaccattactttatattgcaccttattctggtgtaactatgggtgaagagttcatgtttaatggaaaacatgttcttatcgtttacgatgatttaactaaacaagcggcagcataccgtgagctatcattattattacgtagaccaccaggtcgtgaagcatatcctggggacgtgttctacttacacagtagattattagaaagagctgcaaaacttaacgatgatcttggaggcggttcaattactgctttaccaatcattgaaactcaagctggcgatatctcagcatacgttccaacaaatgttatctcaattactgacggacaaatattcttacaatctgatttattcttctcaggtgttagaccagcgattaatgctgggcaatcagtatctcgtgttggtggttcagctcaaattaaagcgatgaaaaaagttgcaggaacattacgtttagacttagcttcatatcgtgagttagaatcatttgcgcaatttggttctgatttagatgaatttacagctaaaaaattagcgcgtggtgaacgtactgttgaagtattaaaacaaggtcaaaataacccactgcctgtagaacatcaagtacttattatttttgctttaactaaaggttacttagatgatattcctgtccaagatatcaatcgttttgaagaggaatttaaccactgggctgagtcaaatgcaactgaattattaaatgaaattagagaaactggtgctttaccagatgctgataaatttgattctgctatcacagaatttaaaaaaggatttaataaatcagaagaataa

SEQ ID NO: 65 - DNA, 126 bp, S.epidermidis
aaaataataaacaataacctgagacatcaatcgttgtctcaggtattttttgtggtagatgctaatggactttggttaaaacatgagttaacaatatatcttttatttgaatttactctttattaa

SEQ ID NO: 66 - DNA, 132 bp, S.epidermidis
gtgacagcaaaaccgtctttcactattgaaccatgcggttcaatatattatccggtattagctccggtttcccgaagttatcccagtcttataggtaggttatccacgtgttactcacccgtccgccgctaa

SEQ ID NO: 67 - DNA, 543 bp, S.epidermidis
ataatggcaaaggtagcaaaaaaatatgccaaagcattatttgatgtcgctctagatacaaatcaactagatgttgtctatgaagatttagaaacaattagccattcatcgtttgatttcatcaaacaacttaaagcaattgatagtaatccaagcttaactgcaaatcaacgtgaagaatttgtagaaagagtttacaacgaagcaaatccatatgtggtaaatactttaaaagtattagcagataaccgacatatttcaattgtagagaatgtttttaaatcattccaaaatttatataacaaatactacaaacaagattttgcaattattgaatcgacttacgagttaagcgaagatgaaatatcaagaattgtagaacttatcaaaaagcaaactgaattatcaaatgtaattgttaacactaaaatcaatcaagatttaattggtggatttagagttaaggttggaactacagttatggatggtagtgttagaaatgaccttgttcaattacaaagaaaatttgaaagagctaactaa

SEQ ID NO: 68 - DNA, 204 bp, S.epidermidis
ggaaatcaaaagtcttatcttgttccctttttatattcaaagttaaatattttaatgagtataattatactaaattttctacttttaaatgaacttgaaaagagtgtaatgcttgattctattgaatccaatttaaagcattgttattttaaagggtcattttcagaaaataatggtatagtaatcaataaaacgctttattag

SEQ ID NO: 69 - DNA, 1296 bp, S.epidermidis
tattttaaaaagaaggaaacaaaggagaaaagtgatatggctcaagaggtaataaaaattagaggtggacaagcactaaaaggagaagtagaaattagtggagcaaaaaatagtgcagttgctattatccccgcaactttattagctcaaggacaagtaaagttggaaggccttcctcaaatctctgatgtcgaaactctagtaagtttgttagaagatttaaatattgaagcaagattaaatggtaaacaattagaagtggatactacacaaatagagaatgcacctctacctaataataaagttgagtctttacgtgcttcttattatatgatgggcgcaatgcttggtcgttttaaaaaatgtgtaattggattgccaggtggatgtccactcgggccaagacctattgatcaacatattaagggattcaaagcattaggagcagaaattgacgaatctagcaatacatccatgaaattagtagcaaaagaacttagaggcgctcatatatttttagatatggtaagtgttggagcgacgattaatattatgcttgcggcagtccatgccaaaggtcaaactgttattgataatgcagccaaagaacctgaagtcgtagatgttgcaaactttttaatgagtatgggtgctgatattagaggagcaggtacaacatcaataaaaatcaatggtgttgaggaactaaaaggttcagagtatcaaattattccggacagaattgaagctggttcttatatgtgtatggccgcagcaatgggtgaggaggtcattttacataatattgttcctaaacatgttgaagctttaactgttaagttgcaagagttaggtgtagatattgaaattgaagatgaaaaaataatcattcgtaaacaaacaccgtataaaaatgtagatataaaaacgcttgtttatccaggttttgcaactgatttacaacaacctattacaccattattattcatgacagaaggaccttcgtttgtgactgatactatttatccagcgcgttttaaacatgtagaagaattacagcgtatgggtgctaatattaaatcggatgagggaacagctgtgattaaaccttcgacacttaatggagctgaagtatatgcaagtgatttacgcgcaggcgcttgcttaattactgcaggtttaatagctgaaggtgtgacgacaatatttaatgtaaaacatatttatagaggatatactaacatcgttgaacatcttaaagcacttggtgctgatatttggacggaaacggtataa

SEQ ID NO: 70 - DNA, 144 bp, S.epidermidis
cctcataaaaatcatcatgagttattgtttcaatatttagattcatttaatacactcctagtctttatcaaatgtgtttatcctacatatgtactcaagattacctataccctacatgaattaactttaatctacattttataa

SEQ ID NO: 71 - DNA, 435 bp, S.epidermidis
gcaatgaaaaaggagtgtatacacatgccaataatttattatgatggaaattgtgtttattgttataactatgcaatttggttaattcaaaacggactttcacataaatatgagtttgcaacaattaaaggtcaaataggtaaacaattttttgaaaattatcctgatgctcaaaataagaatagtgttattcttcaaaaaggaaatcatttagaatttgaatcacaggctgttgcaacattgatatcgtcactacctaatcactctaaatttcttggaataggattaagattaattcctaaaccactaagagatttaggatatcgattatttgcaaataatcgagataaaatgtggaaaacacattggcacaagccaactgattatgaaaaatcattttttcttgatgataatgaaaaaatcaaactaacctaa

SEQ ID NO: 72 - DNA, 1092 bp, S.epidermidis
gaaggaggaaatgtagtgtttgatcaattagatatagtagaagaacgatatgaacaattaaatgaattactgagtgatcctgatgtcgtgaatgacgctgataaattaagaaaatattcaaaagaacaagctgacttacaaaagactgttgatgtgtacagaagttataaaaccaaaaaagaagaattacgagatattgaagatatgctaaatgaaacatctgataaagaagaagttgaaatgctaaaagaagaaagtagtgctttaaaaacagaattacctgatatggaagaagaattaaaaatcttacttatacctaaagatcctaatgatgataaagatgttatagttgaaatccgtgcagctgcagggggagatgaagctgcaatatttgctggggacttaatgagaatgtattcaaaatacgccgaggcaaacggatttaaaacagaaatagttgaagcttcagaaagtgatcatggtggatataaagaagtgagtttctcagtatctggtacaggtgcttacagtaaattaaaatttgaaaatggtgcacatagggtccaacgtgtgcctgaaacagaatcaggggggcgaattcacacttctaccgcaactgttgctgtattacctgaagctgaagatgtcgaaattgagatacgtaatgaagatttaaaaattgatacttatcgctctagtggtgctggtggtcagcacgttaacacgactgactctgcagtgcgtattacacacttgccgactggtgttatagcaacttcttctgaaaagtctcaaattcaaaaccgagaaaaagctatgaaagttttaaaagcacgattgtatgatatgaaattgcaagaagaacaacaaaaatatgcttctcaaagaaaatcagctgttggtacaggtgatcgttctgaaagaataagaacttataattatcctcaaagtcgtgtgacagatcatcgaattggtttaacgcttcaaaagttaaatcaaatcatggaaggaaatttagacgagattgtggaggcactcacactttcagaacaaactgagaaactgaaagaattaaacaatggtgaattataa

SEQ ID NO: 73 - DNA, 186 bp, S.epidermidis
cggcttctgaaacttaatattatcatatttttaaattcaattgcatttgataatctaaatatagaactaaattttaatgacaatttgcgccaatatacatatttttattatgactattacatattaaaagttaataaggtgctatcattctgtgatattctagcaaatttaaaagaagtcatgtaa

SEQ ID NO: 74 - DNA, 426 bp, S.epidermidis
aaagctatgaaaataatttttgtatgtagtggcaacacttgtcgaagcccactggctgaaagtatagccaagtcccttttaccacacgatagtatagcttcaagagggctattcgcagttgagggacaggccatatctaaggaatcgttagaattaattcataagtacgatttacctgaaccatcacgagcacaagcatttcatatagatgatcttgatgctgatattatacttaccatgacgcaagctcataaagatttaatattttctatgtatggacgacaatctaatgtctttacattaaatgagtatgtaggtgacacacaagaaattgatgacccatttggtggctcgtttgatgtttatgaacaaacttataccaaaatttatgatttagtcgacaaaataaaatttaaacacgagtaa

SEQ ID NO: 75 - DNA, 216 bp, S.epidermidis
gagggtatgaaattgaaaaaaggattgataaatgtttcaggtattaaaacaactgaacaagctaaacagctcaaagatcatttatctaagatgataggcatcaatagtgtggatatcgattaccaaatgaatgagattcgagtagaatttgacactcctgcaaatttaaataacattgaaaaagaaatttacgattacggatttcgtattttgtaa

SEQ ID NO: 76 - DNA, 357 bp, S.epidermidis
gcatcaatgaaagttttaagattcttattaggactagcatttggaacagctggtgttttacattttactagagagagacaatttagaaatattgttccagattatttacctttacaaaaaactgctgtattggtaacaggtgttatagaaatcttttttggtatcatgttgcttattaaaagaccagcatcatggttgaaaaagggtattaatttattcttgttagcagtgttcccagcaaatatttatatggctcgtaaaggattgccattaggtgacaaagaactacctaaatgggcactttattcgagattaccattgcaatttgtgcttattaaagccattaaaaaattataa

SEQ ID NO: 77 - DNA, 840 bp, S.epidermidis
acaatggtgaattataaagagaagtttgcagaagccaagacaattgccgtaaatgaggggtttgaatcaactcgtgccgaatggttgtttttagatgtttttggttggtcgaaaacagattatttaattcataaagatgagcaaatgtctttgacatcaattaacaaattggataaagcgttggatagaatgatcacaggagaacctattcaatacattgttggatttcagtctttttatggttatcaatataaagtgaatcaacactgtcttataccaaggcctgaaaccgaggaagttatgttgcattttttagaattgtgtaaaaagactgataccatagcagatattggaactggaagtggtgctatagcaattacgcttaagttactgcaacctgaattaaatgttattgcaacagatttgtatgaagatgctttaaatgtagctaagcaaaatgctagtcattatcaccaaaatattcagtttttgcgtggaaatgctttaaaaccgctaattgaaaatgatataaaattggatgggctgatatctaatccaccatacataggccatagtgaaataatagatatggagtcaacagtactaaattatgagccacatcatgctctatttgctgagaaaaacggatttgctatttatgagtcaatattagaagatttaccatttgtaatgaaacaaggtggacatgttgtttttgaaataggttatagtcaaggagatatcttaaaaagaatgattcaagatttatatcctgaaaaagaagtagagattttcaaagatatcaatggaaatcagcgtattatatctattatttggtag

SEQ ID NO: 78 - DNA, 351 bp, S.epidermidis
ctatcgaacctttttttaaattttaaaatgttaaaaagtaatatccatttttataagtatctttattgcctcttttcgtgtacaatgttatacagtaatcttacgaaggagcttaatatggattatcttggtcagttcgcaattgttcatttaatcttacatgttgtttgtatttgcgtagcttattgggctttaaattccataaaattagaccaattttttaaaaagggctacccattacaagttcaagtttgtatgatttttatttctattttactgggtacggcagtcagtaactttatagttgatttattgcaatattcaactcaagtgaaatacttgataaaataa

SEQ ID NO: 79 - DNA, 204 bp, S.epidermidis
ccgcttattgattgttgtaagccgattaatattgggctaagagctaaactatataatttatttaatagcactagaataagtacgattacaatgaataaaactaaagttattaaagctaaaattactgatttagcatatttgccttttttaaaagcaaaaaataaatcactaaaaagaactttctctttattaatagctttttga

SEQ ID NO: 80 - DNA, 186 bp, S.epidermidis
ttatgtttagatatcgttttagccaaagcaagtataagtataattttcatgaattcggaaggttggatgcttataggaccgaaactgtaccaacttttagcaccattaataattggggtgattgaagtttcaggtaaaataagtaaccctattaatagaacgcaaaatatactatataaaatataa

SEQ ID NO: 81 - DNA, 123 bp, S.epidermidis
agtaagttagatggtaagggaagtaacaatccataccaatttgcttccagtcattttcctattagaggtaaagtgctcctaaagcgcctgaaaaagcaccattctcaatatagtacggtttaa

SEQ ID NO: 82 - DNA, 1488 bp, S.epidermidis
cctatgatagaagtctttactatggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgatgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 83 - DNA, 375 bp, S.epidermidis
tatactaaagaggcgatacaagtgatttatggaataggtatagatttaatagaaattgaacgaattaaaaatcttcagaatcaaacaaaatttattgaaagaatacttactatagaggaaagagacaaattaaatcaatatacaaacgagcaacgtagattagaatttttagctggacgctttactgtgaaagaagcatttagtaaggccttaggtactgggttggggaaatcagtatcgtttcaggatattaactgttacaacgacgctctaggtaaaccatgtattgactatcctggtttttatacacatgtgagtattacacatacggagaattatgctatgagtcaagttattcttgaaaaaaacgaatga

SEQ ID NO: 84 - DNA, 492 bp, S.epidermidis
agcaataaggaggataaatgcatgactaaaatgaatgtagaaagctttaatttagaccatactaaggttgttgcaccttttattcgtctagccgggactatggaaggtcttaatggtgatgtcatacacaaatatgacattcgtttcaaacagcccaataaggaacatatggatatgcctggtctacattccttagagcatttaatggcagaaaacattagaaatcatactgataaagtagtagatttaagtcctatgggttgtcaaactggattctatgtttcatttattaatcatgacgactacgatgacgtattaaatattatcgatcaaacattgcatgatgtgttaaatgctagcgaagtcccagcttgtaatgaggttcaatgtggttgggctgcaagtcattctttagaaggtgctaaaacaattgctcaagcatttttagataaaagagagcaatggaatgacatctacggagaaggtaaataa

SEQ ID NO: 85 - DNA, 1377 bp, S.epidermidis
atacaaaaggagcgtttaaaaatgggaaaatattttggtactgatggtgttcgtggtgtcgctaaccaagaactcacacctgaattggcttttaaactaggtagatacggaggatatgttctcgcacataataagggtgaaaagcatcctcgagttttagtaggaagagatacaagagtatcaggagaaatgctagaatctgcattaattgctggtttaatttcaattggcgcagaagtgatgcgcttaggtgttatttcaacaccgggtgtggcttatttgactaaagaaatggaagcagcattaggtgttatgatttctgcgtcacataatccggttgctgataatggaattaaattttttggttcagatggctttaaattgtcagatgatcaagaaaatgaaattgagcaattattagatcaaaccaatcctgatttaccacgtccagtaggagaggatattgtacattattcagattattttgaaggtgcacaaaagtatctaagttatcttaaatcaactgttgatgttaattttgagggtcttaaaattgtattagatggtgcaaacgggtcaacttcttctttagccccattcttgtttggcgatttagaagcggatactgagacaattggatgtaatccagatggttataatattaatgaacaatgtggctctactcatccagaaaaattagctgaagcggtgttagaaactgaaagtgactttggtttagcttttgatggagatggcgatcgtattattgcggtagatgaaaatggacaaattgtagatggagatcaaattatgttcattattggtcaagaaatgtataaaaaccaagaactcaatggaaatatgatagtttcgacagtaatgagtaaccttggtttctacaaagctctagaaaaagaaggtattcagtcaaacaaaactaaagttggagatcgctatgttgtcgaggaaatgagaagaggaaattataatcttggtggtgaacaatccggtcatatcgtattaatggattacaatactactggtgatggattattaacgggtgttcagttggcttccgttattaaaatgagtggtaaaactctaagcgagttagcttctcaaatgaaaaagtatccacaatctttaattaatgtgagagtgactgacaaatatcgtgttgaagagaatattcatgttcaagagataatgacgaaagttgaaacagagatgaatggtgaaggaagaattcttgttcgtccttctggaactgaacctttagtacgtgtaatggttgaggctgcaactgacgcggatgctgaaagatatgctcaaagtatcgctgacgttgttgaagacaaaatgggtttagataaataa

SEQ ID NO: 86 - DNA, 522 bp, S.epidermidis
aaggtgatactcatgaagtcttataaatatatgcatcaaaacggtattaaagtaatgagaattagtggtgctttttggacacttttacttgtgatagcattgtctattttaatattgcttaatgaattaaaattccattttattgatactaaaaatttaataattggagtaataattttaactacaatagtttgtattttatttatgattatagtgccttggtttaaatttaaacatcttagatattttttagatgataaagaaatacatattagagaaggtatcatttttatagatgtgcacgtcatcccttactttagaatacaaaatatagatatagttgagggatttatcatgagaaagttccaactcgcttcgctgtcattatcaactgctgggggaaattctgaaatagcattgatagatattcaagaagcacaaagattgaaaaaacaaattaaacaacaaaaatcaataacgacaaatgtaacttcattagaaaaattaaacgatgatatataa

SEQ ID NO: 87 - DNA, 141 bp, S.epidermidis
ttcatcaaactatttaactttcaaaaaggtcgtgcaatatgtaatgtaagcgtttttttcataattcaccaaaaaataaaagcatgcgatgaaagtaacatcctaattaatttacagatgctctttcattgcatgctttga

SEQ ID NO: 88 - DNA, 165 bp, S.epidermidis
aaagcgttttgcgacgcaaaatcttacttactatctagttttgaatgtataatcattcatttgtctggtgacaatggcaaggaggtcacacctgttcccatgccgaacacagaagttaagctccttagcgccgatggtagtcggactgacgttccgctagagtag

SEQ ID NO: 89 - DNA, 1098 bp, S.epidermidis
attaaattctgcccttatttctttacagcatataatcacagaagaggtgaaaacatgcacacacaaatatgggatttaagaatgtataaaaataatgttagtcaatatccacatatagatgagataaaacaaactttcctagatggaggtttagtagcgatacctactgaaacagtatatggtcttggtgcgaatgctagaaacgaagaagcagtcgaaaacatctatgttgcaaaaggacgtccgtccgataatccgttaatcgttcatattcacagtattgaacaactcgatgattttgtagagtatattgatgataaggttaaagtattgatggatgaattttggccgggacctatttcttttatattaccacttaaacagggatatctttgcagtaaagtgactggtggattagaatctatcgctgttagaatgcctagtcataaaatagggagagcattacttcaaattgtagatgaacccatagcagctcctagtgctaatattagtggtcgaccgtcaccaacaacttttgaacatgtgaatagagatttaaatggtaaagtcaacggtatagttaatggtgatcaatgtgaagaaggacttgaaagtactgtgattgattgcacacagtttccgtttcgtatcgcgcgaccaggttcaattacgcaagatatgatagaaactaaactacctcattcgataaatcgtcaaatatatgaggaaaatgaaaagcctatcgcacctggtatgaaatataaacattattccccagagaccccattaacaattgttaaagatttaaataaaaaaattgctaatgatgataaatggtcaaaagtagcatttgtattcccagagagtcaaagaagtttgattcccgaaaatagcatttttatatctttatgtgaaaataagggagattttaaatcagcaggccataatttatatgaaattttacatgaacttgaccagaatgaagaaatagaagaggcatatatttatggatttgaagataatcatcacactgaagctatcatgaaccgaatgttaaaagcagcaagttataaactaattaaaggtgaaaagctatga

SEQ ID NO: 90 - DNA, 189 bp, S.epidermidis
acctacaactggaatggattttatataaagagacaactatttaaaacatttggtaagcatattttaaatgattcacaactttctgtcatacttgtaacacatataatagaagaaatgccgttatttttgaaaaagatttacttaaagacttttaaatatttaacaaggttaatatttaagatgttatga

SEQ ID NO: 91 - DNA, 537 bp, S.epidermidis
cgaaaggagtgtcatgagcccgtgactgcaacagctaatacatttattctcggtgcaggagttgaatgggggacaacatttgtaacactcgtaacatttgtaatcctcatcatacttttgaagaaatttgcttggggtccattaaaagaagtaatggacaaacgtgaacgtgatatcaataaagatattgacgacgcagaacaagctaagataaatgctcaaaaacttgaagaagaaaatagaaagacacttaaagaaactcaagatgaagttcaaaaaatcttagacgatgctaagattcaagcacgtaagcaacatgaagaaattattcatgaagctaacgaaaaagctaatggtatgattgaaactgctcaaagtgaaattaatagtcaaaaagaacgtgcaatttctgatattaataatcaagtttctgaactatcagtacttattgcatctaaagttcttagaaaagaaatttcagagcaagatcaaaaagaattagttgaaaagtatttaaaagaggcaggggataaataa

SEQ ID NO: 92 - DNA, 891 bp, S.epidermidis
aatgttattttgtcgtatgacagtgtcaataatgattggtataataatcaatatggaaaagtattacccggaggagatgttatggatttttccaatttttttcaaaatctgagtactataaaaattattactagtttactcgatttactgattgtttggtatgtgttgtatcttctcattacagtttttaaaggtactaaagcaattcaattattaaagggaatagttgtcattgttatcggccagcaaatcagtaaaattcttaacttaacagcaacatctaaattgtttgatattgtaattcaatggggtgttttagcactcattgtgatatttcaacctgaaataagaagagccttagaacaattaggtagaggaagttttttaaaacgatatacgaatacttatagtcgcgatgaagaaaagttgattcaatctgtgtctaaagctgttcaatatatggctaagcgacgcattggtgcgcttattgtttttgaaaaagagacaggtttgcaggattatatagaaactggaataccgatgaattcagatatatctcaagagctactaactaatgtatttatccctaatacgccattacacgatggtgcaatgataattcaaggaagtaagattgccgttgctgcaagttatttaccattatcagatagtgttaaaatatcaaaaagtttaggaactagacatagagcggcagttggaatttcagaagtttctgatgcttttactgttgttgtatcagaagaaactggtgatatatcagtcacttttgatggaaaattaagaagagatatttcaaaagatgtttttgaagaattgcttgctgaacattggtttggtgcacactttcaaaagaaaggtgtgaattcataa

SEQ ID NO: 93 - DNA, 882 bp, S.epidermidis
ttaatagataggggtaaagcaatgtttataaaaaaagattttgatgatattacagttcaagtatttgaagaaaaatatagagatgcacttaaccaatttgaattaagtgaacgacaacaaatatattcttcattgcctcaaactgttttagatgatgcattaaaagatgaaaatcgaattgctaatgtagctttaaataaagaaggaaaagtagtggggttcttcgtattgcatcgttattatcaacatgaaggttatgatacaccaaacaatgttgtttatgtacgttcattgtcagttaatgaaaagtttcaaggccatggatatgggacaaaaatgatgatgtttttaccagagtatgttcaagcattatttcctgattttacacatttatacttagtagtagacgctgaaaaccaaagtgcttggaacgtttatgaacgtgcaggttttatgcatacagctacaaaagaagaaggacctattgggaaagaaagactttattatttagatttagattcaaaacatgtatcttctttaaggctaaaagagggggaagccgcatataatgatgatattcacgtgattaatttgcttaaagatgatgtaaaggtaggctttattgcactagaacaaaatgataataaaatgaatatttctgcaatcgaagttaataagcaaaataggaatgagggaattgcagaaagtgctttacgccaattaccaacgtatatacgtaaacagtttgaagacattgaaattttatcaattactttatatggcgaacgtaatgaattaaaaccattgtgcttgaatagtaattttgtagcaatagaggaaactgaggattatacacgttttgaaaaatatattaattattaa

SEQ ID NO: 94 - DNA, 207 bp, S.epidermidis
ctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcagggtcgaaagacggacttag

SEQ ID NO: 95 - DNA, 297 bp, S.epidermidis
ctctgttccagatggttcagggcaaaggagctgaaaaaaatgaaacaaggaattcatcctgaataccacaaagttatctttttagatacaacaacaaactttaaattcttaagtggttctacaaaaacatcttcagaaactatggaatgggaagatggaaatgaatacccagttattcgtttagatgtatcatcagattctcatccattctatactggacgtcaaaaattcgcagcagcggatggtcgtgtggaacgtttcaacaaaaagtttggactcaaatcaaacaacaactaa

SEQ ID NO: 96 - DNA, 471 bp, S.epidermidis
tattattacagcttaagctcggaggttttaaaaatggaaacgatttttgattataatcaaattaaacaaattatcccacatagacaaccttttttactaatagataaaattgtagagtatgaagaaggtaaaaggtgtgtaggactaaagcaagtatcaggtaatgaaccatttttccagggacatttccctaattacgctgtgatgcctggtgttcttattacagaagctttagcgcaaactggtgcagtagctatgttaaatagtgaagaaaataaagggaaaatagcattgtttgcaggcattgataagtgtcgcttcaaaaaacaagtcgtacctggagatacattaatgttggaagttgaaataactaaaataaaaggtcctattggtaagggttcggctaaagcgactgttgatggccaacttgcttgtagctgtgaacttacttttgctattcaagatgcttaa

SEQ ID NO: 97 - DNA, 792 bp, S.epidermidis
aaaaagagcaggtgcgaaataatggcgaaagagtcgaaatcagctagtgaagtatcacctgaacaaattaaccaatggattaaacaacatcaagaaaacgaagatagccaagctcaagataaattagtaaaacattatcgtaagctgattgaatctttagcttataagtattctaagggacaatcacatcatgaagatttagttcaagttggtatggttggtctaataggtgctattaatagatttgacttatcatttgatcgtaagtttgaagccttcttagtaccaacagttattggtgagattaaaagatatttacgagataaaacatggagtgttcatgtacctagacgtattaaagaaatcggtccaagaatcaaaaaagttagtgatgaattaacaaatgaacttgaacgttcaccatctattagtgaaatcgcacaacgcttagaagtttcagatgaagaagttttggaagcgatggagatgggtcagagttacaatgccctaagtgtggatcactctatagaagcagataaagatggttcgacagttacattattagatatcatgggacaacaagatgataattatgatttaacggaaaagcgtatgatattagagcgtattttacctattttgtcagagagagaaagacaaatcatacaatgtacttttattgaaggtcttagccaaaaagagactggtgaaagaattggtcttagtcaaatgcatgtttcacgtttgcaacgtaccgcaataaaaaaattacaagaagctgcaagacagtaa

SEQ ID NO: 98 - DNA, 1083 bp, S.epidermidis
  unsure (1060): Identity of nucleotide sequences at the above locations are unknown.
gtagtttcaaggaggacatatatgtcagagaagttttatagagcaacatatttaaatgtgaatttagatgcaattttagcaaattatcaaaatttcaatcaattacacgctaataagactgtcatttcagtcattaaagccaatggatatggattaggaagtgtgaaaatagcacaacatttaatgcgtcatggtgcaacattttttgcggtggctacacttgatgaagcaatagaattaagaatgcatggagttgatgctaaattattagttttaggtgttgttccaacagaagacattgagaaggctatacagcatcgtgttgctttaacagtaccttctaaagcatggttgaaggaaactatcaagcaaattcctgatgataaccaaaaaaatttatggctacatgtaaaattagatactggtatgggccgaattggaatgaaagatatagatgaatataaagaagtggttgatttaattaataaaagagatcatttagtttttgaaggagttttcacacattttgcgagtgcagatgaacctggaaattctatgaatgaacaatatactttgttcaaagagatggttaatcaagttgagaaaccaaactatattcattgtcaaaattctgctggatcactactcatggatggtcaattttgtaatgcaataagattaggaatctctctttatggatactatccttcagaatatgttaaagataatgtaaaagttcatttaagaccaagtgcgcagttagtatcagaaaccgttcaagttaaaacacttaaagctggtgaaactgttagttatggacgtacatatattgctgatgaagaaatgacaattgcaattttacctattgggtatgccgacggatatttaagatcgatgcaaggtgcgttcgtcaatgttaacgggagtcaatgtgaagtcattggacgtatttgtatggaccaattgatagttaaggttccttctcatgtaaaaacgggtgataaagtaatacttatggataatcacgttgattcaccaccatcagctgaaaccgtacccnataaacaaggtaggactaactag

SEQ ID NO: 99 - DNA, 501 bp, S.epidermidis
atcttgaaaaggagtacatttatgaaaaatgatagtacgtttcatagaagcccaatccaagcgctaaagtactattacataactagttgcataggtttatttattttgcttgttatacttagtttacttttgtattttagctatttaaatcattggtggccttttacatcctacatctttcttgggctaggtttgttatcgattttaaacacttgtatatctccactaattaaatatagatatcattattataaaattcacgaagattttgtcatattaaaaagattatttatttttaggaaagaagaattaagtaaaatagagagaatacaatttatcgatattggaactaatccgttatcaaaaaaattaaatcttaattccataactttatttactgcaggtcatacaatctcatttccaataatatctgagaaagaagcacaaaatattcaacaacaaatactattgagattgagaggtgcaaatgacgatgtatag

SEQ ID NO: 100 - DNA, 936 bp, S.epidermidis
atgcttgaaagtaaatggggattaagatttgtcgctctcatattagcagtttttttctttttatcagtaaataatgtgttcggaaatatttttaatacagatgatttatctcaaaaatcatccaaaactattcaagatgtgcccgttgatgttatctataatagtaaagacctacatgtaactaaaattcctgaaaacgtcgatgttaatttaacaggaccacaatcaaaattaatcaaaattgaaaaccctgaagatttgaaagtagttgttgatctttctggaaaaaaagcagggaaatatcaaaaaaaatatcaagttagaggcatagatagtggtatcaactatcaaattaaacctgaagttgcacacattaaccttgaaaataaaataacacgagttatgcatgtgcaaccagacattagtagtaacagtttagatccaaaatataaaataagtaaacaaagtatttcaccagaaactgtaaaagtgactggtggagagcaacaattaaaaaatatagcttatttaaaagcaacttttaaaaattctagtaaagtgaacaaagacaccaatgatgttgcagatgttagtgcatttgataaacaattgaataaattaaatgtatcaattaatccaaatgaagttaatttaaaagtaacagttgaaccattcagtaaaatggttaaggtacgtaaaaaaacaacgggtaagcttaatgaaaataaagaattagatagtgttaaactggaagataaagaagtagaaatctttggtaatagagatgaattacaaaatattaatgaaattactgctgaagtagatattgatggaatttcagaatctacagaaaaaacagtatcatttaacttacctaaagatgtgactaaagtgaatccaaaggaaacaaaagcgtatataaatgttaaaaattga

SEQ ID NO: 101 - DNA, 126 bp, S.epidermidis
ttcgtggaaagattcatactgcggagatgttcgttctctaccaggcatagacttgcacccatttcattaattatttattttacgaagttcaaaaataataaacgcatagttagcttaaccaaataa

SEQ ID NO: 102 - DNA, 363 bp, S.epidermidis
atgattagaagaggagatgtttatttagcggatttatcaccagttcaagggtctgaacaagggggagtaagacctgtagttatcattcaaaatgatactggtaataaatatagtccaactgtaattgtagctgcgattactggtaggattaataaagcgaaaataccaacccacgtagaaattgaaaagaaaaagtataaattagacaaagattcagttattcttcttgaacaaattagaacactagataaaaagcgtttaaaagaaaaattaacatttttatcagagagtaaaatgatagaggttgataatgccttagatattagtttgggattaaataactttgatcatcataaatcttaa

SEQ ID NO: 103 - DNA, 246 bp, S.epidermidis
tataaggagagaggctttgtgaagcaatttatatatatttctctagtttgtggcattatttccggagcagggatatttttacaattaccacattatccatctatgatgattccaagatttgtggcgattcttggaataattagcgctgcaatcacaataagagataaggaaataagtggtatgcttaaacttggtgggataatgattaatataatgccgttacttgggagtgtcattgctaaataa

SEQ ID NO: 104 - DNA, 540 bp, S.epidermidis
agagattggaggtttacaatgtcaaaaatcttaaacacacaattaactggtatttttaatcggcttgaaaaacaagagttggatattcaaatggcagctcaatgtctcattcaagcaattggtggagaaggacatgtctatatcaaaggctacgatgatttaaaattctatgagtcattcatattacaaagccatgaaaaattagcgtctagcttaccacttgaagatttacaaaattttaacgatatagatacaacagatagggtactgttattttcaccatactacacttcggaagttgaaagtgatgtacttcaacttattgatttagatgtcgatttagtgcttatttgtaataaccctaaacgagatgattttcctaatcatttaattcattatgttaatttatcaacacctaggcccattgtttacacagaagattatgataaaatcattcaaccacatccgatggccttaaattatatttattatgatatttatactcaaatgattgagatgactagagacctagatttatag

SEQ ID NO: 105 - DNA, 819 bp, S.epidermidis
ttgttatggagtgatagacatatgaagattggaattgatgccggagggactttaattaaaattgtacaagagcatgacaatcgtagatattacagaactgaattaacaactaatatccaaaaagtcatagattggcttaacaatgaagaaatcgaaacattaaagcttacaggtggaaatgctggagtaatagcagatcaaattcatcattcccctgaaatatttgtagagttcgatgcatcatcaaaaggtttagaaattttattggatgaacaaggtcatcaaattgaacattacatttttgctaatgtaggtacaggtacttctttccactattttgatggaaaagaccagcaacgtgttggaggtgtaggtaccggaggcgggatgatacaaggtttaggctatttattgtccaatataacagattataaagaattaacgaatttagctcaaaatggagatcgtgatgccattgatttaaaagtaaaacatatttataaagatactgaaccaccaattcctggagatttaacagcagcaaattttggaaatgtattacatcacttagataatcagtttacatcagctaacaaacttgcctctgcaattggcgtcgttggtgaagttataacaactatggctattactttagcacgtgaatataagactaatcacgttgtatatatcggttcatcatttaataacaatcaattactacgtgaagttgttgaaaattacactgttctaagaggatttaaaccgtactatattgagaatggtgctttttcaggcgctttaggagcactttacctctaa

SEQ ID NO: 106 - DNA, 732 bp, S.epidermidis
ctattaaggagaagatatattatgacagaaagtacacctcacattaacccaaatggagttaaaatagctaaaactgtattaatgccaggcgatccattacgtgctcaatatattgctgaaaattttttagaaaatgttgaacaattcaatacagtacgtaatatgtttggttacacaggaacttataaaggcaaagaagtttctgtgatgggctctgggatgggaattccaagtattggtatttattcttatgaactttaccatttctttgatgtggatacaatcattcgcgtaggttcatgtggcgctcttcaagaagatgtcaatttatatgatgtgattattgcacaagccgcttccacaaactcaaattatgttgatcaatttaatataccgggtcactttgcgcctattgctgattttaatctagtagctaaagctaagaaagctgctgatgaaattggtgccatatcacatgtaggtaacgttttgtcatctgatacattttataatgctgattcaacttttaatgattcatggaaaaagatgggtatcttaggtatcgaaatggaatctgcaggtctatatttaaatgccatccatgcaaataaaaaggctttaggtatttttacagtaagtgatcatattctaagagatgaagccactagtgcagaagagagacaaacatcatttactcaaatgatggaaatagcgctcgaaatagctgaatag

SEQ ID NO: 107 - DNA, 228 bp, S.epidermidis
cccaagaatggtggaggggggcagattcgaactgccgaacccgaaggagcggatttacagtccgccgcgtttagccacttcgctacccctccgcagtatttaattaaatggtggagaatgacgggttcgaaccgccgaccctctgcttgtaaggcagatgctctcccagctgagctaattctccataaaatgactcctacgggactcgaacccgtgttaccgccgtga

SEQ ID NO: 108 - DNA, 690 bp, S.epidermidis
gccacacccggtgttgaaataacacctaagcgcatcacttctgcgccaattgaaattaaaccagcaattaatgcagattctagcatttctcctgatactcttgtatctcttcctactaaaactcgaggatgcttttcacccttattatgtgcgagaacatatcctccgtatctacctagtttaaaagccaattcaggtgtgagttcttggttagcgacaccacgaacaccatcagtaccaaaatattttcccatttttaaacgctccttttgtatctatcaatttttaacatttatatacgcttttgtttcctttggattcactttagtcacatctttaggtaagttaaatgatactgttttttctgtagattctgaaattccatcaatatctacttcagcagtaatttcattaatattttgtaattcatctctattaccaaagatttctacttctttatcttccagtttaacactatctaattctttattttcattaagcttacccgttgtttttttacgtaccttaaccattttactgaatggttcaactgttacttttaaattaacttcatttggattaattgatacatttaatttattcaattgtttatcaaatgcactaacatctgcaacatcattggtgtctttgttcactttactagaatttttaaaagttgcttttaaataa

SEQ ID NO: 109 - DNA, 888 bp, S.epidermidis
  unsure (849): Identity of nucleotide sequences at the above locations are unknown.
tactccaaaggtggtgagataatggcctctcttaaagagatagatagtcgtattaaatcgacaagtaagatgaagcaaataacaaaggcgatgaacatggtttctagttcaaaattacgtagagctgagaaaaatactaaatcatttagaccttatatggaaaagatgcaagatgctattacagctgtagctggttcaaatagtacttctaatcatccaatgcttaaatctagagatattaaaagaagtggttacttagtaatcactagtgataaaggcttagccggtgcctatagtacaaatgttttaaaaagcttagtaaacgatatcaattctaaacacaacgacagtagtgaatatagtctaatcgttttaggtcagcaaggtgtagatttcttcaaacatagaggatatgaaattgaaagttctttagttgaagttccagatcaaccttcatttaaatctattcaatctatagctaaacatgctattgatttatttagcgaggaaaacatagatgaattgactatttattacagtcattatgttagtgtcttagaaaataaacctgcaactaaacaagttttaccattatctcaagaagattcaggtcaaggacatggtcaaatgtcttcatacgaatttgaaccagataaagaatctattttaagcgttattttgccacaatacgttgaaagcttaatctacggtacaatcttagatgcaaaagctagtgaacatgcttcacgtatgacagcaatgagaaatgcttcagataatgcgacagaactaatcgatgatttatcattagaatacaatagagcgagacaagctgcgattactcaacanattactgaaattgttggtggatcatcagctcttgagtaa

SEQ ID NO: 110 - DNA, 234 bp, S.epidermidis
atattaggaggaaattttattatgaatttaatcgcagcggcaatcgcaattggtttatcagcattaggtgcaggtattggtaacggtcttatcgtatctagaacagttgaaggtgtagcacgtcaaccagaagcacgtgggcaattaatgggtatcatgttcattggtgttggtttagttgaggcattaccaatcatcggtgttgtaattgcattcatgacatttgctggataa

SEQ ID NO: 111 - DNA, 132 bp, S.epidermidis
acaaccatgggtttcatcagtaatcactttaatgtgatcatcattattattaaatattttcatttattttatcataatatcatccactattctaaacaacacttatcattaaaagttgattttaaaaattaa

SEQ ID NO: 112 - DNA, 168 bp, S.epidermidis
aataaagctatttctaacgaggtgataattgtgaagaatcaggataagattcaaaatgtagtcaaattattatcatcattgggtgtgaatattaagaaaactaagtctcgtttagatattattaatactttgcctacatctaatcaagtaagtcatgaattaaaataa

SEQ ID NO: 113 - DNA, 1239 bp, S.epidermidis
atgtcttatatcgagaaaaaggataaagttgtttacgatgctattcaaaaggagtttcaacgacaaaatagtaatattgaactcattgcatcagaaaatttcgtatcacaagcagttatggaagcccaaggttcagtattaacgaataaatatgctgagggttatcctgggcgtcgttattatggagggtgtgagcatgtagatgtaactgagtccattgccattgaaagagcaaaagctttatttggagcagaacatgttaatgttcaaccccattcaggttctcaagctaatatggctgtgtatttggttgctttagaaatgggcgatactgtgttaggtatgaatttgagtcatggtggtcatttaacacatggggcaactgtcaattttagtggtaaattttatcattttgttgaatatggtgtggaccaagaaaatgaattaataaactatgatgaagtgagacgtttagcaattgagcatcaacctaaattaattgtagctggtgcttcagcatattcaagaactattgactttaaaaaatttaaagaaattgctgatgaagtaggagctaaattgatggtagatatggcacatattgctggtttagtagctgctggtttacatcctaatcctttagaatatgctgattttgtgactactacaactcataaaactttacgcggtccacgtggtggtatgattttatgtaaagaagaatataaaaaagatatagataaaacaatcttcccaggtattcaaggcggtccattagaacatgtcatcgccgcaaaagctgttgcatttggagaagctttgaacgacgattttaaagattatcaaaatcaagtcattaaaaatgcacaagctttagctcaaacattaattgaagaaggcttcagagttgtatctggcggaacagacaatcatttagttgcagttgatgttaaaggttctatcaatatgactggtaaattagctgaagagacacttgataaagtaggaattacatgtaataagaatactattccatttgataaagaaaaaccgtttgtaacaagtggtgttagactaggaacaccagcagctacaactcgtggttttgatgaatctgcatttgtggaagtagcaaaaattattagtttagcattaaataactatgataatgatactaaactaaatgaagctaaagagagagttcacgcactcacatctaaatatccattatataattaa

SEQ ID NO: 114 - DNA, 216 bp, S.epidermidis
aagttgattttaaaaattaaaaatgcaagtatcatcgttagacacttgcatatcatcatcttttatttagcaatgacactcccaagtaacggcattatattaatcattatcccaccaagtttaagcataccacttatttccttatctcttattgtgattgcagcgctaattattccaagaatcgccacaaatcttggaatcatcatagatggataa

SEQ ID NO: 115 - DNA, 1467 bp, S.epidermidis
tatatgtatatatcttttctaaggagtgaatataataagatgagaaatttcactaaacaatatataaacggtgaatgggttgatagtgcaagcggtgaaactattgatgttattaaccctgcaactgaagaagtaatgggtaaaattgctaaaggtaacgaagaagatgttaataaagctgtagatgctgcagataaagtatatttagaatttagacatagttctgttgaagaaagaagagaacttttagataaaatcgtaaaagaatatcaaaatagaaaaaatgatttaattgaagcaattactgatgaactaggagcgcctttatcagtttccgagaacgttcattatcaaatgggattgaatcattttacagctgcaagagatgctttagatagcttccaatttgaagaacaacgtggcgatgatttggttgttaaagaagcaattggagttgctggacttgttacaccttggaatttccctacaaaccaaacttcacttaaattagctgctgcgtttgctgctggtagccctgttgttttaaaaccatctgaagaaacaccatttgctgcaattattttagcagaaatttttgataaagtaggcgtacctaaaggtgtgtttaacttagtcaatggtgatggatctggagtaggaaatcctttaagtgaacatccaaaagtaagaatgatgtcatttacaggttctggtcctacaggttcaaaaattatggaaaaagctgcaaaagacttcaaaaaagtgtctcttgaattgggtgggaaatcaccttatatcgtattagatgacgttgatgttgaagaagctgctaatgcaacaacgaaaaaagtagttaacaatacaggtcaagtttgtactgcaggaacacgtgtacttattcctgaaagtattaaagaagactacttaacagcagttaaagaagcatttagtaaagttaaagtaggtcaaccaagagaagaaggaactcaagtaggtcctattattagtaaaaaacaatttgatcaagttcaggattacattgataaaggtatcaatgaaggagcagagttattctacggtggtccaggtaaaccagaaggattagataaaggatattttgcgcgtccaactatatttattaatgtagataatcacatgacgattgcacaagaagaaattttcggacctgtcatgtctgtaatcacttataataatcttgacgaagctattgaaattgctaatgatactaaatatggtcttgctggctatgttattggtaaagataaagatacattgagacatgttgctcgttcaatcgaagctggtacaattgaaattaatgaagctggtagaaaaccagacttaccattcggtggttataaagaatctggcttaggtcgtgaatggggcgattatggtatcgaagaattcttagaagtaaaatcaatagctggatattttaaataa

SEQ ID NO: 116 - DNA, 147 bp, S.epidermidis
catcatcatattcaagtcatcgattattactttacaattaataagacgtctaatgataaaattcataagacaacaatcatcaaacatataatttttatgattattaacatttcatttttcagtattaaatcaaaaactgtaagataa

SEQ ID NO: 117 - DNA, 135 bp, S.epidermidis
ccactcctcttaaccttccagcaccgggcaggcgtcagcccctatacatcaccttacggtttagcagagacctgtgtttttgataaacagtcgcttgggcctattcactgcggctcttctgggcgtgaaccctaa

SEQ ID NO: 118 - DNA, 675 bp, S.epidermidis
gggttaagtatgtcatacaaatatgaagcattttttaaagatattttgattaatgaatatatttattttgcttcaaaaaataaaaaattaattagaatacaacatgagaatttgccatatattgctatgtggacagacgaaaatgttgctgagtcttatttgttacatcattcaattgattacgacaaaatcattagagcagatattgaccgttttgtaacatatgaaatggatgaaatctttgatccaggtgacaaagttttagttaatgtgaataatggtgaagaaggaaacattgtagatatagttaaaatgactgatgagttgatgtctgaattagatgatataagaatgagagagtttattaaagatgtcgcaaaatatgacgaagtatacggattgacaaacaaaggtgaaaagaattttattatgatttcagatgatgaccataacaaaccacacatcatgcctgtttggagtattaagagtagagcgcgtaaagtacgtgatcaagattttgaagaatgtgatttaatcgaaattgaaggtgaagtctttagtgaatggttagacaagttacgcgatgataataaagcagtggcgattgatttgaaatcaggtgttgttggtactgttgtatcagcgcaaaaactgtcaaatgaagcaacattttaa

SEQ ID NO: 119 - DNA, 123 bp, S.epidermidis
ctattcgtcattgagatgtcttggtctaactactttcttcgctgggaagtagttttattttttgaggaggctaattatgacattttcaaaagagttgagggaagcatcaagacctattattga

SEQ ID NO: 120 - DNA, 1860 bp, S.epidermidis
gcagtgataattaatcataatagccgtgttatcccatttgttggaggatattatatgtgtggaattgttggttatattggctacgataatgccaaagaattactattaaaagggttagaaaaattagaatatcgtggttatgactcagcaggtattgctgtagttaatgatgatggtacaaaactttttaaagaaaaaggaagaattgctgaattacgtaaagttgcagataatagtgatgaggatggtacgttaggaattggtcatacacgttgggcgacacatggtgttccaaattatgaaaattcacatccacaccagtcaacatctggacgttttacattagttcataatggtgtaattgaaaattatgaagaattaaaagctgaatatttatctgatgtcactttttcatcagaaactgatacggaagttattgtacaattagtagattatttttctagacaaggattagctacagaagatgcatttacaaaagtagttaaattattacatgggtcatatgctttaggattattagatgataatgataaagatactatttatgtggctaaaaacaagtctccgcttttagtaggtgtaggtgaaggtttcaatgttattgcttctgatgctctagcaatgttacaaactacaaaccaatacaaagagatacatgaccatgaaatagttattgttaagcgagacacagtagaaattaaagatcttgaggggcacattcaacaacgtgatacgtatacggcagaaatagatgctgctgatgcagaaaaaggcgtatatgatcattacatgttaaaagaaattcatgaacagcctgcagtgatgcgtcgcattattcaagaatatcaagatgaaaaaggtaatttaaaaatcgattcagagattattaatgatgtagcagatgctgatcgtatttacatcgttgcagctggtactagttatcatgctggattggttggtaaagaatttattgaaaaatgggcaggtgtacctactgaggttcatgtagcttctgaatttgtatataatatgccacttctttctgaaaaaccactatttatttatatttcacaatctggtgaaacagctgatagtcgtgctgtattagttgaaacaaataagttaggtcacaaatcattaacaattactaatgttgctggttcaacattatcacgtgaagcggatcatacattacttttacatgctggacctgagattgcagtcgcatctacaaaagcatatacagcgcaaattgctgttttatctatcttatctcaaattgttgctaaaaatcatggtcgtgaaaccgatgttgatttattaagagaactagctaaggttactacagctattgaaacaattgttgacgatgcacctaagatggagcaaattgcaacggatttcttaaaaactactcgtaatgcattcttcattggacgaacaattgattataatgttagtttagaaggtgcattaaaattaaaagaaatttcttatattcaagctgaaggatttgcaggtggggaattaaagcacggaacaatcgctttgattgaagatggcacacctgttataggtttagctacacaagaaaacgttaatctatcaattcgtggaaatatgaaagaagtagtagcacgtggtgcatatccttgtatgatttcaatggaaggtttgaataaagaaggagacacatacgtgattccacaagtacatgaattattaactcctttagtatctgtagtgacaatgcaattaatctcatattatgctgcgttacaacgagatttagatgttgacaaacctcgtaacttagccaaatcggttacagtagagtaa

SEQ ID NO: 121 - DNA, 567 bp, S.epidermidis
agaaaatcctttgaaaggaagtatttttatatgaaaattcaagattacacaaaagaaatggttgatgagaaatcattcatcgatatggcctatactttattaaatgataaacaaacaacgatgaatttatatgatattattgatgaatttaaatctttaggcggatatgagtatgaagatattgaaaatcgaatcgtacaattctataccgatttaaacactgatggtcgttttttaaatgtaggagaaaatctttggggtctacgtgattggtactctgtagatgatattgaggaaaaaatcgcaccaacaattcaaaaattcgatattctagatgacgaagatgaagaagatcaaaaccttaaattattaggtgatgacgacgctgatgaagatgacgatattcctgctcaaacagatgatcaagaaacattagacgagtcagataatgatgaagatgatgttgaaatgaatgaagcagatatcgttattgatgaagacgaagacgaagatattgctgaaggtgaagaagaagcctttgaagacgccgaagactttaatgattaa

SEQ ID NO: 122 - DNA, 1521 bp, S.epidermidis
gaggtgcaaatgacgatgtatagtccgcaaaagctacatccaatttcttatattgatggcttgattagtgtgattaaatcaaatttcattgtaattatcatctttttatttaatataaaagattttaaatatgatgatttttcgtcttatattattccaggtataatgactttgatattttctatcggtttcattcataatattattaaggtttataatacacgatattggattgaagaggatcattttattttaactactggtgtttttaataaggaacgaaaagaactaaatattagtcgcatacaatctgcagatacgtctcaaggtttgattaatcaaattgttggcggcgttgaactcatcattaaaacaccaagtgatggcatagaattagggacaatttccaaaaagcaaagtgaagttattgaacaagaattgcgatctattcaagaacgcatgaataaccaggtaaatcaagaagctaaagagttaaatgatgagaatcatactcagacatatcaacaacatgccaaaccccaatatgcaatatttaaaatgccttttaaacaactattatttatgtctatgacaagtggagctatagcacttgcttttgtgacactatctcctattattggcagtctctcaagtgttattccatgggataaatttggtgaagaaatatcttcggtatttaaaacgatatatttcattgtcatttttattgtcatactagtgttattattaagttatataatcggaactatcatgtacttaataaagttttatggatatcaagttattcaagataatcatcaacttaaaattcaatatggattatttacaaagaaaaatatcactgtaccaactgaccgactgcaaggtgtacttgaacatcaatcttttatacgaaaattatttggttatacatctatacatttctatattacaagtgatatagatactactgaaggggaacccactgataatgatggaagaattatgattttaccgtttattccaagaaaagaggcatataaagtgattaggcctttggttcctgagatgacatttaatcatgctaaaattggcatgcctttaaaaggatttcatcgtcactttctaattccttccttatgtattattggtatgggcattattggatggtatatgtggtctttatggtctttaatcatagctttattaccaatcttattattttttgtttacgctatactttatacacgttttagtggttttgcttttagcgaatcagagctagttgtccaaaaagcgtctatattaaatattaagagattttatgttaaaaaagaaaaagttttaggaatggctattagccaacatccctttcttgaaagaagtcaactcgcaaattttcaatttgttattgctaagggtagtagtcagcaaaacattggtttgaagtttagtgaagtagataatgttcttaaactcaaaaattggtacatgaaaggtgatactcatgaagtcttataa

SEQ ID NO: 123 - DNA, 171 bp, S.epidermidis
aatttaaaaattgaacgaatgatttataaaaagttttacacacctctatatataattatactaatcgtagattttatagatataaagagctttgatatagagttgatgattcaacaaaactctataataaaaaactgtctacaatacccaaacgggaaagtagacagttga

SEQ ID NO: 124 - DNA, 150 bp, S.epidermidis
atattaaaaataaaaaaatcgctccctctcacagcaattgtaaggggagcgtatctatttaatacacgtgtcctaattaaaggagcccaaataaaatactaccaccttttaaataaaaataaaagtcccactttaatgtttctgttataa

SEQ ID NO: 125 - DNA, 1428 bp, S.epidermidis
aaggaggaaatcaacatgggaattggccgtgtagctcaagttatgggtccagtaatagatgttcgttttgaacataacgaagtacctgagataaataatgcattacacatcgaagttcctaaagaagatggagcgcttcaattaacattagaagttgcacttcaactaggtgacgatgtagttcgtacaattgcaatggactcaactgacggcgttcaaagaggaatggaagttaaagatacaggtagagacataagtgtacctgtcggtgacgtaactctaggaagagtgtttaacgtactaggagaaactattgacttagatgaaaaaattgatgattcagtacgacgtgaccctatccatagacaagctccaggattcgacgaattatcaacaaaagtagaaatcttagaaactggtattaaagtagtagacttattagcaccttacataaaaggtggtaaaattggattatttggtggtgccggtgtaggtaaaaccgtactaatccaagaacttattaataacatcgctcaagaacacggtggtatctcagtattcgctggtgttggtgaacgtacacgtgaaggtaatgatctttactatgaaatgagtgacagtggtgttatcaagaaaactgcaatggtctttggtcaaatgaatgagccacctggtgcacgtatgcgtgtagcattatccggattaacaatggccgaatatttccgagatgaagaaggccaagatgtgttattattcattgataacattttcagattcactcaagctggttcagaagtttctgcgttattaggtcgtatgccatcagctgttggttatcaacctacacttgctacagaaatgggtcaattacaagaacgtataagttcaacaaataaaggttcagttacatcaattcaagctgttttcgtaccagccgatgactatactgaccctgcgccagcaacaacgttcgcacacttagattcaacaacaaacttagagcgtaaattaacagaaatgggtatttatccagctgtagacccgcttgcttctacatctagagctttggaaccttcagtagtaggtcaagagcattatgatgtggcacgtgaagttcaatctactttacaaaaatatagagagttacaagatattattgcgattcttggtatggatgaattatcagatgaagataaacaaactgtggaacgagcacgtagaattcaattcttcttatcacaaaacttccacgttgcagaacaatttactggacaaaaaggttcatatgtacctgttaaaacaacagttgcagacttcagagatattttagatggtaagtatgaccatattcctgaagacgcattccgtttagtaggtagcatggaagacgtaattgagaaagcaaaagatatgggtgttgaagtctaa

SEQ ID NO: 126 - DNA, 1305 bp, S.epidermidis
ataatgagaatgattgacatcatagaaaagaaacgagacggtaagtcattaacaaaagaagaaatagaattttttgtaaacggatacactcatgaggaggttccagattaccaagcttcaagtttagctatggcgatattctttcaagatatgaatgatgaagaaagagcggcattgacaatgtcaatggttaactcaggagagaagatcgacttaagcgatatcaatggtattaaggtagacaagcattctacagggggcgtcggtgatacaacgacactcgttcttgccccattagtagcggcagtaggtgttccagttgcaaagatgagtggtcgtggtctaggacatacgggggggacgatagataaattagaatcagttaagggatttaatgttgaaatcagtgaaaaagattttataaaacttgtaaatgataaccaagtagcagtaataggccaatcaggcaatctcacaccagctgataaaaaattatatgcattgagggatgtaacagggacagttaactctattcctctcatcgcttcgtccataatgagtaagaaaattgctgctggcgcagatgcaattgttctagatgtcaaaactggcagtggtgcgtttatgaagacgctagatgatgccgaagcacttgcgcatgcgatggtaagaattggtaataatgtaggtcgtaatacgatggctattatttcagatatgagtcaacctttaggaaatgcaattggtaatgcgctcgaattaaaagaagctatcgcaacattaaaaggaaatgggccgaaagacctaacagagcttgtgttaacacttggttctcaaatggttgtcttagctgaacaagcaacatctttagatgaagcgcgtcagatgctaatcgatgctataaaaacaggcaaagctttaaacaaattcaaaacatttctatcgaatcaaggaggagatgactctattgtggattctcctgaaaagttacctagcgcgaaatatcaagttgaatttaaagctaaaaaagatggttatataactgaaataatagctaatgagataggcgttgcttcaatgatgttaggcgctggtcgtcaaacaaaagaagacgttattgatttaggtgtaggtatcgtgttaaataaaaaagtaggagaacatgttgagaaaggtgaaaatattttaactattcataccaacaccaaagagatcgatgatattttatataaactagacaatagtattactattgagagtaagggcgaagctccaaccttaattcataaaataataaccgagtag

SEQ ID NO: 127 - DNA, 1062 bp, S.epidermidis
atatttttgatgaaaaaagttatgaccatatttggaactaggcctgaagctataaaaatggctccgttgattaaaacgttagagaaagattctgacctggaacccgttgttgtagtcaccgcccaacatagagagatgcttgattcagtgttgaatacttttaacataagtgcagattatgatttgaatattatgaaagctggtcaaacattgtctgaagtaacatctgaagcaatgaaaaagttagaagatatcatacaaaaggaagtgcctgatatggtacttgttcatggtgatacagtgacaaccttttctggagcattagccgcattttatagtcaaacacctataggacatgttgaagctggattaaggagttataataaatattcaccttatcctgaagaaataaatagacaaatggttggggtaatggcagatttgcactttgccccaacctataatgctgcacagaatttagtaaaagagggtaaattagccaaacatatagctatcactggtaatacagctattgacgcaatgaattatacaatcgatcaccaatattcatcatctatcatacaaaaacataaaaataaaaactttattttactcacagcacatagacgtgaaaatataggtaaacctatgataaacgtgtttaaagcgattagaaagttgattgatgaatatcaggatttagcgttggtctatcctatgcatatgaatcccaaagtaagagatattgcgcaaaaatatttaggaaatcatcctaggattgaattgatagaaccacttgatgtggttgattttcataattttgctaaacaagcatatctcattatgactgactctggtggaatacaagaggaggcaccatcattacacaaaccagttttagtattgagagatagtactgaaagaccggagggagtagatgctggaactttgagagtcattggtacgaatgaagaagatgtctataatgaaactaaaaaattaatagaaaacccagacctttatcaaaaaatgagtcaagctgttaatccatatggcggttga

SEQ ID NO: 128 - DNA, 924 bp, S.epidermidis
attagtatgataaaatatactctatgtgaatataacattagaggtggaaaaatgaagaaaaaagcgttactacctttgtttttgggaataatgatttttctagcaggttgtgattactctacacctgagaagcaagatggattcttctttaatacttttgttcaacctatgaaacatctcttacagtggttaggaaatgatgtttttcataataattttggactagcaattattgtattagttcttttcattcgtttaatcttgttaccatttatgttatctaactataaaaatagtcacatgatgcgtgagaaaatgaaagtggctaaacctgaagtagatggcattcaagaaaaggttaaacgtgcgcgaacacaagaagaaaaaatggctgcaaaccaagaacttatggaagtttataaaaaatatgatatgaaccctatgaagagcatgttaggatgtttacctatacttattcaaatgccaattattatgggattatactttgtattaaaagataagcttgtaaatggtttatctgaacatccgcatttcttatggttcaatttaactaagcctgatatttggattacagttattgccggtgtgctatactttattcaagctgtagtttcaagcaaaacgatgcctcaagagcaacgtcagatgggctatatgatgatggttatttctccaataatgattatttggatttctttacaagcatcatcagctttaggtttatattggtctgtcagtgcattattcttagtaattcaaacgcattttgctaatatttattactctaaacttgctaaaaaagaagttcaaccttttattgaaaagtatgaaagagaacataatccatcttcaaagaaaaaagggaaaaatactcaagtagtatcaaaaaagaataaaaaataa

SEQ ID NO: 129 - DNA, 210 bp, S.epidermidis
atatcagtgataacagcaaatttcatgatattatctcccttcaatgttatcttattagcatattctaacattttgtgctctattatgttagatattaatttaaaatttattagaattttgatattgtatttatatgaaaaaaaaggagtgcttaaaatttgtttaattattataaatccggatttcaaaaagcaaaaccacataatctaa

SEQ ID NO: 130 - DNA, 156 bp, S.epidermidis
  unsure (51): Identity of nucleotide sequences at the above locations are unknown.
tacttatggataatcacgttgattcaccaccatcagctgaaaccgtacccnataaacaaggtaggactaactaggacgtattatgtaatttatcaagacgtcttccaagaatatattattatgataataatgaagaggttactaacgaattgttaa

SEQ ID NO: 131 - DNA, 417 bp, S.epidermidis
gaggtatggataatgaatacacttagactaaatattgtcactcctaatggttctgtctatgaacgtgaagacgttgagatggctgtcttacaaacaacagctggtgaaatggggattatgtatggtcacattccaactgttgctgcattaaaaacaggtcatgtgaaagttaattttcacaacggaaatgaatttattgcagtaagtgatggctttattgaagcaagacaacatcaattatcaattatcgtccaaacggccgaacctgctagtgaaatcgatgttgaaagagctaaattagctaagtcgagagcagaatcacatttagaagatgatgatgataatacagacataaatagagctaaaagagcacttgaacgagcaaataatcgtttacgtgttgcagaattacaataa

SEQ ID NO: 132 - DNA, 207 bp, S.epidermidis
tataacaacttttggaatcagatggaggttcttttcatgttatcttttaatcaaaatagaaaccacagtcttgaacaatctttaaaagaaggttatgcacaaatggccgatttaaacctctccctagcaacagaagcttttccgatagagtgtgaagcttgtgattgcaatgaatcacatttaatatctaattcaaagaatgaatga

SEQ ID NO: 133 - DNA, 948 bp, S.epidermidis
ctaaacattgtagtgagacagaaaaaaaagagattaaagaaaatttcttgcaaagtactattcatgagagacatttcttcaatatggcatatattaatgaaaaatgggaatatgggggaaataacaatgaataaacctaaaattgcactaacaatagcaggcacagatcccaccggtggggcaggtgttatggcggatttaaaatcatttcacgcgtgtggcgtttatggtatggccactataacaagtatcgttgctcaaaataccctaggagttcaacatatccataatttagaatcttcatgggtaaaggaacaacttgatagtgtgtttgatgatgaattaccacaagctatcaaaacgggtatgattgcaacaaaaaaaacgatggagttgattcaaagttacttaaaggaacattccaatattccttatgtgattgatccagttatgcttgccaaaagtggtgattcattgatggatgaaaatactaaaaatcatttgcaatcaacattattacctttggctgatgttgtcactccgaatatacctgaagctgaggaaattactggtattaaaattaatgatgaagaaagcatacgtaaagcaggtcaaatctttattaatgaaattggtagtaagggtgttgtaattaagggagggcattcagccgatttaaataatgctaaagattttctttttactaagaatgaaacgtatacctttgagaacaaacgctttgatactaaacatactcatggaactggttgtactttttcagcagttattacagcagaattagctaaaggtcgttccataaaagatgcagttaaaaaagcaaaagagtttatttcattaagtattgaacataccccagaaattggcaaggggagaggacctgtaaatcattttgcttatatgaagaaagtaggtttagatgatgaataa

SEQ ID NO: 134 - DNA, 132 bp, S.epidermidis
agaaacaacgtatttaacatgaattctgatacactcactatttcatatcactcaaatataaatgttgttaatttaaaaattgtgttaagaattataccgtttccgtccaaatatcagcaccaagtgctttaa

SEQ ID NO: 135 - DNA, 912 bp, S.epidermidis
tataatgacgttgaaaaaaacgtgcactgttgcactcaaggaggaactttaatgcctttagtttcaatgaaagaaatgttaatcgatgcgaaagaaaacggttatgcggttggtcaatacaatcttaataacctcgaatttacacaagctattttagaagcgtctcaagaagagaatgcgccagttattttaggtgtttctgaaggggcagctcgttatatgagtggtttttatacagttgtgaaaatggtagaaggtttaatgcatgacttagacatcacaatcccagtagcaattcatttagaccacggttcaagctttgaaaaatgtaaagaagcaattgatgctggattcacatctgtaatgattgatgcatctcatagtccttttgaagaaaatgttgaaatcacttctaaagtagttgagtatgctcatgatagaggcgtttctgtagaagctgaattaggtacagttggtggacaagaagacgacgtagttgctgatggcgttatctatgcagaccctaaagaatgtcaagaattagtagaaaaaactggaattgatactttagctccagcattaggttctgtacatggaccatataaaggtgaacctaaattaggatttaaagagatggaagaaattggtgcttcaactggattacctttagtattacacggtggtacaggtattccaactaaagatattcaaaaagctattccttatggtactgctaaaattaacgtgaatactgaaaatcaaattgcgtctgctaaagcagttcgtgaagtattaaacaacgacaaagatgtgtatgatccacgtaaatatttaggaccagcacgtgaagcaattaaagagacagttaaaggtaaaattagagaattcggtacttctaatcgcgctaaataa

SEQ ID NO: 136 - DNA, 165 bp, S.epidermidis
ggtgacttagtggacaaagttaataagatcgccaaactaaataaattattttgggaaactacggatagcgtgtataaaattcatataatagcacgcttatttcatgatgtattcgttgataatgattatgataggggattatcaaatttaagcagtgataattaa

SEQ ID NO: 137 - DNA, 135 bp, S.epidermidis
cgattgatagtcaataatgttaaaattcaaatcttatttgtaaactgggacatgattgattattctaacttttttatcaaacactacttaatattcttaaagaatcatacacttataatccagcttccaatataa

SEQ ID NO: 138 - DNA, 153 bp, S.epidermidis
attttctcagtttttagcttcaaacatctttttaatatcaaatttataatgttcgtttataaaaaaagcaccccaaaagttaaattaaaatctaacttatggggtgtaaatactataaacatgtcgcagactttttctaatataatcaattaa

SEQ ID NO: 139 - DNA, 1296 bp, S.epidermidis
ctgattagagttttaagtggaggattaaagatggataaaatagtaataaatggtggaaatcgtttaacaggtgaagttaatgttgaaggagctaaaaatgctgtattacctgtacttacagcgtcattacttgcttctgaaggacacagtaaactagttaatgtcccagagttaagcgatgttgaaacaatcaataatgtattatctacactcaatgcaaatgtagagtatgataaagataaaaatgcagttaaagttgatgcaactaaaactttaaatgaagaagccccttatgaatatgtgagtaaaatgcgagcaagcatcttggttatgggaccactacttgctcgactagggcatgctattgttgctttgccaggaggatgtgcgattggaacacgtcctatcgagcagcacattaaaggatttgaagctttaggtgcagacattcatttagaaaatggaaatatttatgcaaatgctaaagatggattaaagggagcacatattcatttagattttccgagtgtaggtgcaactcaaaatattattatggcagcgtccttggcatcaggaaaatctatcattgagaatgtcgctaaagaacctgaaattgttgatttagctaattatattaatgaaatgggcggtaaaattacaggtgcaggtactgataccattacgatacatggtgttgaaaaactttacggtgttgaacatgcaattataccagatagaattgaagctggaacgttacttatcgcaggtgcaataactcgtggtgacatatttgtacgtggtgcaattaaagaacatatggctagtttaatatataagcttgaagagatgggggtagatcttgaatattatgaagaaggtataagagttacagcaaatggagatttaaatccagtagatgtaaaaactttaccacacccaggtttcccaactgatatgcaatctcaaatgatggctttattattaacagcaaatggacacaaagtgattactgagactgtttttgaaaatagatttatgcacgttgcagaatttagaagaatgaatgcgaatataagtgttgaaggaagaagtgctaaaattgaaggaaaaagccatttacaaggtgctcaagttaaagcaacagatttaagagctgctgcagccttaatcttagctggtttagttgcagagggaactacgcaagtgactgagttaaagcatctagatagaggatacgtcaatttacatggaaaactaaaaagtctaggtgcaaacatagaacgtgtaaatcgataa

SEQ ID NO: 140 - DNA, 1374 bp, S.epidermidis
ttattagaggttttagttatgataaacgtaacattagagcaaattaaaaactggatagattgtgaaattgatgaaaaacatttaaaaaaaacgataaatggggtttcaattgattcacgaaaaatcaatgaaggggcgctatttataccttttaaaggtgagaatgttgatggccatcgttttatcacgcaagcgttgaacgatggtgctggagctgtttttagtgaaaaagagaataaatattctgaagggaaccaaggtcctattatttgggtagaagatactttaatagccttacagcaattggcaaaagcatatctaaatcatgtgaatcctaaggtgatagcggttactggttctaatgggaaaacaacaacaaaagacatgattgaaagtgtattatcaactgaatttaaagttaagaaaacacaaggaaattataataatgaaattggaatgccgttgactttactagaacttgatgaagacacagaaatttctattctagaaatggggatgtcaggttttcatcaaatagagttgttatctcatatcgcacaacctgatatagcggtcatcacaaacattggtgagtcacatatgcaagatttaggatcgcgagaaggcattgcaaaagctaaatttgaaataacaactggtctcaaaacaaatggtatatttatttatgacggagatgaacctttattaaaacctcatgttaatcaagttaaaaatgcgaaattaataagcattgggttaaattcagacaatacatatacttgtcatatgaacgatgtaaaaaacgaaggtattcattttactatcaatcaaaaagaacattatcatttaccaattttgggcacgcataatatgaaaaatgctgctattgcaattgctattggacatgaattaggcctaaatgaaacaataattcaaaataatattcacaatgtgcaattaaccgctatgagaatggaaagacatgaatcatcaaataatgtaacagtaattaatgacgcatataacgcaagtccaacgagtatgaaagctgccattgatacattaagtggcatgaaaggtcgaaaaattttaatattagcagatgtacttgaattaggacctaatagtcaattgatgcacaaacaagttggtgaatatttgaaagataaaaatattgatgttttatatacatttggtaaagaagctagttatatccatgatagtggtaaaatttttgttaaagaagcaaaatactttgataataaagaacagttaattcagacgctaatatctcaagttaaacctgaggacaaagtcttagttaaaggttcacgaggtatgaaacttgaggaagttgttgacgcattgttgtaa

SEQ ID NO: 141 - DNA, 126 bp, S.epidermidis
ttgaagcgggtgctacacgtattggtgctagtgccggtgtgcaaattattcaaggacttgaatcaaatactgattactaatactaaatttatgtctaaaggaatgatgaataatgagaatgattga

SEQ ID NO: 142 - DNA, 141 bp, S.epidermidis
tttatcctttctttcaattatactcgagcggcctttgttaatcataaaatattaataaaaggtcgctttaaatacatagcaaaggcctataatttcaataattatctgataaatttcatttgtattacaacgatattgtag

SEQ ID NO: 143 - DNA, 129 bp, S.epidermidis
aaccccatttcaatcattctatatattaagagcgtgggacatcagttatgttcccacgctctaaaaattttcaataggttttataaatttcagatgaatctatctcaatatttactttttcacatataa

SEQ ID NO: 144 - DNA, 153 bp, S.epidermidis
actatatgttcttcagttaaatctagtgctttaaatacatcaggtgatgaaattccgatgttaggcttagctaaaacaacccatgcagaaggtggtctttttaggaaagttacttgctcgccacgccccgtacacacagcagtttggttataa

SEQ ID NO: 145 - DNA, 1521 bp, S.epidermidis
attgataaatcaaagttcaaaggagagaaatttatgtcagaagaaatgaacgaccaaatgcaagttcgtcgtcaaaaattacaagaattaattgatttagggattgatccttttggtcatcgattcaatcgctcatctacttcaagtgagttaaaagaacagtgggaccaattctctaaggaagaattgcatgaaaaagaagacgaaagccacgtgtcaattgcaggtcgtcttatgactaaacgtggtaaaggtaaagcgggatttgcacatattcaagacttgaaaggtcagattcaaatttatgtaagaaaagatcaagttggagatgatcaatttaacatttggaaaatggctgacttaggtgacatcataggtgttgaaggtgtcatgtttaaaactaatacgggcgagatttctgtcaaagctaagtcatttactttactatccaaatcattacgacctttacctgataagttccatggtttacaagatatagaacaaagatatcgacaacgttatttagatttaattacaaatgaagatagtacgcaaacgtttattaatcgtagtaaaataattcaagaaatgagaaactatttaaataaacaaggattcttggaagtagaaacaccaatgatgcaccaaattgctggaggtgctgctgcacgtccgtttgttacgcatcataacgcattagatgctactctttatatgcgtatagctatagaactacatttgaaacggttaattgtcggaggtcttgaaaaagtctacgagataggcagagtttttcgtaatgaaggtgtatctacaagacataaccctgaatttacaatgattgaattgtatgaagcttatgctgattatcatgatataatggatttaactgaaaatatggtcagacacattgctcaagaagtgtttgggtcagctaaagtacaatataatgatgaagaaattgacttagaatcttcatggaaacgacttcacattgttgatgctgttaaagaagttaccggtgtagatttttataatgttaattctgatgaagaagctattagattagcaaaagaacatgatattgaaattactgaaaatatgaaatatggccatatattaaatgaattttttgaacagaaagttgaagaaacacttattcaaccaacgtttatttatggtcaccctattgaaatttcaccgttagcaaagaaaaatccaaacgatgaaagatttactgatcgttttgaattatttattgtaggaagagagcatgcaaatgccttcacggaattaaacgatccgattgatcaacgccaacgttttgaagcgcagcttgttgaaaaagaacaaggaaatgatgaagctcatgatatggatgaggattacatcgaagcattagagtatggaatgcctccaactggtggtctaggtatcggtatcgacagattagtaatgctattaactgattctccgtcaattagagacgtattactattcccatacatgagacaaaaatag

SEQ ID NO: 146 - DNA, 195 bp, S.epidermidis
cgaacaaggtcgagtgacttcaatggaaatgtggcaaaagcaggtacagatatcaaagaaaacgatgaactcattattcgttttggacaaaaattagtcacagttaaagtaacaggattaagcgaccatgctacaaaagaaaatgcaaaaggtatgtatgatttgattaaagaagaacgtattaatgaagagtga

SEQ ID NO: 147 - DNA, 138 bp, S.epidermidis
agtaggacgttgccaggcaaatatcgtataagatgcgatgagcctaatcgagaccgaaaggtctcttttttttatacaaaaatagttctaaaaaataggtttctcggcgaggagaaagtattaggaacttatgaataa

SEQ ID NO: 148 - DNA, 810 bp, S.epidermidis
tttaaaatgcccaatgttgtaggtgttcagtttcaaaaagcagggaaattagaatactacgcgccgaatcaattagatgtaaaggttggtgactgggttgttgtccaatctaaaagaggtatagaaattggccacgtaaagtttccattacgtgaagttgatgtagaagatgtcacattaccgctaaaaaatatcattcgtaaaatgaatgaagatgatcaagaaacatattatcgtaatgaacgcgatgccaatgatgcgttagaattatgtaaaaaagtagttaaagatcagcaattagatatgcgattagttaattgtgaatatacattagataaatctaaagtgatttttaattttaccgcagatgatcgcattgattttcgcaaacttgttaaagttttagctcaaaatctaaagactagaatagaattacgtcaaattggggtaagagatgaagcgaaattattgggtggtatcggtccttgtggacgttctttatgttgttctacatttttaggagatttcgaacctgtatccattaaaatggcgaaagatcagaacctatcattaaatccaactaagatttcaggagcttgtggtagattgatgtgttgtcttaaatatgaaaatgactactatgaagaggctcgaactcaattacctgatgttggagatatgattcaaacaccagatggtcacggaaaagtgataggattaaatattttagatatttctatgcaagttaaaatagagggtctagaacaacctttagaatataaaatggaagagatagaagtattgaattaa

SEQ ID NO: 149 - DNA, 615 bp, S.epidermidis
gaaatgtctacatttataacgtttgaaggtccagaaggagcaggaaagacctcagtaattaaaaaagtaagcgaaagattagctaaagaatatgatattgttacaacacgtgaacctggtggagtattaactagtgaagaaatacgtcgtattgtacttgatggagatagtatagacattcgaactgaagctatgctgttcgctgcatctagacgtgaacaccttgttgaaaagattatcccatctttacaggcaggtaaaattgtcctttgtgatagatatattgatagttcattggcttatcaaggttatgcaaggggtataggaattaaagaagtaaaattattaaatgaatttgcaattaatggtttgtatccagacttaacgatttatttagatgttgatgcggaaattggtcgtcaaagaattctaaaaaataacagagaacaaaacagattagataaagaggaaaaagcttttcatgaaaaagtgatcgaaggatatcaaaaagtgattagtgataatcctcatcggtttattaaagtcaatgctaaccatagtttggataaagttgttgaagaaacataccaatctatcatcaaatatttaaaataa

SEQ ID NO: 150 - DNA, 141 bp, S.epidermidis
tgttcattaactcgtttagattatctaaattcattgtctctctcatttattcataagttcctaatactttctcctcgccgagaaacctattttttagaactatttttgtataaaaaaaagagacctttcggtctcgattag

SEQ ID NO: 151 - DNA, 153 bp, S.epidermidis
  unsure (126): Identity of nucleotide sequences at the above locations are unknown.
atgctttcagcacttatcccgtccatacatagctacccagctatggccgttggcaccacaactggtacaccagaaggtatgttccatcccccggtcctcttcgttactaaggacagctcctctcanattttcctacgcccaacaaacggatag

SEQ ID NO: 152 - DNA, 597 bp, S.epidermidis
cgtccaacagcatcaatttcatcaataaaaatgatacatggggcatttttcttagcattttcaaataaatcacgaacacgactcgcaccaacaccaacaaacatctcaacgaagtcagatccactaattgagaagaatggtgcaccagcttcacctgcaaccgcacgtgctaataatgttttacctgtacctggaggcccaacaagtaagacaccttttggaattcttgaacccatttgtttaaatttcttgttatcttttaagaaatctacaatttctattaattcttgtttctcttcgtcagctcctgctacatctgagaaacgaactcgacgtttattactgtcgtacatcttagctttggattttccaaagttcatcatacgaccaccgccgccgccaccttgggcttggctaaggaagaaaataaataataatgcaatgattaatacaggaatcagtgtcgttaaaatactaacgaatacactttgtttttcttcttctttaactgtaaatttaagattatcttgtttcttagctgtatctgtgattttttgtaaatctttttcattgttatataaaattgtcgatgagtaa

SEQ ID NO: 153 - DNA, 480 bp, S.epidermidis
atggttaaagcttatttaggattagggagcaatattggaaatagagaactacaactcaatgaggctattaaaatacttcatgactatcaaggtattcaagtaactcaagtttctcatatttatgagactgaaccagtgggatatactaatcaaccgaaattcttaaacttgtgcattgagatagagactgaattgaatccacaatctttgttaaaatgttgtttaacaacggaacaacaacttcatcgtaaaagagaaatacgttgggggcctagaactttagatatagatatactactgtttggtgatcaaattattgaacaagataatttatcagtgccgcaccctagaatgaaagaacgttcgtttgttcttatcccgttaaatgatatagccaccaaacaaatagaaccgatttctaataaaagtatcggacaactagtagtacctgataatagtgtgaaaaaatataaggaataa

SEQ ID NO: 154 - DNA, 210 bp, S.epidermidis
tttatcaatttattgttccatgtctttctgttgaaaactttaggagctatatattgtttcctaatcagttttaatttatatttaagccttttattatacccttcttatcttcatatgtattgttattcaatgaaggttgatattgcatctaatcaaagcaaatctactcactttattattctacaagaccatcaaaatgtaataaagtaa

SEQ ID NO: 155 - DNA, 1386 bp, S.epidermidis
agtgtaaattttaatggagggttagcattcatgcaaagacatgcgattattctggcagcaggtaagggcacaagaatgaaatcaaagaaatataaagtgctccatgaggttgctggcaaaccaatggttgaacatgtgcttaacaacgtaaaacaagctggcgttgatcaaattgtaactattattggtcatggcgctgagagtgtgaaagatacattgggtaatcaatcattatatagttttcaggataaacaacttggaacagctcatgctgtgaaaatggcacatgaacatttagcagataaagaaggaactactctagtagtatgtggagatacaccacttattacataccaaactttacaatcacttattgaacatcatgaaagtacacaatcacatgttactgtattatctgcttctactatcaatccttatggttatggacgaattattagaaatcataatggaatattagagcgtattgttgaagagaaagacgcaaatgactcagaacgtgcgattaaagaaattagttcaggtatttttgcctttaataatcgagtactatttgagaagttagaacaagttaaaaatgataatgctcaaggagaatattatttacctgatgttttgtctttaattttaaaagacggaggtaaagctgaagtttattgtaccgaagattttgatgaaatcattggtgttaatgatcgtttgatgttaagtgaagctgaaaaggctttgcaacaacgtatcaatcgctatcatatggaaaatggtgtgacaatcattgatcctagttcaacatttattggaacagatgtgaaaattggaatagatacaactattgaaccgggcgtgcgcatcggaggtcatacaacgattgaagaagatgtgtggataggccaatactctgaaattaataatagcacaattcattcgaatgctaacataaaacaatcggttatcaatgactctattgttggagagaacacaacagttggacctttcgctcaactacgcccaggatctaatttaggttctgaagttaaagtaggaaactttgttgaagtgaagaaagcagatattaaagatggtgctaaagtatcacacttgagctacattggagatgctgaaataggtgagcgtacaaatatcggatgtggttctatcactgtaaactatgacggcgctaacaaatttaaaacaatagtaggtaaagatgcttttataggatgtaatacgaaccttatagcacctgtaacagtaggtaatcatactcttattgcagctggatccacaattacagataatatccctgaagatagtttagcattagcgcgtgcaagacaagtaaataaagagggctacctaaaaaaatag

SEQ ID NO: 156 - DNA, 153 bp, S.epidermidis
ataaaactatatactactttggtctttactataagacatttcctacaaaagattaagttaaacgtaaaaaaagatagtcgaacgaaagtgaggacaacaaataatcctccttttcgacgacttttacattactatatgactaacttctattaa

SEQ ID NO: 157 - DNA, 897 bp, S.epidermidis
aaaggagatttaacaatgacacatgattatatagtgagaggtttagcatacggtggggaaataagagcatatgctgcaatcacaacagagtcagtacaagaagcacaaacacgtcattatacatggcctactgcttctgccgctatgggaagaactatgacagctactgttatgatgggtgcaatgttaaaaggaaatcaaaagttaacagttactgttgatggcaaaggtccaattggcagaattattgctgacgcagatgctcaaggaaatgttcgtgcatatgtagaccatccacaaacgcattttccactcaacgatcaaggtaaattggatgtacggcgagcagttggtactgatggttccattcaggttgttaaagatgttggaatgaaagactacttttctggtgcgagtccaatagtatcaggtgagctaggagatgatttcacatactactatgccacaagtgaacaaacaccatcatcagtaggattgggtgtattagttaatccagacaactcaatcaaagcagcgggaggatttattattcaagttatgccaggtgctactgatgaaacggtgactaaattagaagaagccattagtcaaatgcaacctgtatcgaaattaattgagcaaggacttacacctgaaggaatattaaatgaaattttgggtgaaggtaatgttcaaattttaaattcaacgtcagcgcaatttgaatgtaattgtagtcatgagaaatttttaaatgctattaaaggtttaggagaggcagaaattcatagcatgattaaagaggatcatggagctgaagctgtatgtcacttctgtggtaataaatatcagtatagtgaaagtgaattagaagatttattagaaacaatgaaatag

SEQ ID NO: 158 - DNA, 123 bp, S.epidermidis
cctgctcctcacttacccatcaacgttactgttgcttgtaagtgtttatttgttcgcaattctacgaacgatagtattatacatgttgatgtaggatacgtcaaattcaattgtaaattttag

SEQ ID NO: 159 - DNA, 546 bp, S.epidermidis
attataatgcataaggatttaaagaatgttttgttatcggaagaagacattcaaaatatttgtaaagagatgggagctatcattactgaggattataaagatcgcccactcgtttgtgttggtattttgaagggatcagtcatgtttatggcagacttaattaaacgtattgatacacatttatcaatcgattttatggatgtttcaagttatcatggtggaacggaatcgactggggaagttcaaatattgaaagatttaggtgcttctatagaaaataaagacgtacttataattgaagatatattagaaactggtacaactttaaaatctattacagagttattgcaatcacgtaaagttaactctttagaaatagctacattattagataaacctaaccgtcgcaaagctgatatcgaagcaaaatatgttggtaaaaagattccagatgaatttgtagttggttatggtttagattatcgtgagttatatagaaatctgccatacataggcacactaaaagcagaagtttattctaaatag

SEQ ID NO: 160 - DNA, 417 bp, S.epidermidis
tctcaatttaatattcacgtaacagatgaatggataattcaaattgcatatgataaattaataataatggctaaaagtgaaatggatcaatatatattagaccgtatatgtattagaaagccaggtacatatgaatttaatgattatcaaattgatattcatcctgacttaccacaacagttatatccgcttactgtgcgtgtccgacaaaatggagatgtgtataaattaaatggtcaaaaaggtcataaaaaagtgagtcgtttatttatcgataaaaaagtgactcttgctgaacgtcagcgcatcccactcattattaatcaagaaaatgcagtgttagctattggcgatttatatgttaaagaaaattttaaagaatttattttgatttcgaataatggagatgaattataa

SEQ ID NO: 161 - DNA, 891 bp, S.epidermidis
atggaatataaagatatagcaacaccatctcgaacacgtgctttgcttgatcaatatgggtttaattttaagaaaagtttaggacaaaattttctaatagatgtaaatatcattaataaaattatcgaagcgagtcatatagattgtacaacgggtgtaattgaagttggaccaggtatgggatcattgactgaacaacttgcaaagaatgctaagaaggtgatggcttttgaaattgatcaaagattaatacctgtgcttaaagatacactttcaccatacgataatgtaacaattatcaatgaagatatacttaaagctgatattgctaaagctgtagatacacatctacaagattgtgacaagattatggttgttgctaatttaccgtattatattaccacacctattttacttaatttgatgcaacaggatgtacctattgatggttttgtcgtaatgatgcaaaaagaggtaggagaacgtttgaacgctcaagtaggtaccaaagcatacggttcgttatcgattgttgctcaatactatacggagacaagtaaagttttaacagttcctaaaactgtatttatgcctcctccaaacgttgattctatcgttgtaaaattgatgcaacgccaagaaccacttgtacaggttgatgatgaggaaggcttttttaagttagcaaaggccgcttttgcacaacgacgtaaaacaattaataataactaccaaaacttctttaaagatggtaagaagaataaagaaactatacgacagtggctagaaagcgctggtattgatcctaaaagacgtggagaaacactcacgattcaagatttcgccacattatatgaacaaaagaaaaaattctccgaattaacaaattaa

SEQ ID NO: 162 - DNA, 144 bp, S.epidermidis
gaagggtataataaaaggcttaaatataaattaaaactgattaggaaacaatatatagctcctaaagttttcaacagaaagacatggaacaataaattgataaatcaaagttcaaaggagagaaatttatgtcagaagaaatga

SEQ ID NO: 163 - DNA, 966 bp, S.epidermidis
atgttaaataatgaatataagaattcatcaatgaagatcttttcgcttaaaggaaatgaacctttggcacaagaagtagcagatcatgtagggattgaattaggtaaatgttctgtaaaacgttttagtgatggagaaattcaaataaatattgaagaaagcattcgtggttgtgatgtttttattgttcaaccaacttcatacccagtcaatcttcatttaatggagttacttattatgattgatgcgtgtaaacgcgcgtcagcagcaaatattaacatcgtagtaccatactatggttacgctcgacaagatagaaaagcccgtagtcgtgaacctattactgctaaattagtagctaatttaatcgaaacagcaggtgccaatcgtatgatcgcattagacttacatgcacctcagatccaaggattcttcgatattcctattgatcatttaatgggtgttcctatccttgcacaacactttgagaatgatcctgatattaatccagaagaatgtgtagttgtgtcccctgaccatggtggggtaacacgagctcgtaaattagccgacattttaaaaactccaattgcaattatcgacaaaagacgtccgaaaccgaatgtggcagaagttatgaacattgtgggtgatattgaaggacgtactgcaattattatagatgacattattgatactgcaggaacaattactttagctgctcaagctttaaaagataaaggtgctaaagaagtctatgcttgctgtacacatccagtgctttctgggccagcgaaagaacgaattgaaaactctgcaatcaagcaacttatagtaacaaactcaattcaattagaagagaatagaaaacctaataatacaaaagaactttctgtagctggtttaattgcgaaagcaattattcgtgtatacgaaagagaatcagtaagtgtattatttgactaa

SEQ ID NO: 164 - DNA, 357 bp, S.epidermidis
tataatgataaaaagaggtgtataaaaatgaaaatgattatagcgatcgttcaagatcaagatagtcaagagctttcagaccaactcgtaaaaaacaatttcagagctacaaagttagcaactactggtggatttttaagagcaggcaatacaactttcttatgtggggttaaggatgaccgtgtcgacgaggttctatctgtcattgataatacttgtggtaatagagaccaacttgtttcaccaataacaccaatgggtggtagtgcagattcatatattccttatccagttgaagttgaagtaggtggcgcgacagtatttgtaatgccgattgaagcatttcatcaattctag

SEQ ID NO: 165 - DNA, 882 bp, S.epidermidis
atgaatatcaaaacagatggttggtctaaaaaagcacatattgttgtggctgtctcaacaggcattgatagtatgagtttattatatagcttattaaacgactatcaacatacatatcgtaaattaacatgtgttcatgttaaccacggattgcgtgaacagtcatatgaagaagaagcgtttttgagagagtattgccatcaacatcatattgacatttatataaagcgtttagacttaagtgatattgtagcagacggtaatagtattcaacaagaagcgcgtcaacgtcgttatgaatggtttggagatatcatagctcaattaagagcagatgtattgttaacagctcatcatcttgatgatcaacttgaaacgattatatatcgtttgtttacagggagatcaacacgtaattcattaggtatgacatacgagtcgtattttaatcaatacaaagtgtatcgtcctatgttaaatttaaaaaaaactgaaatattagcgtatcagtatgcgaaccaaattccatactatgaggacatgtctaatcaagatagaaaatatgttagaaatgacattagacaacgcatcatacctgcaattaacgagaacccgcatttaaacgcgcatcagctactcaaacttaaggattggcatgatattgaattgcaatcgttaaaagaacaagctgaaacgttcatcaataacgaagtttcaaaaagtaaatatttaacctattccttttctagaactgcttttaatgaattgaatgtgaatatcaaaagcgtagttatggatttgttattccaaaaattagattgtcatttagcaatgccacaacatgcttatgacgagtgttttgaacagattagaaatgaataa

SEQ ID NO: 166 - DNA, 132 bp, S.epidermidis; identical to SEQ ID NO: 66

SEQ ID NO: 167 - DNA, 408 bp, S.epidermidis
caagcaatgaataaaaaagtagaacatatcggtaaccaatatacgtcacaagaaaataagaaaaaacaacgacaaaaaatgaaaatgcgtgttgtacgtagacgtattgctttattcggaggtattcttttagcgattatcctcattctacttgtattgcttgtcattcaaagacataataacgatcaagatgcagttgaaaggaaagagaaagaaactgagtttcaaaaacaacaagatgaagaaattgctttaaaagagaaacttaataatttaaatgataaagactatatcgagaaaatagcgagagacgattattatttaagtaataaaggtgaagtcatttttagattacctgatgataaaaaatcctctcagtcaaagacttcaaacgaaaaaggcaattag

SEQ ID NO: 168 - DNA, 378 bp, S.epidermidis
aggagaatgaatatgaacgacatcatctttcttaatggaatgcgtttttatggttatcatggagtattagctgcagaaaatgatattggacaaatttttgttgttgatattactttaaaggttgatcttagttatgcaggtcaatcagatgatgtaaaagatactgtaaattatggagaggtttataaagatgtaaagtctattgttgaagggccacgttcatgcttaattgagcatctggctgaacgtattgcaaaacatataaattcacactataatcgtgtaatggaaacgaaagttagaatcactaaagaaaacccacctattcctggtcattacgatggtgttgggattgaaatagtgagggagaatgactaa

SEQ ID NO: 169 - DNA, 1881 bp, S.epidermidis
agtcaagtgaaatcaatgattgcaaattacattagcgaagataatcgttttcaagaattagatgaagtcttcggccaagagaatattttagttacgggattatccccgtcagcgaaggcaacaattattgctgaaaaatatttaaaagatcataaacaaatgctactcgtaactaataatttataccaagcagataaaatcgaaactgacattttacaatatgtagatgactcagaagtttataaatatcctgttcaagatataatgactgaagagttttctactcaaagtccacaattgatgagtgagcgtgttagaacgttgactgcgttagcccaaggcgaaaaagggttatttattgtgcctttaaacggctttaaaaaatggctaacaccggttgatttatggaaagatcatcaaatgacgcttaaagtaggtcaggatattgatgttgatgcgttcttaaataaattagttaatatgggttatcgtcgagaaagtgtagtgtcacatattggtgagttttcattgcgtggtggaatcatagatatatatccgttgataggaacacctgtgagaatagagctatttgatactgaagttgattccatcagagactttgatgtagaaacacaacgttctaacgataatataaatcaagttgaaatcacaacagctagtgactacattattactgatgaagtgatacaacacttacaaaatgaacttaaaaaagcatatgaatatacacgccctaaaattgaaaagtccgtacgtaatgatttaaaagagacatatgaaagttttaagttgtttgaatctacctttttcgatcatcaattgttacgacgtcttgtttcatttatgtatgaaaaaccatcaacccttattgactattttcaaaaaaacgcgattattgtagttgatgagtttaatcgtattaaggaaacagaagaaacacttacaacagaagttgaagattttatgagtaacttaattgagagtggaaatggatttatcggacaaggatttatgaagtatgaaagttttgacgcattattagagcaacatgccgttgcatatttcacattatttacatcttcgatgcaagtaccattacaacatattattaagttctcttgtaaaccagttcaacaattttatggtcaatatgacattatgcgctcggaatttcaaagatacgtgcatcaagattacactgtcgtagttcttgttgaaactgaaacaaaagttgaacgtattcaatcaatgcttaatgaaatgcatattccaacagtatcaaatattcacgaagatattgatggtggtcaagttgtagtgacggaaggtagtctttctgaaggctttgaattaccttatatgcagttggtagtcatcacagaaagagaattatttaaaacaagacaaaagaaacaacgtaaacgaacaaaaacgatttctaatgctgaaaaaataaaatcatatcaagacctaaatgtgggcgattatatagtgcatgtgcatcatggtgtcggacgatacttaggtgtcgaaacactagaagttggagatacacatcgcgactatattaaattgcaatataaaggaactgatcaattattcgttccagttgatcaaatggatcaagttcaaaagtatgtggcttctgaagataagtcgcctagattaaataaattaggcgggacagaatggaaaaaaacaaaggcgaaagttcaacaaagtgttgaagatatagctgatgaattaattgatttgtataaagcacgtgaaatgtctgtaggttatcaatacgtcctagatactgcagagcaatcagcatttgagcatgattttccatatgaattaacacccgatcaatag

SEQ ID NO: 170 - DNA, 138 bp, S.epidermidis
cacattgcgaaaagctttctgcatgcgtcatttcctcctacttccaataataaaactaacaaaaattgtaacacaacactttatattcaggctagtatttcaactttagtattgcatctacaattttgtcgattttaa

SEQ ID NO: 171 - DNA, 2106 bp, S.epidermidis
cgcatgcagaaagcttttcgcaatgtgctagttatcgcaattattggcgttattatatttggcctcttttcatttttaaatggaaatgggaatatgccaaaacaacttacatatactcagtttgttaataagttgaataaaggcgatttaaaaactttagaaattcaaccagagcaaaacgtatatatggtaagtggtaaaacaaaaaaagatgaagattactcatcgacaattttatataacaatgaaaaagatttacaaaaaatcacagatacagctaagaaacaagataatcttaaatttacagttaaagaagaagaaaaacaaagtgtattcgttagtattttaacgacactgattcctgtattaatcattgcattattatttattttcttccttagccaagcccaaggtggcggcggcggtggtcgtatgatgaactttggaaaatccaaagctaagatgtacgacagtaataaacgtcgagttcgtttctcagatgtagcaggagctgacgaagagaaacaagaattaatagaaattgtagatttcttaaaagataacaagaaatttaaacaaatgggttcaagaattccaaaaggtgtcttacttgttgggcctccaggtacaggtaaaacattattagcacgtgcggttgcaggtgaagctggtgcaccattcttctcaattagtggatctgacttcgttgagatgtttgttggtgttggtgcgagtcgtgttcgtgatttatttgaaaatgctaagaaaaatgccccatgtatcatttttattgatgaaattgatgctgttggacgtcaacgtggtgcaggtgtaggtggcggtcatgatgagcgtgaacaaacattaaaccaactattagttgagatggatggttttggagaaaatgaaggtattattatgattgcggctacaaaccgcccagatatcttagaccctgcattgttacgtcctggtcgttttgatagacaaattcaagttggacgaccagatgttaaaggtcgtgaagcaattcttcatgtgcatgcgaaaaataaacctcttgatgaaacagtagatttaaaagctatttctcaaagaacgccaggtttttctggtgcagacttagaaaacttgctaaatgaggcatctttaattgcagcacgtgagggtaaaaataaaattgatatgcgcgatattgaagaagcaactgaccgtgttattgcaggtccagctaaaaaatctcgtgtaatttctgaaaaagaacgtaatattgtagcgcatcacgaagcaggtcatactatcatcggtatggtgcttgatgaagctgaaattgtacacaaggtaacaattgtccctcgtggacaagcaggcggttatgcaatgatgttaccaaaacaagatcgcttcttaatgacagaaccagaattactcgacaaaatatgtggtttattaggtggacgagtatctgaggatattaactttggtgaagtatcaacaggtgcttcgaatgactttgaacgagcaacgcaaattgcaagatctatggttacagaatatggtatgagtaagaaattaggaccattacaattctcaagcaatagtggtggacaagtattccttggtaaagatatgcaaggtgagccgaattattctggtcaaattgcttatgaaattgacaaagaagttcaacgaattgttaaagagcaatatgaacgttgtaaacaaatcttgttagaacatgaagaacaacttaagttaattgctaaaacactactttcagaagaaacattagttgcagaacaaattcaatcattattctatgatggtgttttaccagaagtagattatgactctgcaaaagttgtgaaaaatgaaaatagtgattatagtgatggaaagtatggaaaatcatacaacgacattcgtaaagaacagttagaagatgacgataaagaagatgatgacaaccatgaaaaagatgaagtaaaccaagacaacacagacagagaagctgataatacttcacatacgaatgaaccaggtcatcaacaatctccgaacatcgataaaccatacaatcctaacgatccaaatcatagacaatag

SEQ ID NO: 172 - DNA, 729 bp, S.epidermidis
tgggtaagtgaggagcaggttagacgtatccaatgtctaaacctcgaaattcgaaaggtggaaatacgaatggcttcattaaagtcaatcattcgtcaaggtaaacaaacacgttctgacctaaaacaattaagaaactcaggtaaagtacctgcagttgtatatggttacggtacaaaaaatacttcagttaaagttgatgaagttgaatttatcaaagtaatccgtgaagtaggacgtaatggtgttattgatttaggcgtaggttctaaaacaattaaagtaatggtttcagattatcaatttgatccattaaaaaaccaaatcactcatattgactttttagcaatcaacatgagtgaagaacgtactgttgaagtacaagttcaattagttggtgaagctgtaggtgctaaagaaggcggcgtagttgaacaaccattattcaacttagaagttacagctacacctgaaaatattcctgaaactatcgaagtagatatcagtgaattacaagttaatgacagcttagcagtttctgatattaaaatctctggtgatttcacaatcgaaaataatccagaagattctatcgtaacagtagttcctccaacagatgaaccttctgaagaagaagttgaagctatggaaggcgaatcagcaactgaagaaccagaagttgttggtgaagacaaagaagacgatgaagaagaaaataaagaagactaa

SEQ ID NO: 173 - DNA, 144 bp, S.epidermidis
caatcaatagaatttttgatgtccaaaattgattttggcatattgccccacctcactacacattacattttaccatatttgagtcgttttcgtcaaataaaatttaaattttatcaatgtgaagggcctttgtcaacattttaa

SEQ ID NO: 174 - DNA, 855 bp, S.epidermidis
tacaggagggataacatgacaactttatatttagtaggaacaccaattggaaatcttggtgatattacatttcgagctatagaaacattaaaaaaagttgatgtgattgcatgtgaagatacacgtgtaacacggaaattgtgtaatcattatgaaatacaaacacctctaaagtcgtatcatgaacataataaagaacaacaaactgactatttaatcaagcagttacaaactggcttaaatatagcgttagtatcagatgctgggttgccattaattagtgatccaggatatgaattggttgtcgaagcacgtaaaaataatataaatatagaaacagtaccaggtcctaatgctgggttgactgcacttatgtcaagtggattaccatctttcacatacacatttttaggttttttgccaagaaaagaaaaagaaaaaattgaagtgcttgaggatagaatgtttcaaaatagtactttaatactttatgaatcgccttatagggttactgatactttgaaagcaatagctaaaatagattcacaaagatggattactgttggtagagagctaacgaagaaatttgaacaagttcttacacttacagttgatgatatgttgaaattgattaatcatgacaaattacctcttaaaggtgagtttgtgatactgattgaaggtgcattacctaagagtggtgaatcatggtttgaaagctatacggttaaagaacatgttgattattatattgaaaccaaacatgttaaacctaaaaaagcaattaaatttgtcgctacagatcgacatatgaagacgggtgacatatataatatttatcataatattgattaa

SEQ ID NO: 175 - DNA, 960 bp, S.epidermidis
attgtaaaactaaaaggagtgttttggatggcacaaaaacctgtagattatgttacacaaattattgggaatacacctgtagtcaaattaagaaacgttgttgatgatgatgcagctgatatttatgttaagttagaatatcaaaatccaggtggttcggtaaaagatcgtatcgctttagcgatgattgaaaaagctgagcgtgaagggaaaattaaacctggtgatacaatcgttgagcctacgagtggtaacactggtataggtctagcatttgtatgtgctgccaaggggtacaaagcagtttttacaatgcctgaaacaatgagccaagagcgccgtaacttattaaaagcttatggtgctgaactagtattaacaccaggatctgaagctatgaaaggtgcaataaaaaaagctaaagaattaaaagaagagcacggctattttgaaccacaacaattcgaaaatccagcaaatcctgaaattcatgaacttacaactggaccagaattagttgaacaatttgaaggtcgacaaattgatgcatttttagctggtgtaggaactggtggtacgttatctggtgttggtaaagtattgaagaaagaatatccaaatgtggaaatagtagctattgaacctgaagcttctccagtattaagcggtggtgaaccaggccctcataaattacaaggattgggagcaggtttcgtacctgatactttaaatacagaagtttatgacagcatcatcaaagtaggtaatgatactgctatggatatggcacgtcgtgttgctagagaagaaggtatattagcaggtatttcatctggtgctgcaatatatgctgctattcaaaaagcaaaagaattaggtaaaggtaaaacagttgtaacagtattaccaagtaatggggaacgttacttatcaacaccattatattcatttgataattaa

SEQ ID NO: 176 - DNA, 123 bp, S.epidermidis
aactatttttgtataaaaaaaagagacctttcggtctcgattaggctcatcgcatcttatacgatatttgcctggcaacgtcctactctagcggaacgtcagtccgactaccatcggcgctaa

SEQ ID NO: 177 - DNA, 165 bp, S.epidermidis
aaaacgttttgcgacgcaaaatcttacttactatctagttttgaatgtataatcattcatttgtctggtgacaatggcaaggaggtcacacctgttcccatgccgaacacagaagttaagctccttagcgccgatggtagtcggactgacgttccgctagagtag

SEQ ID NO: 178 - DNA, 351 bp, S.epidermidis
cctttgaatcgaaacgaattattcgaaagacttatgaaattagaacatcacgttgaacaacttacaaccgacatgtcagaacttaaagatttaacagtcgaacttgttgaggagaatgttgctttgcaagttgaaaatgaaaatttaaaacgattgatgaacaaaactgaagaatcggttgaaactcacttagataaagataattataagcatgtaaaaacaccatctccaagtaaagataatttagcaatgttatatcgtgaaggttttcatatttgtaagggtgaattattcgggaaacatcgtcatggtgaagattgcttattatgccttaatgtgttgagtgattaa

SEQ ID NO: 179 - DNA, 189 bp, S.epidermidis
caactaaagcgaatcacttttggatattacaaaaattggacttattcaaatggttattcgtttaatttaaatgaattgtgtattaataataaacgtaagttgcataatctcatgaaaatgggaataaataaagactacaataacaaagagtctgaacatatattcaatgtccagactcaccttaaataa

SEQ ID NO: 180 - DNA, 867 bp, S.epidermidis
agtttacttagtaagattattaggatagaagggtttgaaaagatgagatataaaagaagcgaacgtattgtatttatgacacaatacttcatgaaccacccaaataagttgatacccctcacttattttgtaaagaaatttaaacaagcaaaatcgtcaattagtgaagacgttcaaatcattaaaaatacgtttcaaaatgaaaaattaggaactattattactacagcaggtgctagcggtggagtaacctataagcctatgatgagtaaatcagaggccacagaggttgttgatgaggtgatagagcaattacaagagaaagaccgtttgctacctggaggatatttatttttatccgatttagttggtaatccttctctattaaataaagtaggtaagttaattgctagtatatatatgaacgaagaacttgatgctgttgttaccatagcgactaaagggatatcacttgcgaatgcagtcgcaaacgtattaaatttacctgtagtggttataagaaaggacaataaagttacagaaggttctacggtttcaatcaattatgtttcaggatcatctagaaaaatagaaacaatggtgttatcgaaacgaactttagctgagaattctaatgtcctcgtagtagacgattttatgagggctggtggctcaattaatggagtaatgaatttaatgaatgagtttaaagcccatgtaaaaggggtatcagtacttgtagaatcaaaagaagtaaaacaaagattaattgaagattatacttccttagtcagattgtcagatgtcgacgagtacaaccaagaatttaaagtggaaccaggcaacagtttgtctaaattttcttaa

SEQ ID NO: 181 - DNA, 333 bp, S.epidermidis
agatatactaggggggctcactacatgaaagtgacagatgtaagacttagaaaaatacaaacagacggcagaatgaaagcactcgtttccattacgctagatgaagcttttgtaattcatgatttacgtgtaattgaaggaaactcaggtcttttcgtcgcaatgccaagtaaacgtacaccagatggtgaattccgtgacatcgcgcatcctatcaattctgatatgagacaagaaatccaagatgcagtgatgaaagtatatgatgaaactgatgaagttattccagacaaaaatgctacttcagataacgaagaatcagacgaagcttaa

SEQ ID NO: 182 - DNA, 798 bp, S.epidermidis
tataatctaaggataggagagataatgatgttaatcgatacgcatgtacatttaaatgatgaacaatatgatgaggatttaaatgaagtgatatctcgtgcgagagaagcaggcgtagatagaatgtgtgtagtaggttttgatacacctactattgaacgtactatggagctaatagataagtatgactttatctatggtattatcggttggcatcctgttgatgcaatagattgtactgatgaaagattggaatggatagaaagtctttctaaacatcctaaaattattggtattggtgagatggggttagattatcattgggataaatcaccttctgatgtacaaaaagaggtatttaaaaagcaaattacattagctaaacgtgttcaattacctattattattcataatcgtgaagcgactcaagattgcatagatattttgattgaagaacatgcagaagaagtgggcggaataatgcatagttttagtgcttcacctgaaattgctgatgtcgtgattaataaattgaacttctatgtttcgcttggaggacccgtcactttcaaaaatgcaaaacaaccaaaagaagttgctaaacacgtaccaatggatcgtttgttatgcgagacagatgccccgtatctatccccgcacccttatagaggtaaacgtaatgaaccagaacgtgttactttagtagcacaacaaattgcagatttgcgtggtatgacttatgaagaggtctgtcgccaaacaaccgaaaatgctgaacgtttattcaatttgaattaa

SEQ ID NO: 183 - DNA, 285 bp, S.epidermidis
tgtgtagtgaggtggggcaatatgccaaaatcaattttggacatcaaaaattctattgattgtcatttaggaaatcgtattgtacttaaagccaatggtggacgtaaaaagacaattgaacgatcaggggttttaaaagaaacatatccatctgtttttattgtcgaattagatcaagataaacacaactttgaacgcgtatcttatacatacactgatgtgcttacagaaaatgtacaagtttcatttgaagaagataatcatcaagaagcagttgcacactaa

SEQ ID NO: 184 - DNA, 1608 bp, S.epidermidis
catggaaagagcaagactatggaccgtcttctttgtggtgatgtgggatatggtaaaactgaagtggctgtccgcgcagcgtttaaagctgtcatggatggtaagcaagttgcgtttttagtaccaacaacgattcttgcacaacaacactacgaaacactacttgaacgtatgcaagattttccggtcgaaattcaattggtaagtcgattccgcacagctaaagaaataagggaaactaaagaagggctcaaatcaggatatgttgacattgtcgtaggtacacataaattattaggtaaagatattcaatataaagatttgggattgcttattgttgatgaagaacaacgttttggagtgcgacataaagaacgcattaaaactttgaaaaaaaacgttgatgtactgacgcttactgcaacaccaataccaagaacattgcatatgagtatgttaggtgtacgtgacttatcagtgattgaaacaccacctgaaaatcgttttcctgtacaaacttatgtcttagaacagaatacgaactttattaaagaggcattagagcgtgaattatctcgcgatggacaagtattttatttgtataacaaagtgcagtctatttatgaaaaaagagaacaacttcaaatgttaatgcctgacgctaacattgctgtagcacatggccaaatgactgaacgtgatttagaggaaacaatgttaagctttattaatcacgagtacgatattttagtaacgactacaattattgaaacaggtgtagatgtaccaaatgctaatactttaatcatagaagaggctgatcgttttggtttaagccagctataccaattaagaggacgtgtaggacgttcaagtagaattggttacgcttatttcttacatccagctaacaaagtgttaaatgagactgctgaagagcgattgcaagctattaaggagtttaccgaactaggttcaggttttaaaatcgctatgcgagatttaaatattcgtggtgcaggcaatttactcggtaagcaacaacatggctttattgattcggttggtttcgatttatactctcaaatgttagaagaagcagtaaacgaaaaacgtggcattaaagaaagatcgccggatgcaccagatattgaagttgaattgcacttagatgcttatttaccagctgaatatatacaaagtgaacaggctaaaattgagatttataaaaaacttcgaaaagtagaaacagaagaacaacttttcgatgtcaaagatgaattaatagatcgttttaatgattatccaattgaagtcgaacgattattagacattgttgaaatcaaagtccacgctctacatgcgggtgtcgaattgataaaagacaaaggcaaatctatacaaatcattttatcacctaaagcgactgaagatattaatggagaagaattgtttaaacagacgcaacctcttggtagagcaatgaaagttggcgtgcaaaataatgcaatgaatgtaacgctaacaaaatcaaaacaatggttagatagtttgaaattcttagttagatgtattgaagaaagtatggcgattaaagatgaagactaa

SEQ ID NO: 185 - DNA, 141 bp, S.epidermidis
aataagcctgggacattgatgatatattgtctcaggcattttaatgtattgttagtcaatggcaaaattagtaatgattgtgtaatggattacttgaaatttataccatattgttcgggagggactgcgacttcttattga

SEQ ID NO: 186 - DNA, 972 bp, S.epidermidis
gtagtctttttacataatgaatatcataaagggagtaagtcgcttatggatgaacaacaacagttagctaacgcatatcattctaacaaattgtcacatgcatatttgtttgagggtgatgatgcacaaacgatgaaacgtgtcgcaatccattttactaaattaattctttgtaataatagtaatcaatgcgaactgaaagttgatacttttaatcatcctgacttttcatatgtgtcttctgatgaaaatacaattaaaaaagaacaaattgaacaacttgttcatcatatgaaccaactacctattgagggtcaatataaagtatatattattgaggattttgaaaaattaactgttcaaggggaaaatagtatactaaaatttttagaagagccccctgataatacaattgcgatacttttatcaacgaaaccggaacaaatattagacactatacattcaagatgtcagcatgtatattttaagcctattgataagcggcagtttatagagcgtttagtagagatgtcaatagcaagaccggtagcagaaatgctaagtacctatacaactcaaatagaagcagcatcgtcgttaaatgaggaatttgatttagttactttaagaaaatcaatcatcagatggtgtcaattaatattatctaataaagctatggctcttataggtgtcattgagttattaaaacaagctaagaatcgtaaattacaattacttactttatcagccgtcaatggctttttcgaagatataatgcatgcaaagatagaaatggataattattatacatttagtgatttaactgaagaaattgaaaattatgcaaatcaattaacttttaatcaattaatcctcatgtatgatcagattactgaagcgcataaaaagttaaatcaaaatgttaatccaacacttgtttttgaacaaatagtaataaaaggtgtgatttaa

SEQ ID NO: 187 - DNA, 261 bp, S.epidermidis
aaggtgtttattatggataaacattttgtttatattgttaaatgtaatgacggaagtttatatacaggctatgctaaagatgtaaatgcacgcgtaataaagcataataacggtaagggtgctaaatatacaaaaataagacggccggtagagttagtttatcaagaaacatatacaacgaaatcggaagcattgaaacgtgaatatgaaattaaaacatatactagacaacaaaagttaaaaatgatacaggagggataa

SEQ ID NO: 188 - DNA, 186 bp, S.epidermidis
ttggttattatacatctcttattggctaatatgaaatctattgctcatacatgtttattgagtattataaccatgagagatgataacaatatttttaccaaaagtttaaaaatgtattggtataaactatacataaaaaagtcccttttcactcaattcatacgtgagcaaaaagagacttactaa

SEQ ID NO: 189 - DNA, 846 bp, S.epidermidis
gagtatattattgaaaaaggtgaaattatgattaaaacaaaaataatggggatattaaatgtgacacctgactcattttctgacggaggacagtaccactcagttgatcaagctgtgaagcgtgctaaagagatgatagatgaaggtgtagacatcatagacgttggaggtgtctcaacacgaccaggtcataaagaagtatcgcataaagaagtatcgcttaaagaagaaatgaatcgtgtattgcctgtggttgagtctatcgttaaatatgatgtgcaaatttcggttgatacatttcgaagtgaagttgcggaagcttgtcttaaacttggtgtttcaatgattaatgatcagtgggcaggcctatttgattcgaatatgtttaatgtggtatctcaatacggtgctgaaattgtacttatgcataatggtgacggtcatagagataaacctgttgttgaagagatgcttgtatcattacttgcgcaagcgaataaggctgaactagccggtataccacataataaaatctggttagatcctggaataggttttgctaaaacacgagaagaagaaaatgaagtaatggcaagattagatgaattagtagcgaccgaatatccagttttacttggaacaagtcgaaaaagatacattaaagaaatgatgaatcaagattcttctccttcagatagagatgaggcaactgcagctacaacggcttatggtataatgaaaggcgttcgtggggttcgagttcataatgtattattaaatacgcgactagcccaaagtatggattttctaaaggagaatgaatatgaacgacatcatctttcttaa

SEQ ID NO: 190 - DNA, 144 bp, S.epidermidis
acgatcgctataatcattttcatttttatacacctctttttatcattatatcataattattttaaatatttgatgatagattggtatgtttcttcaacaactttatccaaactatggttagcattgactttaataaaccgatga

SEQ ID NO: 191 - DNA, 606 bp, S.epidermidis
agatacataatattaatagtggaggtaacaataatgaaatgcattgtcggtcttggcaacattggtaaacgttttgaattaacaagacataatattggtttcgaagttgtcgatgatattctagaacgccaccaatttactttagacaaacaaaaatttaaaggtgcatatactattgaacgtttaaacggcgaaaaagtattatttattgagccaatgaccatgatgaacttatctggtcaagctgtagcccctttaatggattattataatgtcgatgttgaagatttgatcgttttatatgatgatttagatttagaacaaggacaagtgcgtctgcgccaaaaggggagtgcaggcggtcataatggtatgaaatcgataattaaaatgcttggtacagatcaatttaaacgtattcgaattggtgttggccgtccaacaaatgggatgtctgttccggactatgttttacaaaaattttcaaaagaagaaatgatcattatggaaaaggtaattgaacattctgcaagagctgtagaatcttttattgaaagttctcgttttgatcatgttatgaatgaatttaatggtgaagtcaagtga

SEQ ID NO: 192 - DNA, 405 bp, S.epidermidis
aaaatgtcaatcgaagtaggaaacaagcttaaaggtaaaattacaggtatcaaaaagtttggtgcattcgtagaattacctgaaggaaaaagtggtttagttcatatcagtgaagttgccgacaattatgttgaaaatgttgaagaccacttatcagtaggtgacgaagtagaagttaaagttttatcaatcgcggatgatggtaaaattagtttatcaataaaaaaagctaaagaccgccctcgtaagcctcgtcacagtaaagctaatcacggtaaaccagttcaaaaaactgaagactttgagaaaaaattaagtaacttcttaaaagatagtgaagataaattaacgtcaattaaacgtcaaaccgaatcacgcagaggcggtaaaagttctagacgttaa

SEQ ID NO: 193 - DNA, 549 bp, S.epidermidis
tttatgaaaataaacgaatttattgttgttgaaggtaaagatgatactgaacgagtaaaaagtgctgtagattgtgatactattgaaacaaacggtagtgcaattgatacatatactttagaagtgatacaacacgcgcagcaaactagaggtgtgattgtactgacagatccagatttcccaggtgataaaattagaaatactatacgggaacatgtttctggtgttaaacacgcatatgtagatagagaaaaggccaaaagtaaaagaggtaaaataggaatagaacatgcaaacattaaagatattcaagaagcattaatgcatgtaagttcaccacttgaagaagctaaagaaactattgataaaagtgtactcattgatttgggattaattatcggtaaagatgcaagataccgtagaaatatcttaggtcgaaaattacacatcggtcactctaatggaaagcaattattaaagaaacttaatgcttttggctatactgaagacgatgtcagaaaagcgctatttgaagaagaggagaattaa

SEQ ID NO: 194 - DNA, 177 bp, S.epidermidis
ctcaactggatagagcgtttgactacggatcaagaggttatgggttcgactcctatcgggcgcgccattttatgtatcgatttaatttacatacgggaagtagctcagcttggtagagcacttggtttgggaccaaggggtcgcaggttcgaatcctgtcttcccgacttcttttga

SEQ ID NO: 195 - DNA, 1281 bp, S.epidermidis
tgtattaggatacaaagaaataaagcacttaccttttggagacaaattatatcaaatgaagagaggaagacggtcatgacacatacaattacaatagttggtttaggtaattatggcattgatgagttacctttaggtatctatcgttttttagaaaaagagtctaaagtatatgctagaaccttaaatcatcctgtcatcaatacgctaaagaaagaaattgaattcgagagtttcgatagtatttatgaagcacatgaccgttttgaagatgtttatgaagcgattgtcacatcactaatagaattggcacaatctgaagatattgtttatgcagttcctggtcatcctagagttgctgaaactacgactgtaaaattattagagtatagtcattttaataaggatatctctgtgaaggtacttggaggaaaaagttttattgatgacatttttgaagcggttgatgtagaccccaatgatggttttacactgcttgatggtacgtcattaaaagaatcggccttaaatgttcgtacaaatacagtaattactcaagtttatagcgtaatgatagctgccgatttaaaacttactttaatggaaagatatcctgatgattttaatgtgaaaataattactggttctcatagtgatggagctcacgtaattgaatgcccactttatgaaattgatcgctacgacgattattttaataatcttacaagtttatttattccaaaaatcaatgaggatacattactttatcaagattttgattacgcagttcaaactattgatttactcgttgataatgaaaaagggtgtccgtgggataaagtacaaactcacgactcattaaaacggtatcttttagaagaaacgtttgaattatttgaagccattgataatgaagatgattggcatatgatagaggaattaggagatatacttttacaagtattattacattctagtataggtaaaaaagaaggatatattgatatcaaagaaattatagaaagtctcaacaccaagatgattcatagacatccacatatctttggtaatgcgcatgtaacttcgcaagaggatttaaaagacatttggtcacgtgctaaagaaaaagaaggtaaagtgcctcgtgttaaatttgagaaagtatttgcagaccacttcttgaaattgtatgataaaacaaaaaataggcaatttgacgaagatatctcaaacaatttttacaacaaggagagaaaattcatgagattagataaatattaa

SEQ ID NO: 196 - DNA, 543 bp, S.epidermidis
gaaagagggatgactttgattattagggcattggagaagacagatttatcatttatacatcatttgaataatgagtattccattatgtcgtattggtttgaagagccttatcaatcattaagcgaattagaaaatttatatacaaagcatattttagatgaaacagagcgacgtttcattgttgaagagggatcaacatctgtaggcgtggtagagttattagaaattaactttatacatagaacttgtgaagtgttaattattatcgatccgcagtatgcaaataatgggtacgcgaaaaaagcctttaaaatggctattgactatgcttttttagtattaaatatgaataaggtatacttatatgtggatattaagaatgagaaagcagtacatatctatcaaagtaataatttcgaaatagaaggaacgttaaaggaacacttctatacaaggggagaatatagagattgctatgtaatgggcttgttaaaaaggaattgggttaataagaatgatgatgatttgtctcatataagatga

SEQ ID NO: 197 - DNA, 183 bp, S.epidermidis
tatttcaactttagtattgcatctacaattttgtcgattttaaaatgcattattctttgtttactatctgttaacattaattatcttaatagttttaatcaattcataacatttttgaattgttactttgagtctacactaaatctacgcacagttcattatactaacatacttattaattaa

SEQ ID NO: 198 - DNA, 900 bp, S.epidermidis
aggctttatgttaaaatcattttaataacaattcaaagcgagggcggaaaaatgatatatgaaactgcgccagctaagataaattttacgctcgacaccctttttaaaagagatgatggttatcatgaaattgaaatggtgatgacaacagttgatttaaatgatcgattatcttttgaaaagcgaactgataataaaattgttgtcgatattgagcataattatgttcctaacgataataaaaaccttgcgtataaagcagctgatttaatgtttgagagatttaatattaatgaaggtgtgacaatttcaatcgataaagatataccagtttcagctggactcgcaggtggttctgcggatgctgccgctacaatgagaggattgaatcgattgtttggtttaggtcaatctttagacgctttagctgcattaggcatacaaataggcacagacatacctttttgtatttataaccaaactgctgtgtgtacggggcgtggcgagcaagtaactttcctaaaaagaccaccttctgcatgggttgttttagctaagcctaacatcggaatttcatcacctgatgtatttaaagcactagatttaactgaagaacatatagttcataatgaaaagtgtaagcaagctttagagaacaatgattatcatttattatgcaatagtctttctaaccggttagagcctgtttctatggctatgcatcctgacattaaaaagattaaagataacatgctacaatgtggtgctgatggtgctttgatgagtggaagcggtcctactgtttacgggctagctcaaaaagaaagacaagctaaaaatatttataatgcagtgaatggttgttgtaatgaagtttacttagtaagattattaggatag

SEQ ID NO: 199 - DNA, 402 bp, S.epidermidis
aaaaggagtgtcaaattcatcatgaaaataatcaactcagataaggtacccgaagcactaggcccatattcgcatgcaactgttataaacggttttgtctttacatcaggtcaaattccactcacacttgatggaacaattgttagcgatgatgttcaagaacaaactaagcaagttttagaaaatttaactgtggtattaaaagaagcaggttctgatttgaattctgttgttaaagcgacaatctatatttctgatatgaatgattttcaacaaattaatcaaatctatggaaactatttcgtcgaacaccaaccagctcgtagttgtgttgaagtgtcacggttgcctaaagacgtaaaggtagaaattgaattgataggtaaagtgaaggaattataa

SEQ ID NO: 200 - DNA, 1983 bp, S.epidermidis
ggaggaccagtgatggctaaagatacattttatataacaaccccaatatactatccgagcgggaacctacacatcggtcatgcatactctacagtcgcaggcgacgtgatagctcgctataaaagaatgcaaggctatgatgttcgttatttaactggcactgatgagcacggtcaaaaaatccaagaaaaagctcaaaaagctggcaaaacagaactagaatacttagatgaaatgatttcaggtattaaaaacttatggagtaaacttgagatttctaatgatgattttattcgaactacagaagagcgtcataagcaagtcgttgagaaagtgtttgagcgattattaaaacaaggtgacatttatttaggtgaatacgaaggttggtattctgttcctgatgaaacatattatacagagtcacaacttgttgaccctgtttatgaaaacggcaaaattgtaggtggtaaaagtcctgattctggtcacgaagtcgaacttgtaaaagaagaaagctatttcttcaacattaataaatatacagaccgcttattagaattttacgatgaaaatccagactttatacaaccaccatctagaaaaaatgaaatgattaataactttatcaaaccaggtttagaagatttagcagtatcacgtacatcattcgattggggtgtacgtgtaccatctaatcctaaacatgttgtatacgtgtggattgatgcacttgttaattatatttcttcattaggttatctatctgatgatgaaacattatttaataaatattggccagcagacatacacttgatggctaaagaaattgtacgtttccactctattatatggccaatattgttaatggcgttggatttaccacttcctaaaaaagtttttgcacacggttggattttaatgaaagatggtaaaatgagtaaatctaaaggtaatgtcgtagatcctaatgtattaattgatcgttatggtcttgatgcgacacgttattacttaatgcgtgaattaccgtttggttctgatggcgtatttacaccggaagcctttgttgaaagaacaaattacgatcttgcgaatgatttaggtaatctagtgaatcgtactatctctatgataaacaaatatttccacggcgaattacctgcataccaaggtccaaaacatgaattggatgaaaaaatggaagcgatggcgcttgaaactgttaaatcattcaatgataatatggaaagtttacaattttctgttgctttatcaacagtatggaaatttattagtcgtacaaacaaatatattgatgaaactcaaccttgggttcttgcaaaagatgaaaatcaacgtgagatgcttggtaatgtaatggcacatcttgtcgagaacattcgtttcgctacaatcttattacaaccattcttgacgcatgcacctagagagatatttaagcaacttaatattaacaatccggatttacatcaattagatagtctgcaacaatatggtatgttgtcagaggcaattactgtaactgaaaagccaacaccaattttcccaagattagacactgaagcagaaattgcttatatcaaagaatcaatgcaaccacctaaatcaataaaacagtctgatgaacccggtaaagagcaaattgatatcaaagattttgataaagttgaaatcaaagcagcaaccattattgatgcggaaaatgtaaaaaaatcggagaaactattaaaaataaaagttgaattagataatgaacaacgtcaaatagtatctggtatagctaagttttatcgtccggaagacattattggtaaaaaagttgcagttgttactaatttaaaaccagctaaattgatgggacaaaaatccgaaggtatgattttgtcagctgaaaaagatggcgtacttaccttgataagcttgcctagcgcaattccaaatggtgcagtaattaaatag

SEQ ID NO: 201 - DNA, 150 bp, S.epidermidis
atattaaaagtgtcacgattagttaaacgacgtacattagctaaagaaattagcgaacaaggtcgagtgacttcaatggaaatgtggcaaaagcaggtacagatatcaaagaaaacgatgaactcattattcgttttggacaaaaattag

SEQ ID NO: 202 - DNA, 159 bp, S.epidermidis
ctcagcttggtagagcacttggtttgggaccaaggggtcgcaggttcgaatcctgtcttcccgacttcttttgatattgggggcttagctcagctgggagagcgcctgctttgcacgcaggaggtcagcggttcgatcccgctagtctccaccatttaa

SEQ ID NO: 203 - DNA, 750 bp, S.epidermidis
catcctttttttaggagtaaagatatgttagaagataatgaacgcgttgaccatttaataaaagaaggatatgagattatacaaaatgatgaagtattctctttttctactgatgccctattgttagggtatttaaccgaagttcgcaaaaatgataaagttatggatttatgctccggcaatggtgttattccattattattagctgctaaatcaactcaacctattgaaggaatagaaatacaagagcaactagtgagtatggcacgtcgcagttttaaattgaatgatttgaacgatagactaactatgcaccatatggatttaaaagatgtatatcaaacatttcaacctgctcaatatacattagtgacttgtaatcctccttattttaaaatgaatcaaaatcatcaacatcaaaaagaagcacataaaatagcacgtcacgaaataatgtgtaatcttaaagattgtattgaagctgcaagacatttacttaaagagggtggtcgttttattatggttcatcgagcggaaaggctaatggatgtcttaaccgaattaagacatggtaaaattgagcctaaagcactgacgttagtgtatagtaaacatgataagcctgcacaaacaattgttgtggaaggaagaaaaggtggtaaccaaggtttagatatacgtaatccattatacatatataatgaggatggatcatatagcgatgagatgaaaggtgtttattatggataa

SEQ ID NO: 204 - DNA, 1575 bp, S.epidermidis
ttagatgtattgaagaaagtatggcgattaaagatgaagactaagagtgagacggcgtttaacggcgtcgttatacttaccttagcattaattattgtgaagatactaagtgccatttatcgcattccgtatcaaaatgttttaggtgatgacggtttatatgcttatcaacaaatatatcctgtcgtagcactaggggttattttatctatgaatgccattccaagtgctgtgactcaagtgataggtgttaatcgatccgatgaagtctatacaagggttatgtttcgattacaatgcataggttttatcgtctttattttgctttttatgtttgcgaatatgattacccgatggatgggcgattctaatttagcacccatgttaaagatggccagttttagttttattttaataggtgtcttaggagtgttaagaggattttatcaatcaaagcaagtaatgaccataccagcaatttcccaggttatagaacaggtaattagagttagtttaatcattgttgcaattattatgttttcaatgaaacattggtctatttatcaagcaggagcattagctatattggcatcttcgattggttttttaggttcaatgttatatttattacttaaaaaaccacttaaacttaagttatgctatcgctttaataatacttccattcaatggaagcagttgtttatttccatatccatatttgcattgagtcaacttatcgttattttatggcaagttgtggatagttttacaataatacgtttattacaacatagcggtattgcttttaaagaagcaattattcaaaaaggcatttatgatcgtggtgcttcatttatacaaatgggtttgattgtaactacgacttttagtttcgttcttatcccattacttactcaagcaattcgtgaacataatcaaattcatatgaatcgttatgcaaatgcatcaattaaaatcacggtagtaataagtacagcagctagtataggattaattaatctgcttccacttatgaatgttgtattctttaaaagtaatcatttaactctaactttgagtatttatatgtttacagtgatatgtgtttcgttaataatgatgaatatctcattattacaagttcaaaccagtattcgtcccattattatgggtgtgataataggaatactgtccaaaattattttaaatgttatattaatacctttttggggtatcgtgggtgcaagtgtgagtacagtcttatcactactactttttgtcataatattgcaagttgcagtcttaaagtactaccgttttaatcgtatatctttatttatcgttaaacttattttaggtatgataattatgagtatagttgttcaaactgtcatgcttgccttaccttcaaaaagtaggatgttaggattactagaacttatagttagctcaattataggcatagtgattataatgttgtatattgttatatttaatgtattaggatacaaagaaataaagcacttaccttttggagacaaattatatcaaatgaagagaggaagacggtcatga

SEQ ID NO: 205 - DNA, 1371 bp, S.epidermidis
gatgaaaaattaaatttagagagagttattaatatgaaaagaccaataattcaaaaattaaatcacttgatagagaaaaaagctatctctatgcatgttcctggacataaaaacatgacaatcggctacttaaataggcttgatttagcaatggatatgacagaaattactggattagatgatatgcattatcctgaaggaattattttagaaagcatggagaattttaggaaacataaaaactatgatgctttcttattagttaacggaacgacttcaggtatattatcggttatccaagcgttttcgacaagaaaaggtaaatatttaattagtagaaatgttcataaatcagtatttcacggtttagacataacacaacaacaagcgacaataactaagacagatgtcagtaagaaaacgaatcaatatgtaaatccaaagataaatcaagataaaaatcaatattataaacttgccatctgtacataccctaattattacggtgaaacttttgatatttctcaatatatcaaacaattacatcacagagggataccgatattagtagatgaagcgcatggtgcacattttggtttagatggatttccagaatcctcaatgaattttaatgctgattacgttgtgcagtcatatcacaaaacactccctgcactaacaatgggatcagttatatatatacataaagatgcaccattaagacaacaagtcatagattatttaacttatttccaaacgtcaagtccttcgtacctcattatgtctagtttagaattagcgaataaattttataaagaatatgattctacattatttgaccaacgaagaaagatgttaattgatttattagtaaatatgggatttacagttatagaaccagaggatcctttaaaattggttgtgagttttgagggtgttgaaggttatgatgtgcaaaaatggtttgaggataaagaaatttatgtagaattagctgatatgtatcaagtgttactcgttctccccctatggcatgaaggagataaatttccttttaagttgttgattgaaaaaattagagaaattaacgtgccaaaaaaatgtacgcgcgacataaaacctcttaattttatgacgggttttagcgaatacaaaactgttcattttcaaaatacgaaagaagtgtctattaaaagggcagaaggtaaagttttagcacaacatatcgttccataccctccaggtataccggtgatgtttaaaggagaagtcgtgacgtctcatatgatagacttattaaataaatatgataaacaaaatattaaagttgaaggtttaaatcataaaaaaatattagttaaggatgaataa

SEQ ID NO: 206 - DNA, 126 bp, S.epidermidis
tctgctacttcttgtgccaaaggttcatttcctttaagcgaaaagatcttcattgatgaattcttatattcattatttaacatttatagtcctccaattatttacttagacatttatattatatag

SEQ ID NO: 207 - DNA, 180 bp, S.epidermidis
tcatgttgctctattccccctgtgctcctaatttttctcccccgccgattgctttcggtctctcccccccattttttgtacttcgcaattcactccccctctgacacccttttcctcttacttaattatattgtaaccggttccaatcatttacacaatactcctattcatttttcttaa

SEQ ID NO: 208 - DNA, 153 bp, S.epidermidis
agtttggcttttttccacttaataattaagaagatggtccgtcatatagctatcaatcagttcaagaattttattaaccttgataagcttttaagtccaaagaaaaatcaattgttaattttggagagatatccaaattatgatttcccctaa

SEQ ID NO: 209 - DNA, 369 bp, S.epidermidis
ataaaggagttttcaataatgaaaaataaaaaaggattaggcataggtcttatcacaattatgattatcgtttgtattgtactagtaatcatgatgttcgtgggtggtaagaaagaatcatactacggtattatgaaagatagcacgactattgataaaatgataaatactaaaaatgaaaaaattgaaaaaaacgtagaattacctaaagatgctaatgtatcagttaaaaaagaagattttgtgatgctctttaaagatgaaaaaactggaaaaattactaaagttaagaaagttaatcacgatgacgtacctcatggtttaatgtcaaaaatccatgatatgggtaatatgaaacacggaatgtag

SEQ ID NO: 210 - DNA, 2112 bp, S.epidermidis
tatacaatgacatgttttttaaatatatataaagaatatcattctccccctgaacgcaatattaatagaattattctgatgttttcacttacaaatgacttaaaaatcactattaatggtgaaacaaaagatttaggtaatcatatagctatcattaatcaatctgacatctattttattaatagtgcttcaaatctcgtattactctctattccagttatttatttttatagtaaagataataaattttttaaatgttattttgacagacatttattacaatcaagcagttttgttaaaacaattattttacaagctattcaacatttaataaaaggagaaaatcaagatgagcaatccatctctaaaataatacaaacgctactaaaagaagcagtcattcgatataagaaaaaatatattcctcaaattgcagttaatcattcagtgtttactgaaggattaacatttattcattcaaaagtatcacagtcactttcactacgagaagtagctcaacattgtaatatatctgaatcttattgttctaacctatttgcaagatatcttaatatgaattttaaagattattttacaagcttaaaagtgattgactctataaaaaggctactttcatctgaggactcaattaacgctatttcagaacaatctggatttagtagtcataccaattttacaaatcaatttaaaaattatttaggttgtagcccaaaacaataccgaacgattatctctaagttagactccttaccttcgataagttttagtgatactgacttttcacaatatattgatttaattaatcaatttgagtttagtgatcatttggctactgaaacgactgaaagagatatcaatgaattttatcctcaagatcagactaaaaactctaaagcgtttatacgttttcaaaatttcaacgaattatttcaatttgtttttaatgaatattacaacattgattttacctccctgccacaagctgtaatttttatcaatgatatcactgatatttcgacgcgagaggtgaactttaatttattaaatcgatgctttgaaaaattattcgaaaaaaatataggtttagccatgagattaacatctacaaatgaatttgaatctatcaaagaaataattttattatttcttaatagccaccaagattataaaatgaacaaaaaaatggttaaatttatgttagtctttgaaactaagaatatgtcagtgaacgatatacatttatgccatttaaaaattaaaaataaaaataaagctatccgttatagtataactgttgaaggattactacaccaaaattcttctattgatcgaacttatgatatgatgaagcgattaaatttcgattactattttatagacattgaaaatctagaaaccaaaaactcattaattaccaaacgtaaatcgtacttacattcgtccacacactttgaaaattataaacaatttatattagattccggtataccttcaactaaatttgtttacaataatttatctttaaagtgttttaaatatacaaacaatggtacttatccacttcaattatctgaccttgtttgtcatttagtcgcattaatgcgttacgggggtggtgtaagttatcaactgatagaagatgagagtccttttattgccttatttaatcgttatggtagtcccctacctctcatgcacctctataaattaatcgaaccatttttaaatgaacctttagagatagctaacaattttttaatgagtcgcaaagatggtaactatcactttttattatttaataaaataaatgatcgttatctatctgatagtcaacagcgctacgtttttaaaaatacattatcaaccaactcattaattattattaaaacgttaaatcatgagcatggcgcaattcaaaaccttctaccacaaactaaacaacaattttatattgaacgtagtattcttgatgaacttgataaatcaaatcaaccaaaaacagaattagctatacaacatgaccatcatcttcctttccaagtcaccttaaaacacgatgaagtcaaatatatttgttttaaaccttcttaa

SEQ ID NO: 211 - DNA, 150 bp, S.epidermidis
gtgctgaataatgacacatcaaacatgttgagtcttgttatggtcgatatctcttttattgttctttcaattaacgttgaaatgagcagcgtacatttagttacagtgacttcgttttataattcattcgaacttctcctaaacctctaa

SEQ ID NO: 212 - DNA, 141 bp, S.epidermidis
aataatatcaaaatttaccgtattataatcattttagattatgatgcggttatttattgtctatttattgtcattcatatcatcaagctctattttataaactttattttctttatactacaatatataattgcaaaatga

SEQ ID NO: 213 - DNA, 468 bp, S.epidermidis
attatgtgtgataaggatatatacaataataaggagatgataattttgaataaacaacaagtgacaaaagcaatagaaaaagtattaaattcttcaaaaattggtgtcctatcaacagcacatcataataaacctaatagcagatatatggtcttttacaacgatgacttaaacttatatacaaaaacgaatatcaattcactaaaagtcgaagaaatagaaaataatcctgatgctcatattttattaggctataacgaaacaacaaacaatagctttgttgaaatagatgccactatagaagttgtcaaaaatcaaaaagttattgattggttatgggaaactcaagacaaaacatttttcaattcaaaagaagatcctgaattatgtgtactcaaagttatacctcgttcaattaaattaatgaatgatgatgaactagatacgccagctacaattgagttataa

SEQ ID NO: 214 - DNA, 132 bp, S.epidermidis
gacctatgcctaatccttttttatttttcattattgaaaactcctttatctatattaattcatttatacataattttaagtcattttgcaattatatattgtagtataaagaaaataaagtttataaaatag

SEQ ID NO: 215 - DNA, 1296 bp, S.epidermidis
aggggagtttgcataatggctctattcaagaaaaaaataagtctaccaacgcaagtaattattgctttggtactcggtgtcatcgctggtctattactatatggacaagatgatgttgcaaattatattaagccatttggtgatgtgttcttaaatttaattaagatgatcatcattccgattgtattttgttcattagccttatctatttcaaatttaggggattctaaaaaggtaggaagctatggatggaaagcaatcctttattttgagattattacaactatcgctataggtttaggtcttatcattggtaatctattcaaaccaggttcaggtctagatccagataaattacctaaaggcgatattactaaatatcaatcatctgcacattcagcagaacaagcgactacttatggtaatcattttatagatacattagttcatattgtgccaacgaatttatttgaatctatggcaaaaggtgagttattaccgattatctttttcgcagtattttttggattaggattagctgcgataggagaaaaagcagaacccgttaaaggattcttaaatggtactttagaagctgtattttggatgatcaataaaattttaaaattagctccaattggagtatttgcatttatctgtacgacagtaatgacttttggtgcttctgcattaattccattatttaaattattagttgttgtagtatttgctatggttttctttgttattgtagtattaggaattgttgcaagaatggttggaataagtattttttcaatcatgaagatacttaaaagtgaattgttacttgccttttctacttcaagttcagaagcagtattgccgattatgatgaagaaaatggaacgctttggttcgccaaaagatgttacttcatttgttattcctatcggttattcatttaatttagatggctcagctttatatcaatctatagctgctttatttgttgctcaaatgtatgatatacatttatcattaactgaacaacttgtattaatggccacacttatgattgcttcaaaaggtatggctggggtgccaggcgtatctattgtagttttattaacaacattaacttctatgaacataacagcacaaggtcttgctttaattattggtattgatcgtttattagatatggttcgtacatgtgttaatgttattggtaatgcactatcaacagttgttattgctaagtgggaaaacgtctatgataaagagaaaggtcaaaactacttaaattcaatttaa

SEQ ID NO: 216 - DNA, 147 bp, S.epidermidis
tggctcttatgcatttttgaaaaaatgcaaacagaagcaaaacaatctatgattgttagtggctcttatgcatttttgaaaaatgtaaacagaagcaaaactatctatgatagtaagtggctcttatgcatttttgaaaaaatgtaa

SEQ ID NO: 217 - DNA, 378 bp, S.epidermidis
ttgaaagaacgcggaaaaatagaaaaattgtggcgtgaagaaaaatatcgtgtgctatttcatgatcagaatgcatatcattcgataagaacgttattaaaatcgcctaccacattgggtgaagtgaaagaacatataacgcacgctttaaccattacacctacaaaaggctcagttatcaatgcttttgaacatatgtgggggtatttcaaaaaacaatgtacacaatatgaaaagcaacatagccgagaattaaaagcgttgtatattgaaaatcaaattgactattttgagctgttgtcttttttaaaaaatttagcagataaatatgctgtcgagtacttacaacaaagtaccatactcaatattacaaaatga

SEQ ID NO: 218 - DNA, 315 bp, S.epidermidis
  unsure (120): Identity of nucleotide sequences at the above locations are unknown.
agcggcaggctaactcccgccttaagaggggcgcagggggctagacatgaatcgggcgcgtgggcgctcaattttacatcacagatgttggggcgaactgggtcccaacggctcaccgantgggaccgcacacccaacccggggctattggggcggaggggcggggacaggagaccgggggggtataaaactgtactgttaatcaaacgggatatcagggaacaggcgattgatgcggagggaccgccgggagatgaagatgggagtgaactgggattacactcgcaaccgggcgtgggtgcgaaacgagtgtga

SEQ ID NO: 219 - DNA, 129 bp, S.epidermidis
gtggaaaaaagccaaacttcatatagcactaaaaaggggctatattataaagaagtcgttttcaaagatgaacctaacgtgacatatgtgattcaacctatcagtacttcaaaaaggaatattcattga

SEQ ID NO: 220 - DNA, 153 bp, S.epidermidis
cagataaatatgctgtcgagtacttacaacaaagtaccatactcaatattacaaaatgaagtgacaaaatcatttaacaattatatttcgtcaggcaagcacgaatacgtaaaacagatctttatttatatgtcaattttggttttaaaataa

SEQ ID NO: 221 - DNA, 138 bp, S.epidermidis
  unsure (70): Identity of nucleotide sequences at the above locations are unknown.
atcgggcgcgtgggcgctcaattttacatcacagatgttggggcgaactgggtcccaacggctcaccgantgggaccgcacacccaacccggggctattggggcggaggggcggggacaggagaccgggggggtataa

SEQ ID NO: 222 - DNA, 132 bp, S.epidermidis
cacacgatatttttcttcacgccacaatttttctatttttccgcgttctttcaactaaatcccctccaaagtgatattgatttaactgcagatgttaaagctagtttaatattttttaagaaaaatgaatag

SEQ ID NO: 223 - DNA, 990 bp, S.epidermidis
aaggttagttccatgcttaagttaaatccctataaaataggatttagaactgtcaaaactgctgtgggaatgactttaggagtaatcatatgtaaacttctaggcttagataattatgcatccagtgctattttagttgtattgtgcataaagcacactaagatgcattcagtacaagcaattttatctcgactagtttcatgtttactcatattatttttaggttcagcaatttttagtcttttaggacaacatgcatttgttttaggtttaattgttttgttgtttattcctttgacagttgttctaaatgtgcaagaaggtgttatcactagttgtgtcatattattacatgtctttaacgccaaagctattaatgggcaccttattttaaatgaaataatgctattaatagtgggcttaggtatagcatttctaatgaacttaatgatgcctagtttagataagaaattgaatcattttaagcaggatatagaaaatcaaataactgaaatatttaatatttttagtcaagcctgctcaatgcataatgatcatttaaatattaaatttgattcattacttttaaatattaaaaaagcaaaatcacttgcttttagagatgttaaaaatcactttgtacgaaacgaaaattcattttatcattattttgatatgagagaagaacaagttgaattattaaaacgtatgacatcgttattagaaagaataaatacagatgatcctatactcgaaaagatttcacaattaatgtatgaaattggaagtaacgtaaatagcaatgattatacggctctaagactacattcactttatgaaatacgtttatctctcgatgatttaccattaccgactactcataagactttaaattcccgagcacatattattcaaattctaaatgaactagaagaatacttaaatattaaatctcaatttggttctttaaaattgcatagtgaaatataa

SEQ ID NO: 224 - DNA, 1236 bp, S.epidermidis
caattttactcgtttataagatgttataattatgtagtgtataaggaggcatacaagatgactgaagaattcaatgaatcaatgattaatgatattaaagaaggtgacaaagtcactggtgaagttcaacaagtagaggataaacaagttgttgtgcatattaatggtggcaaatttaatggaattattcctattagccagctttcaacacatcatatcgaaaaccctagtgaagttgtaaaagtcggtgatgaagtcgaagcatatgtcactaaaatcgagttcgacgaagaaaatgatactggggcatacattttatcaaaaagacaacttgaaactgaaaaatcttatgaatatttacaagaaaaactagataacgatgaagtgattgaagctgaagttactgaagtagttaaaggtggtttagtcgttgacgttggtcaaagagggtttgtacctgcttctctaatttcaactgatttcattgaagatttttctgtattcgatggtcaaacaatccgtattaaagtggaagaacttgatcctgaaaacaatagagtcattttaagccgtaaagctgtggaacagttagaaaacgacgctaaaaaagcttcaatattagattctttaaatgaaggcgatgttattgatggtaaagttgctcgattaactaactttggtgctttcattgatattggtggcgtagatggtttagttcacgtttctgaattatctcatgaacatgttcaaacaccagaagaagttgtgtcagtaggtgaagcagtcaaagttaaagttaaatctgtagaaaaagattctgaacgtatttctttatctattaaagacactttaccaacaccatttgaaaacattaaagggaaatttcacgaagatgatgttattgaaggtactgtagtacgtttggcgaactttggcgcattcgtagaaattgctccatccgtccaaggtttagtgcatatttctgaaatcgatcataaacatatcggttctcctaacgaagtattagaacctggacaacaagttaatgtaaaaatattaggtatcgatgaagataatgaaagaatttcattatcaatcaaagcaacgttacctaaagaaaatgtcattgaaagtgacgcatccacaactcaatcatatcttgaagatgataatgatgaagataaaccaacattaggcgatgtttttggtgataaatttaaagaccttaagttttaa

SEQ ID NO: 225 - DNA, 192 bp, S.epidermidis
attgtacactctgtatatcaactcgatattttagataagttaccatttataaatcaaatgatttcagttaatatttctatacctttttctaattgttttttagtgatggtcaatggcggtaataacctaatcacatttttaccagctgttaaaatgattaaccccatacgtttagcttctcgcactacttga

SEQ ID NO: 226 - DNA, 162 bp, S.epidermidis
attcagatatcatcgtggcttaatataagaaaagtaacagctcaacgagctgaaaatcatcaaaaaaattataaaaaagacaattcctatattatttcaatagaaattgtctttatttacttatcttggacctttttgttccagcctcttgtaaatttttaa

SEQ ID NO: 227 - DNA, 123 bp, S.epidermidis
ggcaagtcatcatggctgccttatttttttgaatttattgctaattatcataaaataaattgtacaatattacttaaattcaaacaggggattatctttcattcaattataaaaacaagatag

SEQ ID NO: 228 - DNA, 186 bp, S.epidermidis
tcaaatccatcgacatctatcattataaataaagattccagtcactacagtaagatgctgactagaatagctatatcatgtcatactaatgagaggacatcttcttcacaaagattctcttactatagaatcgacgagctaaacttgatagacggagatagcaattatacgggagcgagactatga

SEQ ID NO: 229 - DNA, 330 bp, S.epidermidis
ggagtgacatcaatgaaaacattgaaattattgaaaaaaacacgagcatttaccttgatagaaatgcttttagtattactaataataagtttattgttaatacttataattccaaatattgcaaaacaaacatctcatattcagtcaactggatgtgatgctcaagttaaaatggtaaacagtcaaatagaagcctacgctttaaaacataatcgcaacccttctaatattgatgatttggtttcagatggttttataaaagaaggacaaaaaacatgtaaatccggtcagacaattagtattgcaaatggagaagcagttgccaattaa

SEQ ID NO: 230 - DNA, 894 bp, S.epidermidis
aaagaaggattaaaaatgcctcaaagagtattgctcgttgatggaatggctttattatttagacatttttatgcaacaagcttacacaatcaatttatgtacaattctaaaggaattcctacaaatggtattcaaggttttgtaagacatatttttagcgctatcaaggaaatcgaacctactcacgtagcagtttgttgggatatggggcaagaaacattcagaaatgaaatgtatgatggctataaacaaaatcgcccagcacctcctgatgaacttattcctcaattcgattatgttaaagaaatatcccatcagtttggttttgtaaatgttggtaagcgtaattatgaagctgatgatattattggcagtttagcggaaacatattcacaagaacatgaagtttatatcattaccggagaccgagacttactccaatgcattaatcataatgtagaagtttggcttataaaaaaaggttttacaatctatcaacgttacacgcttgatcgtttcattgatgaatacgggcttaatcctcaacaattaatagatgttaaagcttttatgggtgatacagcagatggctattctggtgtaaaagggataggtgaaaaaacagcaattaaattaattcaaaatcatggaactgtcgaaaatgtagtgaacaatttatcatcattaactcccgctcaacagaaaaaaataacaaataatttaaatcatctgcatttatcaaaatcactcgcagaaatatataccaaagttccaattgaaacagacaaactttttaaagagatgacatatgctcatacactaaatgagattttatccatttgtaatgaacatgaactatacgtttcaagtaaatatattgcaactcacctctaa

SEQ ID NO: 231 - DNA, 132 bp, S.epidermidis
atacatttgtcattatatcataggttaacgttattgagtgactcaaaggttaaccttgtgaaaaaaatatcaatcttaatggtaattacatctttttggtgtttatttaccgttttctgccaaatgtcttaa

SEQ ID NO: 232 - DNA, 1596 bp, S.epidermidis
ttaattatgtcaaagatatattgcattaaagtaataaaaacgttactatatcaaagatacatagaagtgacaggttataaagatgaaagcgagaaggataaaatggataagcaagaacgatacaatagaagagaaaatattagaaatttctccattattgctcatatagaccatggtaaatcgacattagctgatcgaattttagagaatacaaaatcagttgaaactcgagaaatgcaagatcaattacttgactctatggatttggaaagagaacgaggcatcactattaaactaaatgctgttcgattaaaatacgaagctaaagatggagaaacttacacatttcatttgatagatacaccaggacatgtcgactttacatatgaggtttctcgctcattagctgcatgtgaaggtgcaattcttgtagttgatgctgcccaaggtatagaagcacaaaccttagcaaacgtttatttagcattagataacgatttggaacttttgccagttgttaataaaatagacttgcctgcagctgagcccgatagagttaagcaagaattagaagatgttataggtatagatcaagaagatgtagtacttgcaagtgctaagtcaaatataggtattgaagaaattttagagaaaatagttgatgttgtaccagcaccggacggtgatccagaagccccacttaaagcacttatctttgattcagaatatgatccatacagaggagtaatatcttcaattcgaattattgatggtgttgttaaagctggagataggattaaaatgatggctaccggtaaagaatttgaagttacagaagtcggaatcaatacacctaagcaactaccggtagaagaattaacagttggtgatgtgggttatattatcgcaagtatcaaaaatgttgatgattctagagtaggtgacacaattactttagctgaaagacctgctgacaaaccgttacaaggatataaaaagatgaatccaatggtattttgtggtctattccctattgacaataaagactataatgacctaagagaagctttagaaaaattacaacttaatgacgcatccttagagtttgaaccagagtcttcacaagcacttggttttggatacagaactggatttttaggaatgttacatatggagattattcaagaaagaattgaaagagaatttggtattgaactcattgcaacagcgccttctgttatctatcaatgtatcttaaaagatggttctgaagtttcagttgataatccagcacaaatgcccgaaagagataaaatagaacatatttatgaaccatttgtcaaagctacgatgatggtgccgaatgattatgtaggtgcagtgatggaattatgtcaacgtaaaagaggtcaatttataaacatggattatcttgatgatataagagttaatattgttcatgaaattccattatcagaagtaagtttttcgatttctttgatcaacttaaatctaacacaaaagggtatgcttcttttgattatgaatttattgagaataaagaaagtaatcttgttaaaatggacatattactga

SEQ ID NO: 233 - DNA, 747 bp, S.epidermidis
agaatacggtcaggcagtattttagtcatgaatcaatatgaagatatgagtttagtatatgacaaacttactcaagatcaaccgtatcattcgtggtttaatattgttgagcatttcttaccttctgatagtcatgatttgttagatattggttgcggtactggcaacttaacacaattactaacgtcactaggtgaagtcactggtatggatattagtgtagatatgttatcaatagctagacaaaaaacaaatcaagtgaagtggatcgaaggtaatatgactcactttaatttgaacaaaaaatttaatatgattacaatattttgtgattcactgaattatttagaaacattaaatgacgtaaaaatgacattcgaaagagtgtatcaacatttaaataaaaatggtgtttttatttttgatgtacatactgttcataaaatgaaaacattatttaataataaaagttatattgatgaatctgataatgtttttgtaggttgggatgcaatatgtggggatgaaccattaagtgtttatcatgaaatgactttctttgtatcacagcaaaatggattgtatcaacgctttgacgaatcacattatcaaagaacatatgaggaacaaatttatcgaaatttactaaaagatgttgggtatcatagtgttaagacttttacagactttaacattcacagtcatgaagaagatgcccatcgcttgttttttgttgctaaaaaataa

SEQ ID NO: 234 - DNA, 132 bp, S.epidermidis
gattctaggtctcttacatcaaggaattatattgagagggaaagtttaatattattaaattttcaacttagttaccatcttaaattactttcaaaatgcctgagacaatcaatgctgtcccaggcattttaa

SEQ ID NO: 235 - DNA, 174 bp, S.epidermidis
gaattatatcccagactcattgaactcaaaatttatatatattactatccggaaccgagtttggaaagtacttcaatgatatttaagttcgatttcccccatttagtaaattatttaatttcaacgattttaacattcatttcgccaccgttaggaagtggaacacgtacttga

SEQ ID NO: 236 - DNA, 123 bp, S.epidermidis
aaaacattccccccacatacaagttgttcttttggattggtcattttcaactatccccttttatatgcccgtaaaagactaacgttaagaaatgacgtttcaataaaagcagtagacctttga

SEQ ID NO: 237 - DNA, 681 bp, S.epidermidis
ttttttgtgtttaatattaacagacgatatatcgatttttttatgaaatggaagttgtacatcttgattatattaataatgttaacaacattctttttttacttactcaatgataacaataatgatttgatacagaatagtcaggaaagacaatctaaaatatctgaccagcaaataaaaaatagcaaaaagttaaataaaaaagaagtgtctattcaaaaagataatacaaaagaaactaaaatatttatcgatattaaaggtgctgttaaacatccgaatgtatatgaaatgtcttcttcgaatagagtcattgatgctttaaataaagcagaggtattaaaggatgcagacttatcacaattaaatctttctgaaaaattagttgatcaaaaacttatctatgttcctaaaaagggtgagaatagtatgaaaatcaattcacagcaatcaacattgaattcgagtgacgtaaaaatcaacacgaatcaacctttaaatttaaactctgctactgaagaacaattgaaaaacataccaggaataggtccaagtaaagctaaagaaattttaaattacagagaacaaaatcatggatttaatagtatcgatgacttaatgaaaataaaaggattcggaaagaaaacatttgaaaaactgaaagaacattttactatttaa

SEQ ID NO: 238 - DNA, 141 bp, S.epidermidis
gtaaaagtgttagaacacttatggaaagagacaaaaaagcagaataaagagtgtaatattactttttatgagcgaatgttaaaaaatttcgtcataaatcgcataaaaccaacgtttctattacataaatcgttgcgatga

SEQ ID NO: 239 - DNA, 468 bp, S.epidermidis
tttgaggtgttaattgtgccaaaaaagtcagtgagacatataaaaataagagagataatttcaaatgaacaaatagaaacacaagatgaactagttaaacgtttgaatgagtatgatttaaatgttactcaagctactgtttcacgagatattaaagaattgcaattaattaaagttcctgcacctacagggcaatatgtttatagtttaccaaatgatcgtagatatcatccattagagaagttgggtagatatttaatggattcatttgtaaacattgagggtactggtaatctactagttcttaaaacgcttcctggtaatgctcaatccattggtgctatacttgatcaaattgattgggatgaggtacttggtacaatttgtggtgatgatacatgcttacttatttgtcgagacgaagaagcgagtgaagaaatcaaaactcgaattttcaatttattataa

SEQ ID NO: 240 - DNA, 945 bp, S.epidermidis
attcgtcagttaaagtgtatcgaaaggagactggacatgcaaaaaaatattctaaaaagtggcatcgaaatttctgaacttgggttaggttgcatgagtttaggcacagattataaaaaagcgcaaccaattattgaaagtgcaattgataatggtattacgtattttgatactgcagatatttacgatcaaggagttaatgaagaaattgttggtaaagccttaaaaaaatatcaaaatcgtgatgacatcgttatcggaactaaagttggaaatcgattaactgacgatggacatatgacgtgggatccttcgaaaaaacatattaaagaaagtgttaagggatcattgaaacgattaggattaaaccatttagacttatatcaattacatggcggaacaatagatgatcctctagacgaaactattagtgcatttgatgaattaaagcaagaaggatatattcgtgcatatggaatttcatctatacggcctaacgtgatagactattatcttaaaaatagtcaaattgaaacacttatgtcccagtttaatttaatagataatcgccctgaaagtcttattaatgacgttcatgataagcaagttaaaattctagcacgtggccctgtatttaaaggtttattaacttcaaaaagtgttgatgttatagatgaaaaatttaaaaacggtgtgttagattacactcaagacgaattaggtagcacgattgcttctattaaagaattggaaagtaatttaaccgcgttatcatttaaatatttaacttctcatgatgctatggggtcaattattgtaggagctagtagcgttgaacaacttgaagagaatgtccgcaattattataaagaaatcagtttagatcaaatcaaatctgcacgtaatagagttaaagatattgaatatacacaacatttgaaataa

SEQ ID NO: 241 - DNA, 144 bp, S.epidermidis
ttgtttaagtttgaaaacataggtattaaaatcattgttattgtactaactataaaaaaggctagcaatgcatcaataattaaagaccctttaaatttatattttgacaaatctcaaacgccccttttcaatatggaagattaa

SEQ ID NO: 242 - DNA, 1404 bp, S.epidermidis
ggagaggcttttatggttaaaaatatggatacaattgtacaacttgcgaagcatagaggatttgtattccctggtagtgatatttatggtggattatcgaatacatgggattatggtccgttaggtgttgaattaaaaaataatattaaaaaagcttggtggcaaaaatttattacgcaatcaccttacaatgtgggtattgatgctgcgattcttatgaatccaaaaacatgggaagcatcaggacatttaggaaattttaatgatcctatgattgataataaggacagtaaaattcgttatcgtgcagataaattaatcgaagattatatgcaaaatgaaaaaggtgacgaaaactttatagcagatggcttaagttttgatgagatgaaaaaaattatagatgatgaaggaattgtttgtccggtcagtaagactgcaaactggaccgatatccgtcaatttaatcttatgttcaagactttccaaggtgttactgaagattctactaatgaattatttttacgacctgaaacagctcaaggtatttttgtgaactataaaaatgttcaacgttctatgcgtaaaaaattaccttttggtattggtcaaattggtaaatcattccgtaatgaaatcacaccaggaaactttattttcagaacaagagaattcgaacaaatggaacttgaattcttctgtaaacctggcgaagaaattgagtggcaaaattattggaaaacttttgcaagtgaatggttaacagatttaaacatctcagaagacaatatgcgccttagagatcatgatgaagatgaattatcacactattccaatgctactactgatattgaatataaattcccatttggttggggtgaattatggggtattgcgagtcgtacagactatgatttaagacaacatagtgaacattcaggtgaagattttaaatatcacgatcctgaaacaaacgaaaaatacattccttattgtattgaaccatctcttggtgcagatcgtgtgactttagcatttttatgtgacgcgtatgctgaagaaggtgttgaaggtagtaaagatgcacgtacagttatgcacttccaccctgctttagcaccatataaagcggcagtattaccattaagtaaaaaattatcaagtgaagctattaaaatttttgaacaactaagctctagctttgcaatagactttgatgaatcacaatctattggtaaacgttatcgtcgtcaagatgaaataggtacaccatattgtattacttttgattttgattcattagaggacaaccaagtaacagtgcgtgacagagatagtatggaacaagtacgtatgccaatatcagaacttgaaacatttttagctgagaaagttaaattttag

SEQ ID NO: 243 - DNA, 129 bp, S.epidermidis
tctggttttacttcattctgctctgcaactgcaacagctgctggacgtgctaatcctgcagcacaaccgcatgttgagttgattacaacaaatgttgtatcatcattatctatattttgcatatactga

SEQ ID NO: 244 - DNA, 246 bp, S.epidermidis
tttgtgcatacctgttcgtatgttggattttctacatgtcctccactatatccggaaacgactgattttattccaggatatgaggtgaagggtttaaccatgcaccaaaaacaacctccagctagtgtcgcatatgccatgttatattccctccttaagttatctgtttgtttaaatttacgctatattgtcgggaatttaaagtatttaactcagaatcattcatgtgattttgtgacaacttag

SEQ ID NO: 245 - DNA, 1488 bp, S.epidermidis
ggatgtgataccatgaatgatcatcaaaaaaatcatgcaacatctcaagatgataacacaaagtcaacaccatctaagaatagcaagcatataaaaattaaattatggcatttcatactcgttattttgggtattattcttttaacatccatcattactgtagtatcaacaattttaattagccatcaaaaaagtggtttaaataaagaacaacgtgcaaatttaaaaaaaattgaatatgtctatcaaacacttaataaagattattacaaaaagcaaagttctgataaattaactcaatctgccatagatggtatggttaaagaacttaaagatccatattcagaatatatgactgctgaagaaacaaaacaatttaatgaaggtgtatcaggtgatttcgttggcataggtgctgaaatgcaaaagaaaaatgaacagataagtgttactagtccaatgaaggattcaccagcagaaaaagctggtattcaacctaaagatatcgtcacacaagtgaatcatcattcggtagtcggtaaaccacttgatcaagttgttaaaatggtccgcggtaaaaaaggaacatatgttactttaactataaaacgtggttcgcaagaaaaggatattaagattaaacgcgataccattcacgttaagagtgtagagtatgagaagaaaggcaatgtaggcgtactaacaatcaataaattccaaagcaatacttctggtgaactcaaatctgcaatcatcaaagcgcataagcaaggcatccgtcatatcattttagatttgagaaataatccgggggggttattagatgaggcagtcaagatggctaacatctttattgataagggaaatactgtcgttcaattagaaaaaggtaaggataaggaagaattaaaaacttctaatcaagcactaaaacaagcaaaagatatgaaagtatccatcttagttaatgagggatcagctagtgcttcagaagtgtttacaggtgctatgaaagactatcataaagctaaagtttacggttctaaaacatttggtaaaggtatcgttcagaccactcgtgaatttagtgatggttcattaattaaatatacagagatgaaatggctaacgcctgatggccattatattcatggtaaaggaattagaccagatgttagtatctcaacaccaaaataccaatcactcaatgtcattccagataacaaaacttatcatcaaggtgaaaaagataaaaatgttaaaacgatgaaaataggtctaaaagctttaggttatccaattgataacgaaacaaacatatttgacgaacaattagaatctgctattaaaacatttcaacaagacaataatttaaaagttaatggcaattttgataaaaaaacaaatgataaatttactgaaaaactagttgaaaaagcgaataaaaaagatactgttttaaacgatttactaaacaaactaaaataa

SEQ ID NO: 246 - DNA, 612 bp, S.epidermidis
catctcatcacaaacattacaacaggtttaaaagatgtggttgaagttacattcaatcaaatcactgtagatggtgacacttcaacaaatgatatggtgcttgtgatgtcaaatggatgtacaaataataacgaaattaaaaaagacagcgaagactactataaatttaagcagatgcttctatatattatgaccgatttagcaaaaagtattgcaagggatggcgaaggtgcttctaaattaatagaagtcacggttaaaggtgcaaaagaatctagtgctgcaagaatgattgctaaaagtgtggtgggttcaagtttagtaaaaaccgcaatttttggcgaagatcctaattggggtagaattattgctgctgcaggttatgctaaaacatattttgatattaatcaggtagacatttttataggtaggatacctgtattaataagatcctcaccagtaaagtacgataaagaagaaattcaagaaataatgagtgctgaagaaatatcaattcagcttgaccttcatcaagggaattgtgaaggtcaagcatggggatgtgatttatcgtatgactacgttaaaatcaacgcactatacaccacttag

SEQ ID NO: 247 - DNA, 1068 bp, S.epidermidis
cctatgaacactttaatactactaacgaaaagagggaataatttgaatatcgaagatttcgattatcatttgccagagtctctcattgcacaaacaccactaaaaaacagagaccaaagtagattgttagttcttagcaaagatactggtgagctgacacacttacattttagagatgtcatccattattttgagcctggtgatacattggttcttaatgatacacgtgttatgcctgctagattatttggcctaaaagaagaaactggtgctaaagttgaaatgctaatgctcacccaaattgaaggtaatgattgggaagttttacttaaacctgcaaagagaattaaaaaaggtcatcgtctaaattttggagatggtaaaatcgttgctgagtgtattgaggaacttgaacagggcgggcgtattatgcgtctacattatgagggtatactccaagaacgcttagatgaattaggcgagatgccattacctccatatattaaagaaagattagatgatcctgataggtatcaaacggtttatgctaaagagagtggatcagcagctgcaccaacagcgggtttacattttactgatgatttgctaaataaaattaaacaaaaaggggtacatatcgcttttattacattgcatgttggattaggaacctttagacccgtaagtgttgaaaatatcgatgatcacgaaatgcatagtgagtattatcaaatgacacaagaaacggctgatttattaaataaaacaaaagaaagtgggaagcgtgtgatatcagttggaacaacatcaacgcgtacattagaaacgatacgtcgtgatcatcctcaatttgttgccacaagtggatggactgatatctttatttatcctggctttgagtttaaagcgatagatgggttaattactaatttccacttacctaaatcaacgttagtcatgctagtatcagcatttagcaataaaaaatatattttaaacgcttatcataaagctgttgaaatggagtatcgattctttagttttggagatgcaatgttaattatataa

SEQ ID NO: 248 - DNA, 177 bp, S.epidermidis
acaaaattaacgaggtgccttatgtataaagactataacatgactcaacatactctactaatggaaacttcagttcttatccccacaaatgatatttcacgacatgtaaatgatattgcagaaacaattcccgatactgaattcgatgaattcagatatcatcgtggcttaatataa

SEQ ID NO: 249 - DNA, 150 bp, S.epidermidis
atgaaagtaactcatcaatttgttgttgaatggatgtctccaacatttgaaattgatgttcggcaagttgagtcatctcatggatataatcatttaattgtcggcgcaatgagttcaaatcatcttgtaataattcaagagtttgattag

SEQ ID NO: 250 - DNA, 276 bp, S.epidermidis
agaggagtaactaaaatggaattaacttcattgattataccaattttattattggtcgtaatgtatttcttattaataagaccacaacaaaaacgtgcaaaagaacatcgtgcaatgattaaccgtgttgaagcgggtcaaaagattactacaatcggtggtattaaaggaactataaaagctgtagatgaaacttctgtaatcattacagtaaatagtaatggaacagaaatgacttttgaaaaaccagctataaaacaagtagatccttcataa

SEQ ID NO: 251 - DNA, 993 bp, S.epidermidis
aaagtaatgacagatattattttagctgctgatataggcggaacaacttgtaaattggggatatttgacaaggatttagaacaattgcataaatggtctattgatactgatacaagtgaccacactggtgagttacttttaaaaaacatttataattcttttactgaaaagattgcagaatataaatatgattttaacaatgtagttggagtcggtattggtgttcctgggcctgttgattttgatactggagttgtatacggagctgttaatttacattggcccgatagtgtcaatgtaagagaaattttcaaacaatatgttaattgtccagtttatgttgataatgatgctaatgttgctgctttgggagaaaaacataaaggtgccggcgaaggtgctgatgatgtagtagccattactttaggtaccggcctaggtggaggtataatttctaatggagaaattgtacatggacacaatgggtctggcgctgagattggacatttaagagctgattttgatcaacgttttcaatgcaattgtggtaaatcaggttgtatagaaacagttgcttctgctactggtgtagtaaatttagttaatttctattatcctaaattaacgtttaaatcatcaattttacaacttattaaagataaccaagtaactgcaaaagctgtatttgatgcggctaaagctggcgatcaattctgtatatttataactgaaaaagtggcaaattatatcggttatttatgcagtatcattagcgttactagtaatccaaaatatattgttctaggagggggcatgtctacagcgggacttatccttatagaaaatattaaaactgaataccgtaatttaacttttactccagctcaaaataatactgagatagtacaagctaagttagggaatgacgctggtattactggtgcagctgggcttatcaaaacatatatcatagataaagagggtgctaaataa

SEQ ID NO: 252 - DNA, 156 bp, S.epidermidis
tacattaagacattaaggttttccaaaagattaatgagcctgatattattttttcaggctcataaaaatctatattttattatttttattcatcatatgaaatcaaactcatcacatcataatcttttattttatcaattccattcaaatatttaa

SEQ ID NO: 253 - DNA, 1143 bp, S.epidermidis
catatgcctgcagtgacatatgagcatataaaaacatgtaaacaatccggtgccagattaggaattgtacatacaccgcatggatcttttgaaacaccaatgtttatgccggttgggacaaaagcaacagttaaaacaatgagcccggaagaattaagaaacatagaagcaaagattatattaggaaacacatatcatttgtggttacaacctggaaatgatattatcaagcacgctgggggattacacaaattcatgaattgggacggtccaattttaacagattctggtggtttccaagtatttagtttaagtaatttgcgtaaaatttctgaagaaggtgtagaatttagacatcataccaatggctcaaaactatttttgagtcccgagaagtctatgcaaatacaaaatgatttaggttctgatattatgatggcatttgatgaatgtccaccaatgccagctgaatatgattacgtcaaagattcaatcgaacgtacaactcgatgggcagccagatgtttaaaagcacatcaacgccctggagatcaagcactgttcggtattattcaaggtggagaatacaaagacttaagagaacaaagtgctaaagagctagtcagtcttgattttccagggtatgcaataggagggctgtctgtaggtgagccaaaacctgttatgtatgacatggttgaacatacagaacaatttatgccgaaagataaacctagatatttaatgggagtaggttctcctgatgctttgattgaatgtagcattaggggcatggatatgtttgattgtgtattacctactagaattgctagaaatggtacttgtatgacatcaaatggtcgattagttgttaaaaatgctaaatatgcagatgatttaagaccacttgatgaacaatgtgactgttatacatgtcaacattacacaagagcttatattagacatctagttaaagcggaagagacttttggtatccgtcttactactattcataatttacattttctgctaaaattaatggaagatattagacaagccattcgagaagaccgtcttttagattttaaagatgaattctttgaacaatatggattaaatgtagaaaaccctaaaaacttttaa

SEQ ID NO: 254 - DNA, 135 bp, S.epidermidis
tactgtaacgcattcctgaaatgtgtattaaaacagggtagctttatgctatcctgttttttaaaaattattaattgggggtacacgtatgacaacagatttgaaaaaaacacctttatatcaaaattacgttga

SEQ ID NO: 255 - DNA, 645 bp, S.epidermidis
gagtctgaagccgacagtatagtctggatgggagaaaatggaggttttttgttgttcaaatttcctccttttctaagtaagatgaatggaaggagaaaattatatatgcaacaaaacaaacgtttgattacaattagtatgttaagtgcggtagcgtttgtgttaactttcatcaagtttccattgccatttataccaccgtatctaactctcgattttagtgatgtaccgacgttattagcaacattcctcttaagtcctattgctgggattatcgttgcactcatcaaaaatattttaaattttctattcaatataggggatcctgttggaccagtagctaactttttagcaggcgtcagctttttgctatcatcatactatgtttatagaaaaagaaaaaataatcgttctttaatttatggattaattacaggtacaatcgttatgactattgttttgagcatcttaaattattttgtgttacttccattatatggaatgatatttaatttaggtgatgtgcttaataacgtaaaaattgttattgtgtctggagtcataccttttaatttaattaaaggcataatcatttccattatatttgtgctgttatttagaagattaagacatatcatcaaataa

SEQ ID NO: 256 - DNA, 606 bp, S.epidermidis
ttatttatggcttttgaattaccaaatttaccttatgcatatgatgcattagaaccacacatcgacaaacaaactatggaaattcatcatgacaaacatcataacacatatgttacaaaattaaattcagcagttgaagggacagatttagaagctaaatcaatcgaagaaattgttgctaatttagatagtgtgccatctaatattcaaacagctgttcgtaataatggcggtggtcaccttaaccattcattgttctgggaactattatcaccaaattctgaagaaaaaggtgaagtagtagataaaattaaagaacaatggggttctttagatgaatttaaaaaagaatttgcagataaagctgcagcacgctttggttcaggatgggcttggttagttgtaaacaatggacaattagaaattgttacaacaccaaatcaagataatccaattactgaaggaaaaacaccaattttaggtttagatgtttgggagcatgcttattatcttaaatatcaaaataaacgcccagattatatcaatgcattctggaatgttgttaactgggaaaaagttaatgaattatataatgcaactaaataa

SEQ ID NO: 257 - DNA, 339 bp, S.epidermidis
gctaatgcggcacattacggtgcatcgaaagcagggtttagcgccgttcttaatgcattgagattagaacaaccggaattaaaagtgctcaatgtacagcccggtccaatagatacaccattccaaaaaaacgcagatcctactctaaagtattttaaaaattatagacacatgatgatacaacctcaacaacttgccaagcaaatagtggaaggaataatactaaataaaattgaaattaatcaaccatcatggatgcaaataatgcttaaattttatcaattatgtccacgtacactagaaaaattatgtccaaatctatttaaaaataaagtttaa

SEQ ID NO: 258 - DNA, 465 bp, S.epidermidis
aggagtgaggcttccgtggaagaacgattaaatcgcgtgaagcaacaattacaacaatcttcatataaattgactccacaaagagaggcaactgttagagtattaattgaaaatgaaaaagatcatcttagcgcagaagatgtgtacttaaaagtcaaagataaggctccagaaataggattagctaccgtttatagaactttagaattgctagctgaaataaaagtgctagataaaataaattttggtgatggtgtagctcgttttgatttaagaaaagaaggagccaagcatttccatcatcatcttgtttgtatggaatgtggtaaagttgaagaaattgaagaagatttattacctgaggttgaaaatcgtgttgaaaatgagtttaatttcaagattttagatcaccgtttaacgtttcacggtgtatgttttgaatgccaagccaaaaataagcaataa

SEQ ID NO: 259 - DNA, 972 bp, S.epidermidis
gggtttaatttgtacaatatactatcatacgctatgagtcatgcatttaactacaaaaccaataaaagtatctataatattttaacaggcaagaagtcacaccaaacgtttttcgatgcgtcaagccaacaacttttgtcattatatcatagtttacctaacttaaagtattcaacttttgagcaatttatactccaaaaggatgattttaaaaaatcaattcaagtaaaaatacatccacaatacacttatgatagtctcactcaaacctttagttgcatacaattacttatccaaacgttatctcatacacgcaaggagtcaaatacatttattccaatcgttcaaaatacctatatccaacaaagggttaaacaactttatcatcaggtcattgaatcaaatcaagtatcaaatactatagacgaaatatatttattatttgagaatttaaataataaatataaccatacatttcttcattattatttacaaggatatgaggaatccatgtatactagacaacaaataagtttaattgagggtataccacaatcagaattatttgaacgagaaatgaatgaactgattgacatattgaatcaattaaaagattcaacgaaatatccaatactttctcaagctatcattctttcaccattactaacaaatacatacttaagctatcaaaagttaaaatctggtctcaatttaaaagaaattgctcaattacaaaatgtaaaacttaacacaattgaagatcatattctagaaatgtatattaaaggttatttgatagactatacattatttataaataaaaaagatattctcgaatttataaactactatcaaaaacatcgcggtgaacgattaaaattttataaagaacattttactgattggacttactttcaaattaagttagttatagtaggaatagaaagaggtgatttaattgctgaaagataa

SEQ ID NO: 260 - DNA, 762 bp, S.epidermidis
gtggataatttgcaaagatattttatgaatcaaagcgctgatgaaaatcagtgcttttttattgaaaacaaagaagactatcatcatatcgtgaatgttatgcgctataaagaaggacaaaatattattgtcactttttcagatgaaaatgtattcaaatgtaaaattatttcaataaacgatcaatcgattgaaattaaattagtagaaaagcaacaaattaacactgaactacctcagaacattacaatatgtagtggtttaatcaaagcagacaaatatgaatggatgatacaaaaagcaactgaaatgggggcaaatgagtttatagctgtagccatggaacgttctgtggtcaagctcactgattctaaagtagaaaagaaattatcgagatggcaaaaaattataaaggaagctgcagaacaaagttatcgtttaacaataccaaatataaaatttaagtcgaatttaaaagaaatttatggtatgataagtcaatatgactatgttcttatagcatatgaagaacaagcaaagcacggtgaattaagtcaatttaagcaaacaattaaacaatttaagacacaggatcgtgttttaatcatatttggacctgaaggtgggctatcagatagtgaaatttcattattcggtgatgtaagtactatagttggattaggtccacgtatcttgcgtgctgaaactgcacctctttacgctttaagtgcagtaagttatgaaaaagaattattggggtga

SEQ ID NO: 261 - DNA, 2220 bp, S.epidermidis
ccaatgttttacattgctcttgcttttttggtaggggtactttggataaaattcaaagtaatctctatctccttaatattaactcttttgttactaattatgataaaaaggcttaatattataatactattattaatgtttatttcagctataagtttcttttttttaataagttcctataaccaaaccgaaattaaaaacataaatagtttatataatgaaccgtttattgatgattttgttactttcaaatcttttacgcctaaatcaacatactatactggcatattaaattataaaaataaagactatagatacttttacaaaatattaaagtcaaatttcaagcaagatttaactcataaaagttgtcgagttaaaggagaatttaaattcgaaaaagagttgtccttgttgaatatttcaacagttcaatttaagtcttgccaagaaaacaatattttcactcctatatatcatcatcaaaattatatcaccaaaataattcatatatctggggtcacgcatcctgaaagaatattagcgttgataacaggtgatacctctctaattgatgaatattacaaatctaacatcaaagatataggtatttaccatttactagctataagtggtacacatgttggtacaattattgtcctcgtttatcaactgttagtacgtttaaatatacctctagttctcattaaaggtgtaactattttactattattaatctacgctgtttatactggatttgtacctagtgccatgcgtgccatttcaattgcaatcattatacttatgttgccaatccattttaggaaaagttctatacatgtgctttcatttatatttgtgttaatgattctcttaaatcctcaatttataaatcacattggttttcagttctcttttttgataagtttatttattatattggcaaaaccatatataagtgctttaaaaccacttaaatgtttgtttattattagttttttggctcaattaggttcaattgtaattaatacctatcattttaatcaatttcaatggataggtttgctatctaattttatatttgttccattctattcttttatattatttccttcggtcattatctactttattttaattcacttttttcaacatagcttcctattaaatacttatataaatatgctttttaaaattcatgactggctagttcaattatttttaaatttaaatcatttaaagtggtacattcctaaattaaaccaatatagtttacttattttgattatactaacgttaatttttctttacatacttgtctatagagggtttgttacatccgtactaagttttttaattgttttaatcatttttacacatttaattagaccacattatgccgagttaacactttttgatgtgggtcaaggagatagcattttattcaaaacaaagtcaaataaaagtgttttgattgatacaggaggtaaaaaaaatgaaaatgtaagttttaaacataataatattgccaaatataaaattttaccaattattaaaaaaaagggtattaccactataaattatttagtaattacacatcctcatgccgatcatatgggtgaattaatatattttttaaataatattaatgtgaataatctcgttttaaatattgaaagtttcccattaaaattacttaaagaggttacgacaaaatgcaaggaaaaaaaaataaatatcttggatgtaaatcaagtgaaaaaaatagatattgataatagtaaaataagctttttaaatagttttataccattaattgatgataaaaatgaacattccattgttacattaattgaatataacggcattaatattctactgatgggagatgcaactgttaataatgaagacattctaatgaagagatataatttaccaaaaatagatattctaaaagttggtcatcatggaagtaggacaagtagttcgaaattatttattaaagatatagaacctaaaatcagtcttatatctagtggtaaaaataataagtatcatttacctaatttggatgttattcaaagattaaaatattatggtagtaaagtttttgatactcaagacaacggggaattaactataaatttagatgaagaagtttacatagtctaccgtgataatttaaatcaaaagagtttagctagagaaagtgtatcgtaa

SEQ ID NO: 262 - DNA, 513 bp, S.epidermidis
gagtgcatttacatgtttaaaaagttatttggaaaagctaaagaagttgacaaaaacattaaaatctacgcacctttgacaggtgagtatgtcaaaattgaagatattcctgatccagtttttgcgcaaaaaatgatgggagaaggctttggtattaatcctacagagggtgaagttgtttcaccgattgaaggcaaagtcgataatgtttttccaacgaaacatgccgtagggttaaaagccgaaaatggattagagttattagttcatatcggattagataccgttcaattggatggaaaagggtttgaagtacttgttgaaagtggagatgacattaaaataggtgacccacttatacgttttgacttagaatatattaataataatgcaaaatctattatttctcctattattattacaaactctgatcaaactgaatcaattcatattgaagacgtacaagcagtagttaaaggggaaacacaagttattgatgtgacagtaagctaa

SEQ ID NO: 263 - DNA, 465 bp, S.epidermidis
aaaagcatttatcgaatcacactggggaggctcaaaatgattaaaaaaaacaaagaagaactgaatgacatggagtatctagtcactcaagaaaatggtactgaacctccgtttcaaaacgagtattggaatcactttgaaaaaggaatttacgttgataaattgtccggcaaaccattatttacttcagaggataaatttgaatctaattgcggttggccaagtttctccaaagcattaaatgatgatgaaatcgtagaacttgttgataaatcatttggtatgattagaactgaagttcgatcagaaaaagcaaatagtcacttggggcatgtttttaatgacggacctaaagaaaaaggtggtttaagatactgtattaactctgctgcgattcagtttataccttatgataaactagaagagttaggatatggagatttaattaaacattttaaaaaatag

SEQ ID NO: 264 - DNA, 135 bp, S.epidermidis
agttcatttcttactgactccttaggtttgttttcatctacccatctattttacttgagtaaaagattcaattcaagcatgttcattaaacatcaaaacgtcggtatttatttaaatattttagagattgactaa

SEQ ID NO: 265 - DNA, 717 bp, S.epidermidis
gaggaaagttatatgtataatgaaatatttggtattgcgtcatttattgttacattcgctttaatggtactgatgtatcgctgttttggtaaacaaggactaattgcttgggtagcaataggaacgattatcgctaatatacaggtcataaaagcggttcatatttttggtattacggctacacttggaaatgtcatgtttgcttctatatatttagctactgatatattaaatgacatctatggtcgtaaagttgctaaaagagcggtgtggcttggtttctcttctaccttagtaatgattatagtcatgcaaatgtcattgcattttattcctgctccagtagacaatgcgcaaaactcattaaaaatgatttttgatttagttcctagaattgctataggttccattattgcttatatcataggccaacatattgatgtatttatattcagtatgattaaaaagatatttagctctgataagaccttttttattagagcatatggtagtaccattttaagttctatcattgataccggtttatttgtttcaattgcttttattggtactatgcctggtactgctgtttttgaaatatttattaccacttacttgttaaaactagtgtcaactatttttaatgtaccatttggatatatcgctaagtcactatatcgaaaaggaaagatagaacaactagataatgggtattga

SEQ ID NO: 266 - DNA, 732 bp, S.epidermidis
attctatcctactcttttttaatacatataaggagtttaaaaatgattaaccttaaccaaagattatcaattgtatgctcatttattaaaagaggaacattggctgatattggttcagaccacgcatatctacctatatatgcaattcaaaacgacttatgcacaaaagcaatagcgggagaagtgattcaaggaccttataaggctgctaaaagaaatattgcaaattatgaattaaatcaacaggttgatgtacgtctaggcgatggtctaagcgttataaactcagaagaccaaattgataatataactgtttgtggtatgggagggccattaattgcaaaaatattaaacgatggaaaagataaattagttaaccatccaagactcatactacaaagcaacatacaaactcaagcattaagacaaactcttaataaactttcatatgaaatcgttgatgaaagaatcattgaggaaaagggtcacatatatgaaatcgtggtagctgagtttaataataacttagttaaattaaatatattacaagaaaaattcggaccatttttacttagagaatgtaataacatttttcaaaaaaaatggcaaagagagttagaagcactgcgtgatataaaatcccaattgaattcaacatcacatcatgagagactaaaagaaatagaagatgaaattaacttaatacaagaggtgttaattaatgaaaattag

SEQ ID NO: 267 - DNA, 1059 bp, S.epidermidis
aggaacacctattcatattattccaagaaaaagaaattaaaaacaaaggggaattcaataatgagaaaaattacagtttttggtatgggtagttttggtactgcattagctaatgtattagctcaaaatggtcatgatgttttaatgtggggcaaaaatgtagagaatgtagatgaacttaacacacatcatatgaacaaaaattatcttaaagatgctaaattagattcatctataaaagcaactgtagatttaaataaggcagtgcaattttcagatatctatcttatggcactacctacaaaagcaattagagaagtatcaaaagatatcgatcaattactcacatctaaaaagacttttattcatgttgctaaaggcattgaaaacgatacatttaagcgcgtatctgaaatgattgaggactctatctcttcagaacataatggaggaatcggcgtcttatcaggtccaagtcatgctgaagaagttgttataaaacaacctacaactgtagctgcatcatctaaagataataatgtgagcaaacttattcaagatttatttatgaacgactatttacgtgtttacacaaataatgatttagtaggtgtagaattaggtggtgctttaaaaaatattatagctatagctagtggtatcgttgccggcatgggttacggtgataatgcaaaagcagctttaatgacacgaggtttagccgaaatcagtcgacttggtgagaaacttggtgcagatccaatgactttcttaggtctaggtggcataggtgacttgatcgtaacttgtacgtccacacattcacgaaattacacacttgggtttaaattagggcaaggcaaaacagcagaagaagctttaaaagagatgaaaatggtggttgaaggtatttatacaactaaatcagtatatcatcttgctcaacaagaaggagtagagatgcctatcactaacgcattatatgaagttttatttgaagatgtccctgtaagtaaaagtgttagaacacttatggaaagagacaaaaaagcagaataa

SEQ ID NO: 268 - DNA, 138 bp, S.epidermidis
agtaaagcctataatccacgtatttttattcataatgctgctcctttttatctaataatgcaacattcaatattctatcataataaagaaatattagtctatataaaatttcagaaaattaaaacattgtacaattga

SEQ ID NO: 269 - DNA, 180 bp, S.epidermidis
ttgccatctctgaaagatttgctcacttgtttgaactctaacatgtttatgattcctttctatccaattgctttaagtggatttatttttattatagacaacacagaaaatagactgcctaataaagaaataatgataagaacaattccatatatcaacatcgttaataaattaaaatga

SEQ ID NO: 270 - DNA, 573 bp, S.epidermidis
aagtatcaatatgatttaaatttattgttaccactcgttaaaattctaaaaaagaggtgttttagtaagatgattagattagcaactaaaaatgatttacttagtattactcaattagtcaaagaggctaaacagattatggaagaattcaacaacaaccaatgggatgatgaatatcccgcgaaagagcattttgaagaagacatcgaaaataaaacactatatgttttagacgttgatcatacaatttatggtttgattgtgatcgaccaaaatcaatcggagtggtatgatgacattgattggcctgttaatccaaatggggcatacgttattcacagattacctggatcaaaacaatataaaggtgctgccactgaacttttccaatttgccattgacttagcaaatgaacatgatattcatgtcattttaacagatacatttgccctcaataaacctgctcaaggattatttgaaaagtttggttttactaaagttgatgagatagagatagattatcatccttttgatagaggggcacctttttatgcatattataaaaacatataa

SEQ ID NO: 271 - DNA, 123 bp, S.epidermidis
aaaatcaaatacgtaatgcttttggttttgaaggaacacctattcatattattccaagaaaaagaaattaaaaacaaaggggaattcaataatgagaaaaattacagtttttggtatgggtag

SEQ ID NO: 272 - DNA, 1317 bp, S.epidermidis
aaagaaaaatataggagtttggttatgaaaactacgattaaacaagcgaaaaaacatcttaaccaagaagtaacaattggtgcttggttaactaataaacgttcaagtggtaaaatagcgtttttacaattacgcgatggtacaggatttatgcaaggagtagtagtaaaatctgaagtagatgaagaaacatttcaactagcaaaagatataactcaagaatcatctttatacatcacaggaacgattacagaagataatcgttctgatttaggctacgaaatgcaagttaaatcaatcgaaattgtacatgaagcacacgattatcctattacaccaaagaatcatggaacagaatttttaatggatcatcgtcacttatggttacgttcaaaaaaacaacatgctgtcatgaaaataagaaatgaaattatccgtgcaacatatgagtttttcaatgaaaatggcttcactaaaattgatccacctattttaacagcaagtgcaccagagggaacaagtgagttattccatacaaaatatttcgatgaagatgcattcttatcacaaagtgggcagttgtatatggaagcagccgcaatggctcacggacgtgttttttcatttggcccaacttttcgtgcagaaaaatctaaaacacgccgtcatttaattgaattctggatgattgaaccagaaatggcctttacaaatcatgcagaaagcttagaaatacaagaacagtatgtgtctcacattgttcaatctgttttaaatcattgccaattagaactcaaagctttagatagagatacaactaaactagaaaaagttgctacacctttccctagaatttcttatgatgatgctatcgaattcttgaaaaaagagggattcgatgatattgaatggggtgaagactttggtgcacctcatgaaacagccatcgctaatcactatgatttaccagtattcattacaaattatccaactaaaattaaaccattctatatgcaaccaaatccagacaatgaagatacagtattatgtgctgatttaattgcgcctgaaggttacggtgaaattattggtggttccgaacgtattaatgatttagaattattagaacaacgcattaatgagcacgaattggatgaggaaagttatagctattatttagatttacgtcgctatggtagcgtaccacatagtggttttggcttaggcttagagcgaacagtagcttggatttctggagttgaacatgttcgtgaaacatccccattcccacgtttacttaatcgcttatatccataa

SEQ ID NO: 273 - DNA, 315 bp, S.epidermidis
tataatgaatatcattataaaacctcaggaggtgaattcataatgaataaaactgatttaattaatgcagttgcagaacaagctgacttaactaaaaaagaagctggttcagcagtagatgctgtatttgaatctatccaaaactcacttgctaaaggtgaaaaagtacaattaatcggtttcggtaactttgaagtacgtgaacgcgctgctcgtaaaggtcgtaaccctcaaacaggtaaagaaattgacatccctgcaagtaaagtaccagcatttaaagctggtaaagcattaaaagatgctgtaaaataa

SEQ ID NO: 274 - DNA, 630 bp, S.epidermidis
cacttgagatataacatttcacgtatatttggagtgttagtgggtataccagtggcctttattgtttggcttattactgtttttgcgttggatttatcattcattatagacatgcttatcagttttggtagtttcattgcatcatacttccctacgcaaaggctcacttcacgaaagtatcttaatgaaattggtttatcaagaagagattacagatatgttcaatcacagcttcatcatgcacatactaaaattagaaatatcttaaagtcatttattaatattcgttcaatcaaagattttagacaagtaaatgatatatatcgaatttctcgttctattcatacaagcattaagcaaagacccgcgatgttttttaaagttgaaagctttttctattctcatttggataatgcacttaacttagtagactcgtatacacgtcttgcaagaatgccacgtaagtcgcaagatgaaaagctaaaattagaacaaacacgtattactctagatgaaataaagagaacgctcattgctgaccttaaaaggcttaatgaggaagattatgagcgactagatgttgaaatagaattaaataaattagaacagcaacgtcgacataataattaa

SEQ ID NO: 275 - DNA, 1725 bp, S.epidermidis
gaaactggatacatcactatattaaggagaatgtacatgtttagaaagtctatgctcatcttaatgattgctgtcattttgttcgtaacagcatgtagcaaagataaaacgcaagatgaagcgaaaagaaaagcagatgctaaaggtaaaccagatacatggattgcagatagaaagcttaaaggacttgtgtttcaaagtgataacgatgcctcccctaaaatgaataaagaagtcgctcaagaacttaagaaaaagactggcatcacgttagaacttcaaaccgtttctaatgaagattccacagaagcattaacttcaggactcgcttcaggagatttacccgacttcatcgtttattacttagacgatagtggaagacctgaaatgaaagtactaaataaagcagcgaaacaaggtcgactcacagacttaacgaaaatgcttaaaaacacaaaaatttatagtaagtatttcaaaaaaggatatttaccaaaagatacgaaagataacatcatgtttaataaagaacaagatggaacgtaccttgtacatatggggattaaccgtcatccaggacaagaagaacgtcgcactgtaggtggtccttacgtcagaaaagatatcatggataaacttcatatcgaccctacttctatcaagacgtccaaagatgtagaaaaacttgctgaaaagatgaaagaacaccacttcaaagatgataatggtaaagaaatcacacctattggcccaacagcgtggggcggtgacgatcgtactaaattctataatgaccttgtgtggactggtcagtctgatgagaaatttttaaataaaggtaagaaaattatacatgaatcacaaaccgaatatccacttaaacgtgtacattacgttaaagaccttatgaagaaaggcttaatgacaaaagagttctatacaatggaagaaaataaagcaaaagaaggactcgttaatggctcatggggcattgtttcagatttacataactatgttactgaaaatcaaagtatgaaatacgttcctcttgggccactcaatacagtcaaaggtaaatttagagttgaaaagccatataaatcaggcgcaaacggttgggctgtaccaagtacgactgaacatcctgaagacgtcgttaaactcgctgatttccttgcaagtcgcagaggtaaattactcggtcagtacggtattaaaggacgtgactatacgttagataagaaaggtaaccctcatgttaaacctgaagtgttaaaagaagttgaaaataatccagacgaagctaaaaaacgtggttttagaggtgcgggttcttattgggcagatcatcttggttatactgatatagataataaagctgatttcggtgaaactgaatacggagataatacaaaaacgaaaaagacgactcctgaaaagattgctgatatgtggcattatgatcaaagacagaaacacgccaaaatcgtaaacggactcacagtaaagtcattcttatctaaatatgaatatggcgaagatttagaagttgcactcgatgattatagtgacgctattaaacgtgcttattattctcaatcagacaaggaaacgaaacaaattattgatagtgctaagcaacgtttagaagaggcaggcttaaatcaatttgaaagatacgttgaaaatcaaagagataaaaaaggaactcaaattatttattaa

SEQ ID NO: 276 - DNA, 774 bp, S.epidermidis
ataattatgtataaaagaaatgaacgtttgaatcttattcgtaaacgtgttgatcagtacggacaggtggcagtaaaagatttagctatattcttacaagttacgcctgaaaccgtgagaaaagatttagaaaccttagaaaacgataaactgattacacgtacacatggaggtgcgatacaatacaatcatattaataaagagaaatcatatgcgaataagtggcagaaacaatcacaagtaaaagagcgtattgctaagaaagctgctttgcaaataaagtctggagaaattattgtcatcgatggtggaaccacaacagggcgaattcctcaatatctcaatgatattactcagaccacgattgtgacgaattctctgaagattgcggatgaattgaatcgtgctatagaggagcaacgaattcaagcagaagtgattatgcttgctggaaagacgaatactgaacaagatgttgtgcgcgggcatatgacgaatgagttattacaacgttttaaatttgataaagcttttatttcatgtggttcgtttgatacgagtgattgttatgaatttgatctggaagaagcgcatgcaagtcacattatgattcaaaaaagtcaactgagttatctcttagcggatagtagtaagcgagatgcgcatgcgtcgtatcgtattgatggttttagcgaaattgattatatgatttctgattatgctaaacctcagaatatagaatattttaatcagaagcattggttacagatttaa

SEQ ID NO: 277 - DNA, 273 bp, S.epidermidis
ggagtgtcgtatatggaaaattttgataaaacaatgaaatttagttatgaagaaattccaaaggaagatgtcaaatcagttcttcagaatgtccatcgtacattagaagaacgtggatataatgcagttaatcaaatagtgggttacttattatctggagatcctgcatatattccacgtcaaaatgaagcaagaaaccaaatacgtcatatagaccgtgatgtaattatggaagaactcgtttcaaactatttaaaagagtctaagaattaa

SEQ ID NO: 278 - DNA, 171 bp, S.epidermidis
gattatcagtattatatgaatcgtgtttcgaatttcaactcgatagatttgttgaattttagaatgaaattcttcgagttgtgttcacctaaatttagttgggacaaacttaatataaatgagtttttcaaattaattaagttatggactaccaatactaccaatgtatag

SEQ ID NO: 279 - DNA, 1278 bp, S.epidermidis
aataaaaatctccttgtttgtctaactgacttatgttgtgtgattgaatatgataatatattaaacatattacaatttaatgtattgaagaatagaaaggggcgtgcgatcatgagataccttacatccggtgaatcacatggaccacaacttacagtcatcatagaaggtgtaccagctaatttagaaattaaggctgaagatattaataaggaaatgtttaaacgtcaagggggatatggtcgggggcgtcgtatgaaaattgaaaaagatactatagaaattgtgtcaggcgtcagaaatggctttactttaggaagtccaataactttagtagttactaacgacgatttcactcattggagaaaaataatgggcgtcgcaccaattagtgatgaagaaagagaaaatatgaaacgtaccattacaaaacctagaccgggccatgctgatcttataggtggcatgaaatataatcatcgtgatttaagaaatgtgcttgagcgttcatctgctagagaaacagcagcaagagttgctgtgggtgctgtttcaaaaattcttttagaacaattagatatccacttatatagccgtgtagtcgaaattggtggtattaaagacaaaggtttatatgatgtagatatgttcaaaaataatgtagataaaaatgatgtacgtgtaattgacgaaaatattgcgcaacaaatgagagataaaatagatgaagcgaaaaaagacggagattcaatcgggggcgtagttcaagtaatggctgaaaacatgcctattggagtgggaagttatgtacactatgaccgtaaattagatggacgcattgcacagggtgttgtgagtatcaacgccttcaaaggtgtaagttttggtgagggatttaaagcagctgaaaaacctggtagcgaaattcaagatgaaattcattataatcaagattcaggctattttagagctacaaatcacttaggtggatttgaaggaggcatgagtaatgggatgcctataattgttaatggtgtcatgaagcctattcctactttatataaaccactaaactcagttgatattaatactaaagaagacttcaaagctactatagaacgctcagatagttgtgcagtgcccgcagctagcgtagtatgtgaacacgttgtcgcttttgagttagcaaaagcagtactcgaagagtttcaatctaaccacatggaccaactcgtagcacaaattaaagagcgtcgacaactcaacatagaattttaa

SEQ ID NO: 280 - DNA, 1116 bp, S.epidermidis
ttaaatcttcaaaggagcaaagacatgatacaaatcaaggatttaaacaaagtttacgacaatggtagttacgcagttaaagatttcaatttagatattgaggacaatgaatttgtagtatttgtaggaccttcgggatgtgggaaatcaacaacgttacgtatgattgcaggacttgaagatgtgagcaaagggacaattagtatcaacgataaagtaatcaacgatttacaacctaaagatcgtaagattgctatggtctttcaaaactatgcattatatccacatatgacagtttataaaaatttagctttcggcttaaaaatgcgaggaatcaagaagaaaatttatgacgaaaaaattcaacatgcagctcaaatattagaaattgaaaacctcctcgaccgtaaacctaaagccttatctggaggacaacgtcaacgtgtggcacttggtcgagctatcgttagagaagctcaaatctttctcatggatgaaccactttctaatttagatgctaaattacgaagtaacatgagaagcgaaattataaaaatacataaacaaatgaaagcaacaacgatttacgtgacacacgaccaaactgaagctatgacaatggcatcacgtatcgtcatattaaaacaaggcgaaatacaacaaattggtacgcctgaagaaatttatcgtcatcctgtcaatgaatttgttgccactttcattggtagcccatcaatgaatatggttccaatgacctacaacatggatgcttggtacttcgatggacaaaaagtggctgatgctacattacttcaacttgcatcgcatgcacaatacagacttggtatacgacctgaagacttacatcttgttaatgataacgaaataagtaattatccaatccaactttctcaattcactgtagacttagttgagttaactggttcatacaaattacttcactgtcatcacaatgagcataaaatcatagcagctgtagatagtaatttggattttgaattaggacaaacagtttccttcggtataaaaacggaagatgcacactttttcgattctgattcaggcgaaagagtacaagaggaggttttatcatga

SEQ ID NO: 281 - DNA, 138 bp, S.epidermidis
aaaaagattcattgtaaaaagatttctattataatgaaagatcttaaaataaatttatcaataaaaagctcctatcttttgttgttaaaacttaagataggagctttattcgtattcaaaatttttacttataactaa

SEQ ID NO: 282 - DNA, 132 bp, S.epidermidis
attgttgttcaaaatgctattgtgataaatgaagagcaaaccgaaattaaacggtcggaacatctgctcttttttattgagcaaatgtatgagttattcattgtcaaaattatcaacattaaaaacgtataa

SEQ ID NO: 283 - DNA, 612 bp, S.epidermidis
aaggtagttcatactaagatgtatcaatggctttgggaaacttcactttatcaaaaatggttgatttcttttattttaatttgcaatatatttggtacgatatacggttatcattggtatagtagtcaattagctaacacaccaaattattttaaattatttgttccagatagtcccactgctacattatttttatgtttatcattattattcatactatttaataagcgttatgccctgattgacgctttagcttttataactctatttaaatatggtagttgggctgtaattatgaatattttgatgtttataaaaatgaatgatattgccataaacggacttatgttgctcatttctcacgcaattatgatattagaagctatctatttttatcctcgttttaaaatatctaaattggctggattgatgagtttcatatgggtgacgatcaatgacgtaatagattacatatacggacaatatccctactatgattttatcgccaaacatttaattgaagtaggggtattggcttatagtctcactatcatttcgtatattttatttttaaaattacaaaagtggttgaaagttaaaacatttgattaa

SEQ ID NO: 284 - DNA, 1005 bp, S.epidermidis
aatttatctcatgttgatgaaacattaaatttacgtaacttgaaaaggagcgcgtttatgccaggaataattcaaattgacgatattaatcaatctcaagctttaataggaaataacgatgaaaacctaaaagcgattgaagcacattttaatgtcgtaatacatgctagaggtcaagaaattgctgttaaaggtgaaaaaatagagcatgttgaaaaagcagaattagttctaaagaatttacttaaagtaattgaattaggtaatacaattacgcttaaagatgtagaagctgctataaaaatggccgacaataatacaattcatcatttattagatttatacgatgaagaaattacaaaagatgcttatggtaaaacaattcgtgctaagactatgggacaacgtatatatattaatgctatgaaacgtaatgatttagtatttggcattggtccagctggaactggtaaaacctttttagcagtcgtatatgcggctaaacaactacgtaaaggatctgttaagcgtattgttctaacgagacctgctgttgaagcaggtgaatctctaggatttctaccaggcgatttaaaagaaaaagtagatccatatttaagacctctttacgatgggttaaatactgttttaggtagagagcaaactcaaagactcatcgaacgaggtgtaatagaaattgcgccattagcatatatgagaggtagaaccctagatgatgcatttgttatattagatgaagctcaaaatacgacacatgcacaaatgaaaatgtttcttacccgcttaggatttggatcaaaaatggttgtcactggtgatcaaactcaaatcgatttaccaaaaggtgtaaaaagtggtttgaaagaagcggtaaaaaaactaagtggtgtcagcggcataagtatcatgaaaatggatcaaagtgatgtagttagacatccacttgtaagtaaaattattaatcgttatgaaggagttgaataa

SEQ ID NO: 285 - DNA, 141 bp, S.epidermidis
ttgataactcattacattcctcccttaaatatttctaatatatatggtaaaaaaacgattaacccaatacatattgaaacgattgaaacgatgacaacactaaacgcagctatatctttagcgtattttgcatattcatga

SEQ ID NO: 286 - DNA, 276 bp, S.epidermidis
catttttatcaaaggaggcgaataaatatggcaaaatatacaatcgttgatatggatacatgtatagcatgcggtgcttgcggtgcagctgctccagatatatatgattacgatgatgaaggtattgcatacgtaatccttgacgataaccaaggtactactgaagtgcctgaagagttatatgaagatatggaagatgcgctagaaggttgtcctactgactcaatcaaaattgaagacgaaccatttgatggtgacgcactgaaatttgaataa

SEQ ID NO: 287 - DNA, 888 bp, S.epidermidis
ctacggcatcaacggactctatcggtacgcaagacttttgtcttgcgtatttttatgtatataattataaagaagcatagatataatgaattggaatcaaaggagctaaagatgaaacatcaattttcaaggaatgaattagcaataggacaagaagggctgaacttactaaaaaataagactgttgcagttttaggtgttggtggcgtcgggtcatttgcagctgaggcattggctcggactaatatagggcacatcatacttatagataaagatgatgtcgatattacaaatgtgaacaggcaaattcatgcactgacttcaactattggtcaaagtaaagtcacgctaatggaagaaagaatcaaattaataaatcccgattgtaaagtaacttctttgcatatgttttataccgaggaaacatacaaagatatcttcaataattatgatattgattattttattgatgcaagcgatacaatcatttataaagttcatctcatgaaagagtgtttagaaagaggaattgagttaatttcaagtatgggtgcagcaaataagactgacccgacacgttttgaaattgcagatatttcaaaaacacatactgatcctatggctaaagtaattagaaatcgtttaaaacgccttggtattcgtaaaggtgttaaagtagtattttctgatgaaagtcctattgttattcgcgaggacgtaaaagaaacagtaggagataaaaatgcaatcaatagaaaagggcaaatgcctccatcttctaatgcatttgttccaagtgtagtaggccttatttgtgcaagctacgttgtcaacgatattttaaaagatatacctgtaaggcgaattaaagataaaggacaaaattaa

SEQ ID NO: 288 - DNA, 198 bp, S.epidermidis
agaagtaatcaaggaggcatgagtatgtctaatttatggattatatttgcagttactgtactaatagcagtttattccgcaattgaagtatttacaaatttaaatcataaacaacaaccaagatttaaatattttactatcgcatttgttgtgtttattatcttagcgattatagaagttatatttcttgctcaatga

SEQ ID NO: 289 - DNA, 240 bp, S.epidermidis
aaattaaatcaaaaacaaacagaacctaagataacatatatacttcaggttctgctaacaaatagggcattgatgtctaaatttagcccttttattaagatttatttaactttggtcgtaggtcctatcattgagaatttcgctcgaaaattctacggacaaaccaaattgaatttcgaagctagttcagcacatggaactctgattcgcttttgtataactatatttctgatacaataa

SEQ ID NO: 290 - DNA, 1332 bp, S.epidermidis
ggagggtgtcaattggatataaaaatgcctaagcttggtgaaagtgtgcatgaaggtacgattgaacaatggttagtatcagtaggagatcatgtagatgagtatgaaccattatgtgaagttattacagataaagtaacagctgaagtgccttcaacaatttctggaacaataacagaattagtggttgaagaaggacaaactgtcaatattaacacggtgatttgtaaaatcgattcggaaaatggtcaaaatcaaacagaatcggcaaatgagtttaaggaagaacaaaatcagcattctcaatcaaatataaacgtgtcacaattcgaaaataatcctaaaactcatgaaagtgaggtgcatacagcctctagtcgcgcaaataacaatggacgattttcaccagttgtctttaaattagcttctgaacatgatattgatttaacacaagtcaaaggaactggttttgaaggtcgtgttactaagaaagatattcaaaatattattaacaatccaaacgatcaagaaaaagagaaagaatttaaacaaacagataaaaaagatcattcaacgaaccatggtgactttttacatcaatcctcaactaaaaacgaacactcaccatcatcaaatgaacgtgtcgtaccagttaaaggtattagaaaagctatcgcacaaaatatggttactagtgtcagcgaaataccacacggttggatgatggttgaagctgatgcaacgaatttggttcagactagaaactatcataaagctcaatttaaacagaatgagggttacaatttaactttctttgcgttttttgtaaaagctgttgcagaggctttaaaagtaaatccattactcaatagtacatggcaaggagatgaaattgttatccacaaagatattaatatctctattgctgttgcagacgatgataagttgtatgtgccagtcattaaaaatgcagatgaaaaatcaattaaaggtatcgcgcgtgaaatcaatgatttagctactaaagcaagattaggaaaattagcacaaagtgatatgcaaaacggtacatttacggttaataatactggttcttttggttctgtttcttcaatgggaatcattaatcatccacaagctgccattttacaagtagaatcagtcgttaagaaacctgtagttatagatgatatgattgcaattagaaatatggttaatttgtgtatttcaatcgatcatcgtattctcgatggtgttcaaacgggaaaatttatgaatcttgttaagaaaaaaatagaacaatattctattgaaaacacttctatttattaa

SEQ ID NO: 291 - DNA, 696 bp, S.epidermidis
aaaataagtcatatactaaaaatgtatcatattttaattagaaaggggcttttaaatatgaagactgttttgattgtaggcgcaaatggtagagtatctatcgaagcgacaaaaattttcctagagaactcaagatttaatgttgatttatttttgagaaatgcgcatcgtatacctgattacgcctctaatagaattaaagtttatgagggagacgctaaaaatattgaggatttagaaagtgctttaaacaatgttgatgttgtttttgcaagtttatcgggatcacttgataaacaagctgaaactatcgtaaaagccatggataacaaaaatgttaagagactgatttttgtagcagctcctggtatttatgatgaactaccagaaccattcaatcaatggaataaagaacaatttggcgaaaaattgaatcgctaccgcaaagcatctgatattatagaaaattcagatttagattacacaataatacgtccaggctggcttacagataaaaatgaaaatgtatatgagatcacagcaaagaacgaaacatttaaaggtactgaagtatcacgtaaaagtgtagcatctttagcagtacaaattgccaaaaacccagaactacactctaaagaaaatattggtgtgaataaacctaatacagaaggtaataaacctgcttggttcaattag

SEQ ID NO: 292 - DNA, 1350 bp, S.epidermidis
atattgagtcatcgttatataccattaacagaacaagataaaaatgaaatgctaaatagtattggggcaaaatctatttccgaattatttgatgatatacctacagatattttattaaaaagaaatttaaatattgccgaaagcgaagcggagacgatattacttagaaggttaaatcgtctcgcagctaaaaatacaactaaagaaacacatgcaacatttctaggtgcgggcgtttatgatcattatactccagctgttgtcgatgcaatgatttcaagatctgaattctacaccgcatatacaccttatcaacctgaaatttctcaaggtgagttacaagcaatttttgaatttcaaacactcatttgtgaattaacagatatggatgtagcaaattcttctatgtatgatggtatgactagttttgctgaagcatgtatattggcactaagtcatacaaaaaaaaataaaattgtagtttcaagtggactacattatcaagctttacaaattctacacacatacgccaaaactcgtgatgaatttgaaataattgaagttgaccttaaaggtactattactgatttagagaaattagaacaacttatcgatgacaacacagcagctgtcgctgtccaatatcccaatttttatggttctattgaagatttagaacaaattaataactatataaaggataaaaaagctttatttatcgtatatgccaatccactttctttaggattactaacacccccaggtacattcggggcagacatagtagtgggagatacacagccttttggtattcctacacaatttgggggtccgcattgtggatactttgctacaacaaagaaattaatgagaaaagtacctggtcgattagttgggcaaactcaagatgacgaaggtaatcgtggatttgttctcacgttacaagctagagaacaacatatccgccgtgataaagcaacttctaatatttgttcaaatcaagctttaaatgcacttgcatcttcaatagcaatgtcagctttaggtaaacaaggtatttatgaaattgcagttcaaaatcttaaaaatgccaattatgccaaaaataagtttgaagaacatggttttgaggtactaaaagcacaatcttttaatgaatttgtagtcaaatttaatcaaccaataaaaaatattaatcttaaattagcagaatatggatatattggtggttttgacttaggtgaagtatctgatgattttaaaaaccatatgttagtagcagttacagagttaagatctaaagatgaaatcgatgatttcgttacgaaagcaggtgagttaaatgattag

SEQ ID NO: 293 - DNA, 1416 bp, S.epidermidis
agaaaaatccatagaaacagtacgtggcgtagggtatgtgattcgatgattaagcgccaaaaattaaaatataaatggatgcttattacgacgctcattaccttcacgacaatattacttttctgcttaattattattttctttttaaaagatactttacgaagtagtgaaattgacgaagctgaaagaagttcaaatgatatcgccaatctgttccattctaaatctttaagtgatatatctgcattggatttaaatgcatccttagaaaattttcaagaaatattgatttatgatgataagggtaggaagttaattcaaacatcaaatgataatacacttgcttatgataacaaaattgatttcaaacatcctgaacgtatacatattcaaagaagccacggtattaattacttagtaataactgaacctatacgttcgaaagatttttctggatacagtgtattagtccattctcttcaaaattatgataatctcgttaaatcactttatatagttgcacttgcttttggattaattgcaaccattattactgccggcgtgagttatatcttttcttcacaaattactaaaccgatagttacaatgtccaataaaatgaatcaaattagaagagatggttttcaaaataaacttgaattaactacaaattatgaagaaacagataatttaattgatacttttaatgaaatgatgtatcaaatagaagaatcttttaatcagcaacgtcaatttgtcgaggatgcttcacacgaattaagaacgccactgcagattattcaaggtcatctaaatttaatccaacgttgggggaaaaaagatccagcagttttggaagaatctttgaatatttcaattgaagaagtgaatcgaataacaaaacttgtcgaagaactacttttacttaccaaagatagagtcaatcataatgttttggaatgtgaaaatgtagacgtaaatagcgagattcaatcacgtgtgaagtcactgcaacacctacatccagattatacttttgaaacacatcttgctactaagcctatccaattaaaaattaaccgtcatcagtttgaacaactcttactcatatttattgataatgcaatgaaatacgacactgaacataagcacattaaaattgttactcaactaaaaaataaaatgattatgattgatattactgatcatggtatgggtataccaaaagctgacttagaatttatctttgatagattttatcgtgtagataaatcacgtgctcgtagtcaaggaggcaatggattaggactatcaatagcggaaaaaattgtgcaacttaacggtggtatgattcaggtagaaagtgaactacaaaagtacacgactttcaaaatcagttttccagtactaaactaa

SEQ ID NO: 294 - DNA, 1095 bp, S.epidermidis
acaaaatgtctaaagaaggtgttatatgtgaagaagttgtcgataaatacatttaaatataagaggaataaatatcttactgaaatacaatcaatagacttactacagagattacaacagcttttaagtcacggattcactttatatcaaagttttaaatttttaaactcctattttaaatataaagagcgaacaataaataaaaagattatccaacatctacaaaacggtgctacatgttatgatattttaaaaataatagggtatccagaattagttcttcttcaaataaaatttgctgaaaactacggcaacattgaggaggctctcgttgatactgttcaatatatgaaaagaaatctgaaagctaaaaaacgactcatcaaaaccttacaatatcctgttgcattaatttctatcttcttattcatattaaccattttaaatataactgtcatacctcaatttcaacaactttatgagactatgaatgttaaattatcaacatttcaaaatctactaactcttattattacccgtcttcccaaactaactttcatttttatctttattagtggtatagcattttttatcacttataaattctactattatctaccaattgagaaaaagttaaaatctattttaaaaatcccaatgattaatacgtattataaaatatatagaacttatcaactttccaatcaactttctttattttacagaaatggtacaagtcttcaacaaattgtccgtatatatcgtaatgagcaagataacgattttcttaaatttctgggtgattatctttttaaagaagctaataaagggctcccgttacctgttatattaatgaatttaaaatgttttcaaaatgatttgattaaattcatagaacaaggagagaaaaatgggaaattagatatagaattaaagttatacagtcaaatgctattacagcaatttgaagaaaaagtgttaaaacaaacaaaatttatacaacctatcatcttctttatcttgggaatttttattgtatctttatacttagtcattatgcttcctatgtttgaacttatgcaaacaataaaataa

SEQ ID NO: 295 - DNA, 732 bp, S.epidermidis
aatatgtcccaaatgatgtttgacaatttcctctcaagttctcgcgcaaaatggggtgagcgttcaggtttaacacttttcttaccacatgtttttgaaggacagggaccagagcattcatcggcacgcttagaaagatttctacaattagccgctgaaaataattcaactgtagttaatctatctagtgcaagtaattacttccatttactacgtgcacaagccgctagtttagataccttagaaatgagaccattaattgtcatgtcacctaagagtcttttaagaaataaaacagtagctaaacctattgatgagtttacatctggcggttttaaacctatcatcacagaagatatcgatgaacaaaaagtcaaaaaagtgattttagcatcaggaaagatgtatattgacctaaaagaatatttagctaaaaatcctaacgattctattcttctcatagcagtagaaagattatatccgttcccagaagaagaaattaaagaagtattaaaatcgttacctcatcttgaaaatgtgtcatgggttcaagaagaacctaaaaatcaaggtgcatggttattcgtgtatccttatctaaaagcacttgttgctaataaatatgatttaacttatcacggtagaatacaaagagctgcacctgctgaaggcgatggagaaattcataaacttgtacaaactaaaattattgaaagtagcattaacaattaa

SEQ ID NO: 296 - DNA, 150 bp, S.epidermidis
acattttaccataattcaaagatttttataagaggcaattatacgaatatgtctccaagcattattattagtagggtaaatttaaataattctaatattaaaatgcctgggacagcattgattgtctcaggcattttgaaagtaatttaa

SEQ ID NO: 297 - DNA, 1782 bp, S.epidermidis
aaaggaagtctaaaaatgaataaaagaacaacgtattgtggtttagtcacagaagaatttttaaacgaaaaagtaacattaaaaggttgggttcataacagacgagatttaggtggattaatttttgttgatttaagagatcgtgaaggtattgtccaaatagtttttaatcctgacttttccgaagaagcattgcaagttgctgaaacagtacgctcagaatatgtagtcgaagttgaaggtgtagtaacaaaacgtgatgctgaaactattaacccaaaaatcaaaacaggtcaagttgaggttcaagtttcaaatattgagattattaacaaatcagaaacacctccattttcaattaatgaagaaaatgtaaacgttgatgaaaatattcgattaaaatatagatatttagatttacgtagacaagaattagcgcaaacttttaaaatgagacatcaaactacgcgttctatccgtcaatacttagataataatggcttcttcgatattgaaacaccagtattaacaaaatcaacacctgagggtgcgcgagattatctagtaccttcccgtgtacacgagggtgaattttacgcgttgccacaatcaccacaattatttaaacaactattaatgataagtggttttgataaatattatcaaattgttaaatgtttccgtgatgaagacttacgtgcagatcgtcaaccagaattcactcaagttgatattgaaatgagttttgtcgatcaagaagatatcatagccatgggtgaagatatgttacgtaaggttgtaaaagatgtaaaaggaatagacgttagtggcccattcccacgtatgacatatgcagaggctatggaccgttttggttcagataaacctgacactcgtttcggtatggaacttatcaatgtgtcacagcttggtaaagaaatgaattttaaagtttttaaagatacggtagataacaacggcgaaattaaagcaattgtcgcaaaagacgctgcaaataaatatacacgtaaagacatggatgcattaacagagtttgtaaatatatatggtgcaaaaggattagcttgggttaaagttgttgatgatggtttaagtggcccaattgctagatttttcgaagatgttaatgttgaaacacttaaacagttaacagaagctaaacctggagatttagtaatgtttgtagctgataaacctaatgttgttgctcaaagtttaggggctttaagaattaaattagcaaaagaattaggtttaattgatgaatcaaaattaaatttcttatgggtaactgattggccgttattagagtatgatgaagatgcaaaacgttatgtagcagcacatcatccatttacttcacctaaaagagaagatatcgaaaagctagacactgaacctgaaaatgtacaagccaacgcttatgatattgttctaaatggttatgaacttggtggtggttctataagaatacacgatggtgaattgcaacaaaaaatgtttgaagtattaggatttactaatgaacaagctcaagaacaatttggtttcttattagatgcttttaaatacggtgctccacctcatggtggcatcgcgttaggtttagatagacttgtgatgttattaacaaatagaacaaacttgagagatacaattgcattccctaaaacagcatcagctacatgtcttttaactgacgctccaggagaagtatctgataaacaactccaagaactctcactaagaatcagacactag

SEQ ID NO: 298 - DNA, 138 bp, S.epidermidis
aagttaaaacatttgattaaagacaaatttgacagtaaaatgaaaataaaggagagtgagtttaatgtctttaatatcaatgattatatatttcgtaatattaatggtcattccaatgtgggctcaacacaaagttaa

SEQ ID NO: 299 - DNA, 150 bp, S.epidermidis
gaggacttgcaaaacgagaaacagggcacccacctgtatatagcaggccgaatgatcaagctatttataactacggcatcaacggactctatcggtacgcaagacttttgtcttgcgtatttttatgtatataattataaagaagcatag

SEQ ID NO: 300 - DNA, 147 bp, S.epidermidis
agtaaacttttttcaaatttaagttttcgtaaatcaaaattttttgtttgtaatttttcaaaaaacaaaagacttaaaacatttataagacaacattttaagtcttttattaacaaaaatgaaaacaaagaaattaatataagataa

SEQ ID NO: 301 - DNA, 567 bp, S.epidermidis
cgtaaatttaaacaaacagataacttaaggagggaatataacatggcatatgcgacactagctggaggttgtttttggtgcatggttaaacccttcacctcatatcctggaataaaatcagtcgtttccggatatagtggaggacatgtagaaaatccaacatacgaacaggtatgcacaaatcaaacaggacatgtggaagctgtacaaattgaatatgaccctaatattacaacatttgaaaatatcttagacgtttactttaaaacatttgacccaactgatgacggagggcagttctttgatagaggtgaaagctatcaacctgtcattttttatcatgatgagaatcaactcaaagctgccgagttaaagaaacaacaaattgacgaagagggtatctttaaaaaacctgttatcacaccgataaaaccatataaaaatttctatcctgcagaagaatatcatcaagattactacaaaaagaatcctacgcattatgaacaataccaacgtggatctggtagaaaagcatttatcgaatcacactggggaggctcaaaatga

SEQ ID NO: 302 - DNA, 144 bp, S.epidermidis
aatcgatttaatccctttaaagtaaccacttataaaagtgaaaactttgaagggatttttcatttactttttttatcattaaataccaacttaatgacattagtaactataaacgttataatgttaagtgaacgaaatgggtga

SEQ ID NO: 303 - DNA, 168 bp, S.epidermidis
gaacttattaaaaaaaagaaacttatagctgaaataaacattaataatagtattataatattaagcctttttatcataattagtaacaaaagagttaatattaaggagatagagattactttgaattttatccaaagtacccctaccaaaaaagcaagagcaatgtaa

SEQ ID NO: 304 - DNA, 1461 bp, S.epidermidis
atgaatattaataaactttattggaaggctttatactactggattaggtatcttaattataatgtaatttatcgtgataaagaggacgatgaaatatggttgtctcataagagaaaacattcaattgttgtatttagaaaagatgtcacatctacccaagagattaggtttgataaatcaaaaattatggaacgacctgaagaaatacaacaattcatcggttatatacctgaatcttatgaattttattattttacggataaagagctttcaaaagaaaatttaaatgaagaaaaaccaattaaactgaaatttaaaattataagcaatgagcaaagcttaaattcactccctataaactttttacttttaaaaatgctaattaataatgaagataaaaggacttaccttcattacaaaagaaaagttttaacacaaaatcttgttgataaacatatgcaacgttttacccctattacatatacacttatcttaattaatattgtgatatggttatgtatgattttatacttaaatcgattttctgatgttaaactattagaagtaggtggacttgttcattttaatgttgttcacggagaatggtatagacttatttcgtcaatgtctttacattttaatttcgaacacattttaatgaatatgctctctctatttatttttggtaaaattgtcgaatcaatcattggatcatggcgaatgctaataatttatataatatccggattatatggaaattttgtttctctatcatttaatacgactacaatttcagtcggtgctagtggagcaatatttggtctaattggttctatttttgtgattatgtatttaagcaagaattttaataaaaaaatgattggccagttattaattgctttggttgttttaatcgttttttcactttttatgtctaatattaatataatggcacatttaggtggatttatcagtggtgtattaattacattaataggctattatttcaaaacacaacgctctttattttggtcatttttgattgtatttttacttatattcatcattttacaaattagaatatttactataagtgaggataatatctatgataaattaattcgggatgaaatgattaaaggtaattatagcgaagcaaaaaatgttgtaaaacaaacacttaataataattacgccgatgatgaaacatattaccttagtggtttgattactgcaactaagagttcgcaagcagaggccgtatcagaatgggaaagaggtttaagaaaatttccaaattcaggtgtacttaattatgaattagctatagctaatcgttctttaagtgatgataaaaaggctttaaaatatataaaaaaagctgtagcaattaatcctaataataaaaaatatgttaatttaaaaaaagagttgagtaaatctaatgacacgaaaaattaa

SEQ ID NO: 305 - DNA, 441 bp, S.epidermidis
atggatattaaaaaaattgaggaagtcattaaattggtaaaagctaatgatgtaaaaaaatttaagtataaggactctcataatgaaatagaacttgattttactaatggagcatctcaacaacattcgcaacaatcatctcaagatattcaacaagagaatattaaatccttagatgaaaagcaagagtccatatcaaatgaccagcaagagattaaatctcctatggttggaacatttttcttacaagatagtaaagaactaacagaacctaagattaaagttggcgatactgtaactgaaggagatattatcggttacattgaagctatgaaagttatgaatgaagtaactacggatgttactggtgaggtcactgaaatattagtagaacatggagacaatgttgaatatgatcagctactagtcagagttaaatag

SEQ ID NO: 306 - DNA, 369 bp, S.epidermidis
ctagaaattaatatgaaacgttttaaatatgcatatgagggtttttgcgcaattttaaaaaaagaccaaaatttcttattacacattttagcggccataattattatcatattaggatttgtgttaaatattgatcgtatagattggatattaatcatcgtagctataggacttgttttaagttttgaagctattaatacctcaattgaatttgttgttgacctaattacaactgactatcatgaatatgcaaaatacgctaaagatatagctgcgtttagtgttgtcatcgtttcaatcgtttcaatatgtattgggttaatcgtttttttaccatatatattagaaatatttaagggaggaatgtaa

SEQ ID NO: 307 - DNA, 558 bp, S.epidermidis
aatcattataaaggtaaaggtgaaaagatagtgggaatcataaaaaaattatttatgccaaatgcatatgtgaaatcaatatttgaaattgatatagaaaaacttgccgatagtggtgttaaaggtatcataactgatttagataatacacttgttggttgggatgttaaagaacctactaagggtgttaaatcatggtttgctaaggctaaagatttaggaataactgtcacaattgtgtcaaataataataaaagtcgagtatcaagtttctcaagtaatttaggtgtagattatatattcaaagcacgtaaaccgatggggaaagcctttaagatggctattaaaaaaatgaaaattcaaccgagagaaaccgttgttgtaggagatcaaatgcttactgatgtgtttggtggcaattgtaatggtttatatacaattatggtagtacctgttaaacggactgatggattaattacaaagtttaatcgattaattgaaagacgattattaaatcattttagaaaaaaaggttatattaaatgggaggaaaattga

SEQ ID NO: 308 - DNA, 168 bp, S.epidermidis
attgtctataactatatcataacaagtagatttataagcaacaaagaatatgctttcaaaaaagttttaattattaaattattttcccgactcacacgacaattaaacaaaattgttaatgtgaatcttgttaatatttttctaaacctactaattgatatactataa

SEQ ID NO: 309 - DNA, 138 bp, S.epidermidis
tcgcagcataatctgcgtatacttccatgtttggacactccttgtcaaattatcaatgttcctataatagcaccattatttgtttatttctacttttctgttttaccaatgaaaaaatttatgtcatttaaattttaa

SEQ ID NO: 310 - DNA, 1683 bp, S.epidermidis
ttttttaataacataggaggagatattatgaaaagaaattggtggaaagaagcagttgcatatcaagtatatccacgaagttttaatgatagtaatggagatggaataggtgatctacctggattaattgaaaaattagattatctagaaaatttaggaatagatgtcatttggttaagcccaatgtatccatcaccaaacgatgataatggatatgatattagtgactacaaaggcattatgagtgaatttggtacaatgaacgattttgatcaattgttatcaagcatacatcaaagagggatgaaattaatattagacttagtggttaatcacacatcagatgaacacccttggtttattgaatcaaaatctagtaaaacaaatgcaaaaagagattggtatatttgggcagatcctaaaccggatggatctgaacctaataactgggaaagtatctttaatggttcaacttgggagtttgacgaatcgactaagcaatactatttccatttatttagcaaaaagcagccagatttaaattgggaaaatccagatgtaagacaagctgtgtttgaaatgatgaattggtggtttgaaaaaggtattgacggatttagagttgatgccattactcatattaaaaagaattttgaagcaggagatttacctgtacctgatggcaaaaaatttgctccagcatttgatgtagatatgaatcagccaggaatacaagaatggctccaagaaatgaaagataaatcgttaagtcggtatgacattatgactgtaggcgaggctaatggtgttactcctaatgatgctgaagaatgggtaggagaagaaaatgggaaatttaatatgatattccagtttgaacatcttggtttatggagtactggcgatacgaaattcgatgttaaatcctataaacaagtcttaaatcgttggcaaaagcaactagaaaatgtaggttggaatgctttatttatcgaaaaccatgatcaaccacgtcgtgtttcaacctggggtgatgataaaaattattggtatgaatcagcaactagtcacgctactgcctactttttacaacagggcacaccttttatttaccaaggtcaagaaataggtatgactaattatccatttgaaagcattgaaagtttcaacgatgtcgcagtgaaaactgaatatcaaatagtcaaaaaagaaggtggagatgtcaatcaattactagataaatataaaatggaaaaccgagacaatgcaaggactccaatgcaatggaataattctatcaatgctggattcactactggtaagccatggtttcatgtaaaccctaactatacagaaattaatgttaaacaacaactaaatgataagttttcgatactttcttattataaagcgttaattcaactaaaaaaatctgatttgatttacacctacggtaagtttaatatggtcgatgctgaaaataagcaggtttttgcatatacacgcacatttaaaaacaatactgtattaattgtagccaatctcacaaatgaagtatcagaactaaacctaccttttgaattagatatttcatctgtagatataaaattgcataattatcacttaaatgatataaatttagaccatattaaaccttatgaatcattcgtcgttgaaatataa

SEQ ID NO: 311 - DNA, 132 bp, S.epidermidis
gctcataataatatgaggaataaaaatgaaaaagatatatcaaaattggtaataaacatagtattacttctctatcgaggggacttggttaaaaataagtttatttacatagttctcaatggtcaaaaataa

SEQ ID NO: 312 - DNA, 1056 bp, S.epidermidis
ttacataataatacaataaggagtgtatatatgcatatttctatagtaggtatcacaggctatacaggactagaattgttaagattagcacttaatcaccctcatgtaacagtttcatcgattcatgctacaaaagaagtgggagtgcaaatttctgatatattccctcatttgaaaggtatttttgataaagaaattcaggttttcgacagtgaatttattatgacacattcagatttggtattttttgctactccgagtggcgttgcaaaagatttatccaaaaatttcgttaaaaataattttcctgttatagacttatcaggtgaccatcgtttatctccagatgtttatctcaaatggtataaaaaatcaccgtgtactgttgatatacaaaagcgttttacatatggtctctcagaagtaatgaatattagtcatcgcaatagatttattgctaaccctggttgttatgcaactgcaactgaattagcgctatatcccttaatcagcaatcatttaatccgtgttgattctataattgttgatgctaaaagtggtcttactggagctggtaaaaaattaaatcagtcatcgcattacgtaaatgtaaacaataattatgtgacgtataaacttaataaacatcaacatattcctgaaattgtacaaacgttgcagttttttaacaaaagtttacagaatattcagttttcgacatcgcttattccggttaatagaggtattgttgcaactatatacacacggcttgaaaacggagttaaaataaatcaaatagaatctacctacaaggatgtatataaaaataagcctttcataagaattaaagatggattaccacagttaaatgaagtaataggaacaaattacactgatattggttttgtttataacgaaaccacgggtgttttaacaatttcatcagttattgataatttaattaaaggtgccgctggacaagcaattcaaaacatgaatctgatgtttaatttcgacgaaactgatggtttaattttggcgcctttatatatctaa

SEQ ID NO: 313 - DNA, 696 bp, S.epidermidis
agaggtgataagatgaatattggcattatcattttcatcatatctgtgataattacaggtgttagcgcattacgagataaaagtcacgaggacagacaaaatcaaagacccaatcaaaaaacctcaaacgagcaacatcaagaaggtggtttctttgaaaaattagaaaaaacttttcaagaaattagtgacgaattaaatgatgaacctgaaaaaaaacagagtaaaccttttgaaacttcattaccaccactgaacgaagattggaatgaaaatgaaaagaaaaaaacatcacatcataaagaaaaacaaaatacttcacaatccaaacgtcaaacaacgtctactcatgaacatcaaaatatccctcagccagataaaacaacatcaagagatgataattatgaaaaacttaagcaagaacttgaacaagatgtaactaaaaatttaattgacgtacgtaaagaaattgataaagaaaaagaaaagcaacttgttatgattgagaggaaagctcaagacattatcaacgataaatatctttcagaaagaacaaaacgatatagaataaaacaactactaaattctaggaatgttgagaaaaacatgtcgcgctctgcttttcaatatgatagtgatgaagttattaatggtattatttggtcagaaattttaaataaaccaaaacagctttaa

SEQ ID NO: 314 - DNA, 1509 bp, S.epidermidis
atgattagtaaatcaagtcctttaatatttgaaagatccaaaaaagatagatatgcgtattcattaccacaaaatgacattgagaatatcagtattgcttcactcttagatgataagtatattcgtaaacataaggctgaatttcccgaggtttcagaattagatttagttagacattataccgaactatcaaataaaaatttcggggtagatactggattttacccattaggttcttgtacgatgaaatataatcctaaaatcaatgaaaaggtagcgcgtatttctggttttagtgaatctcatcctttacaagaagaagaacacgttcaaggttctcttgaaattatatatagtttacaagaagaattgaaggaaattactggtatggatgaagttaccctacaacctgctgcaggtgcacatggtgagtggactgctttaatgattttcaaagcttatcatgaaaaaaatggacaaagccatcgtgatgaagtaatagtgcctgattcagcacatggtactaatcctgcttctgcctcatttgctggatttaaatcagtaactgtaaaatctaatcaacgtggggaagttgacatagaagatttaaaaagagtagtaaacgataatacagctgcaatcatgttaactaatccaaatacattaggtatatttgaacagaatattattgaaatagggaaaatcgttcatgaagcaggaggtttattatattacgatggagcaaatttaaatgctattttagataaagtacgtcctggtgatatgggctttgatgcggtacatcttaatttgcacaaaacattcactggtcctcatggcggtggtggaccaggatcaggaccagttggagtagtagagaaattagccagttatctacctaagcctatggttataaaagataacgataggtataaatatgataatgatattccaaattcaattggacgagtaaaaccgttttatggaaatttcggcatttatttaagagcatatacttatatcagatcaatgggagccaatggtttaaaagaagtatctgaagctgccgttcttaatgcgaattatataaaatctcgccttaaaaatcactttgaaattccgttcaatcaatattgtaaacatgaatttgtattaagtggaactttacaaaaacaatatggtgtcagaacattagatatggctaagcgactgttagattttggtgtgcatccacctacaatatattttcctctcaatgtcgaagaaggaatgatgattgagccaacagaaactgaatctaaagaaacacttgattactttattgatgcgatgattcaaatcgctgacgaaacaaaaaatgatccagataaagttttagaagcaccacatacgactataattgatcgattagatgagaccactgcagcacgaaaaccaattcttaaatttgaagaacttaaggacgaaaagtataaagaacacacaaatattgattctgaagataattaa

SEQ ID NO: 315 - DNA, 240 bp, S.epidermidis
tgtgacagtaagctaatggttaagaattattcattttatcaatttattatgaccgtgcgcggaagaaaagacgataaaggtgtttttgctgagcaaatttttgaagaccttgcctttccaaaacacgaagatgattttaatacattatctgaatatattgagacacatagcgaattcaccctaccaatgtctgtatttgatgacttatatgatgactatacagaatggttgaagttttaa

SEQ ID NO: 316 - DNA, 1272 bp, S.epidermidis
tattcaatccttatagggggtcaaaagatgggggaaaatacaaaacaagatttcaatcaaaaaggacaaaattttaaattcacaaaaaaacatagacgattattatatggttcagtttttttaatggctacatcagctattggtccagcatttctgactcaaactgcagtgtttactgcacaattttatgctagttttgcatttgcaatattaatttctattattatagatataggcgctcaaataaatatttggagaatattagtggtaactggattacgtggacaagaaatatctaataaagtattacctggacttggtactattatctccatactaattgcatttggtggtctcgcatttaacataggtaatattgctggtgcaggtttaggtttaaatgcaatgtttggtcttgatgtaaaatggggtgctgcaataacagctatttttgcgatacttatctttgttagtagaagtggtcagaaaataatggatgttattagtatgattctaggtatcgtaatgattttagtagtcgcttatgtcatggttgtttcaaatcccccttatggagatgcattagtacatacatttgcacctgaacatcctttcaaacttatattacctataattacattagttggtggtacagtagggggttatattacttttgcaggtgcacatagaattctagattctggtataaaaggtaagtcataccttcctttcgtaaatcgatctgctgtagcaggtattttaacaactggtgtcatgcgcaccttattgtttttagctgtactaggtgttgttgtaactggcgttacgcttagttcagaaaatccaccagcatcagttttccaacatgcattaggtcctataggtaaaaatatttttggcgtagtaatatttgcagcagcaatgtcctcagtaattggttctgcatatacaagcgcaacatttttaaaaacactacacaaatcgttactcaataaaaataatcttatcgttattacatttattgtaatttcaacttttgttttcttatttattggtaaaccggtgagtttacttataatagctggtgcgattaatggttggattctaccaatcacattaggtgcaattctcattgcaagtaggaaaaaatctatcgttggtaattaccaacacccaacatggatgcttgtttttggtattatagccgtaattgtcacaataatgactggtatcttttcattacaagatttagcaagtctttggaaaggttaa

SEQ ID NO: 317 - DNA, 849 bp, S.epidermidis
atagaattcaaaattgaaggagttgagttgaatatgaaacttgtattttatggtgctggtaatatggcgcaggcaatttttactggaattattaattccaacaatttaaatgcaaatgatatttatttaactaataaatccaatgaacaagcattaaaaagctttgcagaaaaattaggggttaattatagttatgatgatgaagcattactcaaagatgccgattatgtatttttaggtacaaagccccatgattttgaaaatttagctaatcgtattagagaacacattactaatgataataggtttatttctataatggcaggtttatctattgattatattcgtcagcagcttaataccaataatccattagctcgtattatgccaaatacaaatgctcaagttggacattcggttactggaataagtttttcaaataattttgatcctaaatctaaaaatgaagtggatgaattaatcaatgcatttggatcagttatagaagtctccgaagaacatctacatcaagttactgcaattacaggaagtgggtctgcatttttatatcatgtatttgaacaatatgtaaaagcaggtacagaattaggtttagaacgaaatcaagtcgaagaatctatacgcaatttaattattggaacaagtaaaatgattgagcgttcagacttaagtatgtctcaattaaggaaaaatattacatctaaaggtggtactacacaagctggacttgatgcactatctcaatatgatattgtatcgatgtttgaagattgtttaggtgcagctgtgaatagaagtatggaattatcacataaagaagatgaataa

SEQ ID NO: 318 - DNA, 2694 bp, S.epidermidis
ataatactcaactatgactatctaactgcgataacaaaaacgtatgaaggagagtttttatttatgaaaaaaatgaaagctagtgaaattaggcaaaaatatttgaatttctttgtagaaaaaggacatatgattgaaccgtctgcaccacttgtacctatcgatgatgattcattattgtggatcaattctggtgtagctaccttgaaaaaatactttgacggacgcgaaactcctaaaaaaccaagaattgtcaattctcaaaaagctatacgaacaaacgatatagaaaacgtcggttttactgctcgccatcatactttttttgagatgctaggtaatttttcaatcggtgactactttaaacatgaagcgattgaatttgcttgggaatttctaacaagtgataaatggatgggcatggaacctgagaagctatatgtgactattcatcctgaagatactgaagcttttagaatttggcatgaagacattggtttagaggaaagtcgcatcattcgaatagaaggcaatttttgggatatcggggaaggaccatctggaccaaatacagaaattttctatgatcgtggatcggcttatggaaaagatgatcctgctgaagaaatgtatcctggtggtgaaaatgaaagatatttagaagtttggaatctagtgtttagtgagtttaatcacaataaagacaatacttacacaccactaccaaataaaaatattgatactggcatgggattagaacgtatgacgtctatctcacaaaatgtaagaacaaattatgaaacagacttatttatgcctataattaaggaagtagaacatgtttcaggaaaaaaatatttaattgatgatgcacaagatgttgcatttaaagttatcgcagaccacattagaacgatttctttcgcaattgctgatggcgcattaccagctaatgagggtagaggatatgtattaagaagattattacgcagagcagttcgctttagccaatcattaggaattaatgaaccatttatgtataaacttgttgatatagtcgctgatatcatggaaccatattatccaaatgtcaaagacaaatccaactttattaaacgtgtcattaaatcagaggaagaacgcttccatgaaacgcttgaggaaggtcttacgattttaaatgaactgataaaagaagcgaagaatagtgatcaggttattaaaggtcatgatgcttttaagttatatgatacttatggattcccaatagaattaactgaagaattagcaactcaagaaaatttgtctgttgatatgcctacttttgaacaggaaatgcaacaacagagagatcgagctagacaagctcgacagaattctcaatcaatgcaagttcaaagtgaagtactaaaaaatattcaagatgaaagtcaatttgttggctatgaaactacggactatcaatcattaataactcatatcatatacaatggtgaagaagttaaacatgttgaagcaggagaaacaatttactttattttaagagaaacgcctttctatgcagtaagtggtggacaggtcgcagataagggaacagttggtaatgagagctttgaaataaatgtaactgacgtaactaaagcgcctaatggccaaaacttacacaaaggtattgtgcaatttggtgaagcaacacagaacgcgaaagtagaagcacgtgttaacaaagaggatagacgacttattcaaaaaaatcatagtgctacacatttattacatgctgcattaaaagaagtattaggagatcatgttaatcaggctggttcgttagtagaacctgaaagactacgttttgatttctcacattttggtcctatgacacaagaagaaattaatttagtagaacgtagagtaaatgaagaaatttggagagctatcgacgtccgtattcaagaaatgagtattgaagaagccaaatcaataggcgctatggctttatttggtgaaaaatatggagatattgttcgcgttgtcaatatggcaccattttcaatagaattgtgcggtggaatacatgtgaataatactgcggaaattggtctctttaagattgtgagtgaatctggaacaggtgccggtgttagaagaattgaagctttaacaggtaaaggtgcattcttacatcttgaagaaattgaaacacagtttaataatattaaaaatcatttaaaagttaaatccgataaccaagtagttgaaaaagttaaacaacttcaagaagaagaaaaaggactgcttaaacaattagaacaacgcaacaaagaaataacatcactaaagatggggaacattgaagaacaggttgagttgattaataatttgaaagttttagcaacagaagtagaaattccaaatccaaaagcgatacgttcaactatggatgactttaaatctaaacttcaagatactattatagtgttagtcggacaagttgatggaaaggtttctgtaattgctacagtaccaaaatcacttacaaatcaagtaaaagctggagatcttatcaaaaacatgacaccaattattggtggaaaaggtggaggtcgtcctgatatggctcaaggtggcggaactcaacctgaaaaaataacagaagcattacgctttattaaagattacattaaaaatctataa

SEQ ID NO: 319 - DNA, 366 bp, S.epidermidis
agaatggtcaatgtagcagattattctcaatctaatttaggaaaaattgaaatagcaccagaagtattatctgttatcgcatccattgcgacatcagaagtagaaggtattacaggccattttgctgaactaaaaaaaacaaatctagagaagattagtcgaaaaaatttaaacagagatttaaaaatcgaagctaaagaagacggaatatacattgatgtattttgttctttaaaacatggcgtaaatatttctaaaactgcaaatcaaattcaatcagcaattttcaattcaattacgacaatgacagctattgaaccacagcaaattaatattcacatcagaagtatcgtcgcagaaaaataa

SEQ ID NO: 320 - DNA, 138 bp, S.epidermidis
attttatccaaagtacccctaccaaaaaagcaagagcaatgtaaaacattggttattcttgagtcagatattgagcaacatattcaggtgaaaacggaatttttttatattcaattcctgattgcttcaataatttaa

SEQ ID NO: 321 - DNA, 195 bp, S.epidermidis
cataaggccaagatttgcgccgaagtttacaggagcctctgtaaattctttcttgttcttagtcatttaacaccctccacaaaaatgatgaaacgcttacatggttatcatagcattatttcatatattgttaaagtacatttacctattattatacaaaataggagcaagacagaatttactccaaattcatag

SEQ ID NO: 322 - DNA, 498 bp, S.epidermidis
aagaaggacaaaaaacatgtaaatccggtcagacaattagtattgcaaatggagaagcagttgccaattaaaaacattaaagcatttagtttagtcgagatgatttttactttatttattatcagttgcttgttgataacaactttatggtcacgaagcctgttcgacattcagctaattgatgaagaatatgaaattaaacaattaataacaaaatttaattactataaatctaaagctattagcaacaacgaatcaataactttattattttttaataattcaaatagagtacaagtaattgaagaaaatggagataaatatagttttaaacttaataaaggcaaagtgattaatatagctaaaattcaaacattaaattttgataaaaatggaaatataaatcattttggatcgctcattttacaatataattcacatgcttatagattaatcttccatattgaaaaggggcgtttgagatttgtcaaaatataa

SEQ ID NO: 323 - DNA, 399 bp, S.epidermidis
ggaggatgcaagatgagtatctctttgtacattgcaattggtattattgttattatcattgcatatatgattatccaacaaattcttaataagcgagctgtaaatgaattagaccaaaatgaattccataaaggtttaagaaaagctcaagttattgatgtgagggaaaaagtggattatgattatggacatattaatggtgcacgtaatattcctatcacagtatttaagcaacgatatcaaggactaagaaatgaccaacctatttatttatgtgatgctaatggtatagcaagttatcgtgctgcacgtatattaagaaaaaatggatataaaaatatttacatgcttaaaggcggttacaaaaaatggacaggtaaaataaaatctaaaaagtaa

SEQ ID NO: 324 - DNA, 957 bp, S.epidermidis
tggattagcaatatctataaaaggagaatgactatggttgaattattagttactcctaagtcaataactcatatggaaacactaatagataaaggtgcagacgcatttgttattggtgaacaaaaatttggtttaagactgccgggagaatttaatcgtgatgctatgcaagaagctgtagcattagcccataaaaataacaaaaaagtatacgctgctgtgaatggtattttccataattaccacttagatgccttggaagactatattaactttttacatgatattcaagtagatcgcattatatttggtgatccagctgtcgttatgtatgttaaacaacacgagcatccaattccattaaattgggatgctgaaactcttgtaacgaattattttcagtgtaattactgggggaaaaaaggtgcaaatagagcagttttagctcgagaacttagtttagatgaaataattcatattaaagagcatgctgatgtagagatagaagttcaagttcatggtatgacttgtatgtttcaatccaaaagaatgctattaggaaattattatactttccaagagcgacaaatgaagatagaacgccaacatgatcatggagacttattattatatgatgaagaaagagataataaatatccagtttttgaagattataatggtactcacatcatgtctccaaatgatatctgtttaatagaagaattagagcctttttttgaggcaggaatagatgcgtttaagatagatggtattttacaaagtgaagaatatataaatgtagtcacagagcaatatcgagaagctatagatttatttaatgaagatccggatgcatatgaagatgaaaaattcatgctcgttgatcctatagaagaaatacaacctgaacatcgtccattcgacgaaggtttcttgtataaacaaacagtatattaa

SEQ ID NO: 325 - DNA, 1035 bp, S.epidermidis
tggtcaagcaattcatgtatagttggaggtaaaaaaatgatagattacaagtcagcaggccttacagaagaagacctcaaaaaaatatataaatggatggacttaggaagaaaaacagacgaaaggctatggttactcaatcgtgcaggtaaaattccatttgttgtcagtggtcaagggcaggaagcaactcaaattggtatggcatatgcaatgcaaaaaggtgatatctcatcaccttattatcgtgatttagcatttgtcacttatatgggaatttctccattggatactatgttatcagcttttggaaaacgtgatgacattaactcaggaggtaaacaaatgccttctcattttagtcacaaagaaaaaggcattttatctcaaagttctccagtagccactcaaataccacattctgtcggtgctgcattagcacttaaaatggataacaagccaaatattgctaccgcaacagttggagaaggcagttcaaatcaaggtgactttcacgaaggtatgaactttgctgcagttcacaaattacctttcgtctgtgtaataattaacaataaatatgcgatatctgtaccagattcactacaatatgctgctgaaaagttatcagatcgtgcattaggttacggtatgcatggaatacaggtagatggaaatgacccaattgcagtatacaaagcgatgaaagaagcaagagaacgagcgctagcaggtgaaggtccaacattgatagaagctgtcacttcacgtatgacaccacattcatctgatgatgatgatacatatcgtacaaaagaagaaagagacctattgaaacaagaggattgtaatataaaatttaaaacggccttactcgatcaaggcatcataaacgaaaattggttgagtcaattggaaaaagagcataaagaactcattaatgaagctactaaatctgctgaagcagcaccatatccttcagaagaagaagctttgacatatgtttatgaagagggaggtcaacgaaatgactaa

SEQ ID NO: 326 - DNA, 30612 bp, S.epidermidis
atgaagagcaaaccgaaattaaacggtcggaacatctgctcttttttattgagcaaatgtatgagttattcattgtcaaaattatcaacattaaaaacgtataattttcaaatcacatcaaacaacaaagaaaaaacatcaagaataggagtggcaatagctttgaataatcgtgataaattacaaaaatttagtattcgaaaatacgcaattggaacattttctactgtgattgcaacacttgtgttcatgggtatcaatacaaaccatgcaagtgccgacgagttgaatcaaaatcaaaagttaattaaacaattaaatcaaacagatgatgatgattcgaatacgcatagtcaagaaatcgaaaataacaaacaaaattctagtgggaagactgaatcattacgttcatcaactagtcaaaatcaagcaaatgcacgactgtcggatcaattcaaagacactaatgaaacatcgcaacaattacctacaaatgtttcggatgatagtatcaatcaatcgcatagtgaagcaaatatgaataacgaaccattgaaagttgataatagtactatgcaagcacatagtaaaatagtaagcgatagcgatgggaatgcttctgaaaataaacatcataaactaacagaaaatgtacttgcagaaagccgagcaagtaaaaatgacaaagagaaagagaatctacaagagaaagataaatcgcagcaagtacatccaccattagataaaaatgcattacaagctttttttgacgcatcatatcacaattacagaatgattgatagagatcgtgcggatgcaacagaatatcaaaaagtcaaatctacttttgactacgtcaatgacttactaggtaataatcaaaatattccttcagaacagcttgtttcggcatatcaacaattagagaaagcattagaacttgcacgtacgttaccacaacaatctactacagaaaaacgtggtagaagaagtacgagaagtgttgttgagaatcgttcatcaagaagcgattacttagatgctagaactgaatattatgtttcaaaagacgatgatgattctggtttccctcctggtactttcttccatgcttcaaatagaagatggccttataatttaccaagatctaggaacatcttacgtgcttctgatgtacaaggtaatgcttatatcactacaaaacgacttaaagatggatatcaatgggatattttatttaatagtaatcataaagggcatgaatatatgtactattggtttggacttccaagtgatcaaacaccaactggtccagtaactttcactattatcaaccgtgatggttcaagtacatctactggtggcgttggatttggatcaggtgcaccactacctcaattttggagatcagcaggtgctattaattctagcgtagcgaatgattttaaacatggctccgctacaaattatgcattttatgatggtgttaataatttttctgactttgctagagggggagaattatacttcgacagagaaggcgctacacaaactaataaatattatggcgatgaaaacttcgcattgctaaatagtgagaaaccagatcaaataagaggattagatacaatatatagttttaaaggtagtggtgatgtaagttatcgtatttcatttaaaactcaaggagctccaactgcaagattgtattatgctgctggcgcgcgttctggtgaatataaacaagcaacgaactataaccaactctatgtcgaaccttataagaattatcgaaatcgagtacagtcaaatgtccaagttaaaaatcgtacacttcatttaaaaagaacaatcagacaattcgatcctacattacagagaactactgatgttcctattttggatagtgacggttccggaagtattgattcggtatacgacccattaagttatgtaaagaatgtgactggtacagtcctaggtatttatccatcttatcttccttataatcaggaaagatggcagggagctaatgcaatgaatgcctatcaaattgaagaacttttttcacaagaaaatcttcaaaatgcagcacgttcaggccgtccaattcaatttcttgtaggttttgatgttgaagatagccatcataaccctgaaactcttttaccagtaaatttatatgtaaaacctgagttaaaacatacaattgagttatatcacgataatgaaaaacaagatagaaaggaattttcagtatcgaaacgagcgggccatggtgttttccaagtaatgagtggaacgcttcataacactgtaggatcaggaatattaccttatcaacaagagatacgtatcaaacttactagtaatgaaccaattaaagatagtgaatggtctattacaggatatcctaacacgcttacattacaaaacgctgtgggtagaacaaataatgctactgaaaaaaacttagctcttgttggtcatattgatccaggaaattatttcatcactgttaagtttggtgataaagtagaacaatttgaaattagatcaaaaccaactccaccaagaatcattacaactgctaatgaattacgtggaaatcctaaccataagcctgaaataagagtaacagatataccaaatgatactactgctaaaatcaaacttgtgatgggcggaaccgatggcgatcatgatccagaaataaatccatatactgtccctgaaaactacacagtagttgcagaagcataccatgataatgatccaagtaaaaatggggtcttaacattccgttcatcagactaccttaaagatctaccattaagcggtgaattaaaggcaattgtttattacaatcaatatgtacaatcaaactttagtaatagcgttccgtttagtagcgatacaacaccacctacaattaatgaaccggcaggactagttcataagtattacaggggagatcatgtagaaattactcttccagtcactgataatactggcggttcaggtttaagagatgtaaacgtcaatttacctcaaggttggacaaaaacctttacaatcaatcctaataataatactgagggtacgcttaagttaattggtaatatacctagtaatgaagcatataatacgacatatcatttcaatattactgcaaccgataattctggaaatacaacaaatccagctaaaacctttattttaaatgttggtaagttggctgatgatttaaatccagtcggattatctagagatcaactacaattagtgacagacccttcttcattatctaattccgaacgagaagaggtaaaaagaaaaataagtgaagcaaatgctaatataagatcatatttattacaaaataacccaatactcgctggagtaaacggcgatgttacattttattatagagatggttctgtagatgttattgatgctgaaaatgtaatcacatatgagcccgaaagaaaatccattttcagtgaaaatggtaatacaaataaaaaagaagcagtaatcactattgctagaggacaaaactataccattggtccaaacttaagaaaatatttctcattaagtaatggttcggatttacctaatagagatttcacctctatatcagctattggatctttaccttcatcgagtgaaattagtcgactcaatgttggaaattataactatagagttaatgctaaaaatgcttatcataagactcaacaagaacttaatttaaaacttaaaatagtagaggttaatgcacctactggtaataatcgtgtatatagagttagtacttataatttaactaatgatgaaatcaataaaatcaaacaagcatttaaagcagctaattctggacttaatttaaacgataacgatatcactgtttcgaataactttgaccatagaaatgttagtagtgtgacagtaactatacgtaagggcgatttgataaaagagttttcatcaaatctcaataatatgaatttcttacgttgggttaatataagggatgattataccatttcgtggacttctagtaagattcaaggtagaaatacagatggtggattagaatggtcaccagatcataaatcacttatttataaatatgatgcaacattaggtagacaaataaatactaatgacgtgttaactttacttcaagcaacagctaaaaactcaaatttacgttcaaatatcaatagtaatgaaaaacagttagcagaacgagggtctaatgggtattctaaatctataattagagatgatggcgagaaatcttatttacttaactcaaatcctattcaagtattagacttagtagaaccagataatggttacggtggacgtcaagtcagtcattctaacgttatatataatgaaaaaaattcttctatcgtaaatggtcaagttccagaagctaatggggcatccgcttttaatattgataaagttgttaaagctaatgcggcaaataatggtattatgggtgttatctataaggcacaattatacttagcaccatacagtccaaaaggttacattgaaaaattaggccaaaatttaagcaataccaataacgtgattaatgtttattttgtgccttctgataaagtaaatcctagtataactgtaggtaattacgaccatcatacggtatattctggtgaaacatttaaaaatactatcaatgtaaatgataattatggattaaatacagtagcttctacaagtgatagtgcaattactatgaccagaaacaacaacgagttagtaggtcaggctcctaatgttactaatagcataaataaaattgtaaaagttaaagccacagataaaagtggaaatgaaagtattgtttctttcacagtaaatataaaaccattaaacgagaaatatagaataacaacttcatcaagtaatcaaacaccagtgagaattagtaatattcaaaacaatgctaacctttcaattgaagatcaaaatagagtaaaatcttcactcagcatgactaaaattttaggtacaagaaattatgtcaatgagtcaaataatgacgttcgtagtcaagttgtaagtaaagtaaatagaagtgggaacaatgctacagttaatgttacaactacattttctgatggtacaactaatacaataaccgttccagttaaacatgtgttattagaagttgtacctactactagaacaacagtaagaggacaacaatttccaaccggcaaaggaacttccccaaatgatttctttagtttaagaacgggaggtccagttgatgcgagaatagtttgggttaataatcagggacccgatataaatagtaatcaaattggtagagatttaacattacacgctgaaatattctttgatggtgaaacaacaccaattagaaaagatactacttacaaacttagtcaatctattccaaagcaaatatatgaaacaactatcaatggtcgatttaattcatcaggtgatgcatatccaggaaattttgttcaagcagtaaatcaatattggccagaacatatggacttcagatgggcccaaggatcaggcacaccaagttctcgtaatgcaggttcatttactaaaacagttacggtagtttatcaaaacggccaaactgaaaacgttaatgtactattcaaagtcaaaccaaataaacctgttattgatagtaatagtgtgatttcaaaaggacaattaaatggtcaacaaattttagttcgaaatgttccacaaaatgcacaagtcactctatatcaatcaaatggaactgttattcctaatacaaatacaactatagattctaatggtatagctactgtaacaattcaaggcactctaccaaccggaaatattactgctaaaacctcaatgacaaataatgtaacgtacactaaacaaaatagtagtggaattgcttcaaatacaactgaagatataagtgttttttcagaaaacagtgatcaagtaaatgttaccgctggcatgcaagctaaaaatgatggtattaaaataattaaaggtacaaactataattttaatgacttcaatagtttcataagtaatataccagcccattctactcttacatggaacgaggagcctaatagttggaaaaacaacatcggtactacaacaaaaactgttacagttactctacctaatcatcaaggtacgagaactgtagatattccaataacaatctatccaacagttacagctaagaatccagtaagagatcaaaaaggacgaaacttaaccaatggtactgacgtttataattatattatttttgaaaataataaccgtcttggaggaacagcttcttggaaagacaatcgtcaacctgataaaaacatagccggtgtacaaaatttaattgcacttgttaattatcctggcatatctacaccattagaagttcctgttaaagtgtgggtatataattttgatttcactcaacctatctacaaaattcaagtaggagatacattccctaaaggaacatgggcaggctattacaaacatcttgaaaatggagagggattaccaatagatggttggaaattttattggaaccagcaaagtacaggaactactagtgatcaatggcaatcattagcatatactagaactccttttgttaaaactggtacttatgatgtcgttaatcctagcaactggggtgtttggcaaacatcacaatcagctaaatttatagttacaaatgctaaacctaatcaaccaaccataactcagtctaaaactggtgatgtaacagtaacacctggtgctgtgcgtaatatactaataagtgggacaaatgattatatccaagcatctgcagataagattgttattaataaaaatggaaataaattaactacatttgttaaaaataatgatggtcgttggactgttgaaactgggtcacctgacataaatggtatcggaccaacaaataacggaactgctatatctttaagtcgattagcagttagacctggggattcaatagaagcaatagcgactgaaggttccggagaaactataagtacttcagcaactagtgaaatttatattgtcaaagctccacaacctgaacaagtagcaactcatacttatgataatggaacattcgatatattacctgacaattcacgtaattctttaaatccaactgaacgtgtcgaaattaattacactgaaaaattaaatggcaatgaaacacaaaaatcattcactattactaaaaataacaacggcaaatggacgataaataataaaccaaattatgtcgagttcaatcaggataatggtaaagttgtattttcggccaatacaattaaacctaattctcaaattacaataactcctaaagcaggtcagggtaacactgaaaacacaaatcctactgtaattcaagcacctgcgcaacatactttaacaatcaatgaaattgttaaagaacagggtcaaaatgtgactaatgatgatattaataatgcggttcaagtgccaaataaaaatagagttgcgattaaacaaggaaacgctcttccaacaaatttagctggtggtagtacatcacatattccagtagttatttattacagtgatggaagttctgaagaagctactgagactgttagaactaaagttaataaaaccgaattaatcaatgctcgtcgtcgactagatgaagaaattagtaaagagaacaaaacaccatcaagtatcagaaactttgatcaagctatgaatcgtgctcaatcacaaattaatacagctaaaagtgatgctgaccaagttataggcacagaatttgcaacacctcaacaagtaaattcagctttatctaaagttcaagcggcacaaaataaaataaatgaagctaaagcattattacaaaacaaggctgataatagtcaacttgtgagagcaaaagaacaattacaacaatcgattcaaccagccgcttcaactgatggtatgactcaagatagcacaaggaactacaaaaataaacgccaagcagctgaacaagcaatacaacatgcaaatagcgttataaataatggagatgcaacatcccaacaaattaatgatgctaaaaacacagttgaacaggcacagagagattatgttgaagctaaaagcaacttacgtgctgataagtcacagttacaaagcgcttatgatacgttaaatagagatgttttaacaaatgataaaaagccagcatctgtaagacgctataatgaagccatttcaaatattagaaaagaattagatacagctaaagcggatgcaagtagtactttgcgaaacaccaatccttccgttgaacaagttagagacgctttaaataaaataaatactgttcaacctaaagtgaatcaagcaattgctttacttcaaccaaaagaaaataattcagaacttgtacaagctaaaaaacgtttacaagacgctgtaaatgacatacctcaaacacaaggtatgacacaacaaacaattaataattataatgacaaacaacgtgaagctgaaagagcacttacatctgcacaaagagtgattgataatggggatgctacaactcaagaaattacttctgaaaaatctaaagtagagcaagcaatgcaagctttaactaatgctaaaagtaatctgagagctgataagaatgagttacagactgcatataacaaattaattgagaacgtatctaccaatggtaaaaaaccggcgagtatacgtcaatacgaaacagccaaagccagaatacaaaatcaaattaatgatgctaaaaatgaagcggagcgaattttaggtaatgataatccacaagtatcacaagtaactcaagcattgaacaaaatcaaagctattcaaccaaaattaacagaagctatcaacatgcttcaaaacaaagaaaataatacagaattagtcaatgctaaaaacagacttgaaaatgcagtaaatgatacagatccaacacacggtatgactcaagaaacaattaataattacaacgctaaaaagcgagaagctcaaaatgaaatacaaaaagcgaacatgattattaataatggagatgctactgctcaagatatttcttctgaaaaatctaaagtagagcaagtattacaagcattacaaaatgctaagaatgacttaagagctgataaaagagaattacagactgcatacaataaacttatacaaaatgttaataccaatggtaaaaaaccatctagtattcaaaactataagtctgcaagacgaaatatcgaaaaccaatataataccgctaaaaatgaagcacataatgttcttgaaaatacaaaccctactgtaaatgcagtagaagatgctttacgtaagataaatgcaattcaaccagaggttacaaaagctattaatatacttcaagataaagaagataatagcgaacttgttagagcaaaagaaaaattagatcaagcgattaatagtcaaccatcactaaatggtatgactcaagaatctattaataattacacaacaaaacgtagagaagcacaaaatatagcaagttctgctgacactattattaataatggggatgcatctattgaacaaataacagaaaataaaattcgagttgaagaggcaactaatgcacttaacgaagcaaaacaacatttaacggcagatacaacttctttaaaaactgaagtacggaaattaagtaggagaggcgacacaaacaacaaaaagcctagcagtgttagtgcttataacaatactattcattcgctacaatctgaaattacacagactgaaaatagagcaaatactatcatcaataagcctattcgttctgttgaagaagtaaataatgcattgcatgaagtaaaccaattgaaccaacgcttaacagatacaattaacttattacaacctttagcgaataaagaaagcttaaaagaagctcgtaatcgacttgaaagtaaaattaatgaaaccgttcaaacagacggtatgactcaacaatctgttgagaattataagcaagctaaaataaaagctcaaaatgaatctagtattgcacaaactcttattaataatggtgatgcatctgatcaagaagtttctacagaaatagaaaaattaaatcaaaagctgtctgaattaacaaattcaatcaatcacttaacagttaataaagaacctttagaaactgccaaaaatcagttacaagcaaatattgaccaaaaacctagcactgatggtatgacgcaacaatctgtacaaagctatgaacgtaaactacaagaagccaaagataaaataaactcaattaataatgtcttagctaacaatccagatgttaatgctatcagaacaaacaaagttgagacggaacaaatcaataatgaattaacacaggcgaaacaaggtcttactgttgataaacaaccattgattaatgcaaaaactgctttgcaacaaagtctagataatcaaccaagtactactggtatgactgaagcaacaattcaaaattataacgctaaacgtcaaaaagcagagcaagttatacaaaatgcaaataaaattattgaaaacgctcaacctagtgtacaacaagtgtctgatgagaaatctaaggtagagcaagcactcagtgaattgaacaacgccaaatcagcgcttagagctgataaacaagaattacagcaagcatataatcagttgattcaaccaacggatttaaataataagaaaccagcttctatcactgcgtacaatcaaagatatcaacaatttagtaacgaattgaacagcactaaaacaaatacagatcgcattttaaaagagcaaaatccaagtgtagctgatgtcaacaatgcactaaataaagtaagagaagtacaacaaaaattaaacgaagccagagcacttttacaaaataaagaagataatagtgcactagttcgagccaaagaacaacttcaacaggcagttgaccaagtcccttcaacagaaggtatgacgcaacaaactaaagatgattacaattcaaaacaacaagctgctcaacaagaaatatcaaaagcacaacaagttatcgataatggcgatgcgactacacaacaaatttctaacgccaaaacaaatgttgaacgcgctttagaagcattaaataatgcaaaaactggtttaagagcagataaagaggaacttcaaaatgcatataatcaattaactcaaaatattgatacgagcggtaaaacgcctgcaagtatcaggaaatacaatgaagctaagtcacgtattcaaactcaaattgattcagctaaaaatgaagcaaacagtattttaacaaatgacaatcctcaagtatcacaagtgactgctgcgttaaacaaaataaaagctgttcaacctgaattagataaagcgatagcaatgcttaaaaataaagagaataataatgcattggttcaagcgaaacaacaacttcaacaaattgttaatgaagtagatccaacacaaggcatgacaacagatactgctaataactataaatcaaaaaaacgtgaagctgaagatgaaatacaaaaagctcaacaaatcattaacaatggcgatgccactgagcaacaaattactaacgaaacaaatagagtaaatcaagcgattaatgcaataaacaaagccaaaaacgatttacgtgctgataagtctcaattggaaaatgcttataaccaattaatacaaaatgttgatacaaatggtaaaaaacctgctagtattcaacaataccaagctgctcgacaagctattgagacgcaatacaataacgctaaatcagaagcacatcaaattcttgaaaatagtaacccttcagttaatgaagtagcacaagcattacaaaaagttgaagctgtacaacttaaagttaatgacgcgattcatatacttcaaaataaagagaataatagtgcacttgtcacagctaaaaatcaacttcagcaatcagttaatgatcaaccattaacaacaggtatgactcaagattctattaataactatgaagctaagagaaatgaggctcaaagtgctatcagaaatgcagaagctgtcatcaacaatggcgatgcaactgcaaaacaaatttcagacgagaaatctaaagttgaacaagcactagcacatttgaatgatgctaaacagcaattaactgcagatactactgaattacaaacagcagttcaacaattaaacagaagaggcgatacaaataataaaaagccaagaagtatcaatgcatataataaagcaattcaatcattagaaacacaaattacttctgctaaagataatgccaacgctgtgatacaaaaacctatacgtactgttcaagaggtaaataatgcattacaacaagtaaatcagttgaatcaacaattaactgaagcaattaatcaacttcaaccgctatcaaataatgatgcattaaaagctgcaagattaaatttagaaaataaaattaatcaaactgtacaaactgatggtatgacacaacaatctatagaggcttatcaaaacgctaaacgcgtagcccaaaatgaatctaacactgctttagcattaattaataacggcgatgccgatgaacaacaaattacaactgaaacagaccgagtcaatcagcaaactacaaacttaactcaagcaattaacgggttaacagttaataaagaaccattagaaaccgctaaaacagcgttacaaaataacatcgaccaggtacctagtacagatggtatgactcagcaatctgttgcaaattataatcaaaaactacaaatagctaaaaacgaaattaacacaattaataacgttttagcgaacaatccagatgttaatgcaatcaaaacgaataaagcagaagcggaacgaatcagtaacgatttaacacaagctaagaataacttacaagttgatactcaacctttagaaaaaataaaaagacaacttcaagatgaaattgatcaaggtactaacacagatggaatgactcaagattcagtggataattacaatgatagcttaagtgcagcaattatagaaaaaggcaaagtaaataaattacttaaacgtaatccgacagtagaacaagttaaagagagcgttgctaatgcacaacaagtcatacaagatttacaaaatgctcgaacttcacttgttccagacaaaactcaacttcaagaagctaaaaatagattagaaaacagtattaaccaacaaacagatactgacggcatgactcaagattcgcttaacaattataatgataaattagcaaaagctagacaaaaccttgaaaaaatatctaaagttttaggtggtcaacctactgtagctgaaattagacaaaatacagatgaagcaaatgcacataaacaagcattagacactgcacgttctcaacttacattaaatagagagccatatatcaatcatattaataatgaaagtcatttaaataacgcgcaaaaagataattttaaagctcaagttaactcagcacctaatcataatactttagaaacgattaaaaataaggctgatactttaaatcaatctatgacagcattaagtgaaagtattgcagattacgaaaatcaaaaacaacaagaaaattatttagatgcatctaacaataaacgtcaagactatgacaatgcagtcaatgcggctaaaggtattttaaaccaaactcaaagtccgacaatgagtgctgatgtgattgatcaaaaagctgaagatgttaaacgtacgaaaactgcgttagatggaaatcaaagattagaagttgctaaacaacaagcacttaatcatttaaataccttaaatgatttaaacgatgctcagcgacaaactttaactgatactataaatcactctccaaacatcaattcagtgaatcaagctaaagaaaaagctaatactgttaacacagcaatgactcaactgaaacaaactattgctaactatgacgatgaattgcatgacggcaattacattaatgcagataaagacaaaaaagatgcttataataacgctgttaacaatgctaaacaactgattaatcaatctgatgctaatcaagcacaacttgatccagctgaaattaataaagttacacaaagagtcaatacgactaaaaatgatctaaatggtaatgacaaattggctgaagctaaaagagatgctaatacaaccattgatggtttaacttatctaaatgaagctcaacgtaacaaagctaaagaaaatgtaggcaaagcttctacaaaaacaaatattacgagtcagttacaagattacaatcaattgaatattgctatgcaagcattacgtaacagtgtgaacgacgttaacaatgttaaagcaaatagcaattatataaatgaagataatggtccaaaagaagcttacaatcaagccgttactcatgctcaaacattgataaatgcacaatctaaccctgaaatgagccgtgacgtagtaaatcaaaaaacacaagcagtaaatactgcccatcagaatttacatggacaacaaaagttagaacaagcacaaagtagtgctaatacagaaatcggtaacttaccaaacttaactaatactcaaaaagctaaagaaaaggaactggtaaatagtaaacaaactcgtacggaagtacaagaacaacttaaccaagctaagtcactagatagttctatgggcacgttaaaatcattagttgctaaacaacctacagtacaaaaaacaagtgtttatattaacgaagatcaacctgagcaatctgcctacaatgattccattacaatgggacaaactataattaataaaacagctgatccagtacttgataaaactttagttgataacgcaatcagtaacatttcaactaaagagaatgcactgcatggtgaacaaaaattaacaactgctaaaacggaagcaattaatgcacttaatacattagctgatttaaacacacctcagaaagaggctattaaaacagctattaacactgctcatacaagaactgatgtaactgcagagcaaagtaaggctaatcaaataaatagtgcaatgcacacgttgagacaaaacatttctgacaacgaatcagtaacaaacgaaagtaattatattaacgctgaacccgaaaaacaacatgcctttactgaggctctaaataatgctaaagaaatagttaatgaacaacaagccactcttgatgccaattcaattaaccaaaaagcacaagcgattcttactactaaaaatgctttagatggtgaagaacaattacgtcgtgctaaagaaaatgccgatcaagaaatcaatacgttaaatcaattgactgatgcgcaaagaaatagtgaaaaaggtttaatcaacagttctcaaactagaacagaagttgcttctcaattagcaaaagctaaagaactaaataaggtgatggaacaactgaatcaccttatcaatggtaaaaaccaaatgataaatagcagtaaatttatcaatgaagatgcgaaccaacaacaagcatattcaaatgcgattgcaagtgcagaagcgcttaaaaacaaatcacaaaaccctgaattagataaagtaacaattgaacaagcaattaataatattaattctgcaattaacaatctaaacggtgaagctaaactgactaaagctaaagaagatgctgttgcttcaataaacaacctaagcggattaacaaacgagcaaaaaacaaaagaaaatcaagccgttaatggcgctcaaactagagaccaagttgctaataaattacgtgatgctgaagcattagatcaatcaatgcaaacattacgtgacttagttaacaatcaaaatgcaatacattcaacaagtaattattttaacgaggattcaactcaaaagaatacttatgataatgcaattgataatggctcgacatatataactggtcaacacaatccagaattaaataaatctactattgatcaaacgattagccgaattaacacagctaaaaatgatttacatggtgtagaaaagttacaaagagataagggaactgctaatcaagaaattggacaattaggttatttaaatgaccctcaaaaatctggtgaggaatccttagtcaacggttcaaatacacgttctgaagtagaagagcatcttaatgaagctaaatcattaaataatgcaatgaaacaattaagagataaagtagctgaaaagactaatgtcaaacaaagtagcgattacattaatgattcaactgaacatcaacgtgggtatgatcaagcacttcaagaagcagaaaatattattaatgaaatcggtaatccaacattaaataaatcggaaattgaacaaaagttacaacaattgactgacgctcaaaatgcgttacaaggttcacatctattagaagaagctaaaaataatgcgattactggaatcaataaacttacagcattaaatgatgcacaacgtcaaaaagcaattgaaaatgttcaagcacagcagacaatcccagcagttaatcaacaattaactttggatagagaaataaatactgcaatgcaagctttacgagataaagtaggccaacaaaataacgttcaccaacaaagtaattatttcaatgaagatgaacaaccaaaacataactatgataattctgtacaagccggtcaaactattattgataaacttcaagatccaatcatgaacaaaaatgaaattgagcaggctattaatcaaatcaatacgactcaaacagcgttaagtggagaaaataaattacacactgaccaagaaagcacaaatagacaaatagaaggtttatctagtttgaacacagctcaaatcaacgccgaaaaagatttagtcaatcaagctaaaacaagaacagatgttgctcaaaagttagctgcagctaaagaaataaattctgctatgagtaatttaagagatggcattcaaaataaagaggacatcaaacgtagcagtgcatatatcaacgcagatccgactaaagttacagcttacgatcaagcactacagaacgcagaaaatatcatcaatgccacaccaaacgtagagcttaataaagctacaattgaacaagcgctatcacgcgttcaacaagcacaacaagatcttgatggtgttcaacaattagctaatgctaaacaacaagctacacaaactgtcaatgggttaaatagcttaaatgacggtcaaaagcgtgaattaaatctattaattaattcagctaatacccgtacaaaagtacaagaagaattaaacaaagcaactgaattgaaccatgcgatggaagctttaagaaacagtgttcaaaacgttgatcaagtaaaacaaagtagcaattatgtcaatgaagatcaacctgaacagcacaattatgataatgctgtcaatgaagctcaagctacaatcaacaacaatgctcaacctgttctagacaaattagctatagaacgtttaactcaaactgttaacactacaaaagatgcattacatggtgctcaaaaactgacacaagaccaacaagctgctgaaactggaatacgtggtttaacgagtctcaatgaacctcagaaaaatgctgaagtagctaaagtaactgcagcaacaacacgtgatgaagtgagaaatattcgtcaagaagcaacaacattagatactgcaatgcttggtttacgtaaaagcattaaagataaaaacgatactaaaaatagtagtaaatatattaatgaggatcatgaccaacaacaagcttatgacaatgctgtaaataatgctcaacaagttatcgatgaaactcaagcaacgttaagctcagatacaatcaatcaattggcaaatgccgtaactcaagctaaatctaatcttcatggagatactaaactacaacacgataaagatagtgctaaacaaacgattgctcaattacagaatttgaattcagctcaaaaacatatggaagattctttaattgataatgaatctacacgtacgcaagtccaacacgatttaacagaagctcaagctttagatggtttaatgggtgccttaaaagaaagtattaaagattatactaatattgtttcaaacggtaattacatcaatgcggaaccatctaagaaacaagcatatgatgcagctgtacaaaatgctcaaaatataataaatggaacgaatcaaccaacaattaataaaggtaatgtcactacagcaacacaaaccgtgaaaaatactaaagatgccttagacggtgatcatagattagaggaagctaaaaataatgccaatcaaacaatcagaaatctatctaatttgaacaatgcccaaaaagatgcagagaaaaatctagttaatagcgcatcaacattagaacaagttcaacaaaacttacaaaccgctcaacaattagataatgctatgggtgagttacgacaaagtattgctaaaaaagatcaagtgaaagcagatagtaaatatctaaatgaagatcctcaaattaagcaaaactatgatgatgcagttcaacgtgttgaaactattattaacgaaactcaaaaccctgaattacttaaagcaaacattgaccaagcaactcaatccgttcaaaatgcagaacaagctttacatggtgctgaaaaattaaatcaagacaaacaaacgtcttcgacagaactagatggattaacagatttaacagatgcacaacgtgaaaaactcagagaacaaattaacacttctaatagtagagatgatattaagcaaaaaattgagcaagcaaaagcactaaatgacgcaatgaaaaaacttaaagaacaagttgcgcaaaaagatggtgttcatgctaacagtgattatacaaatgaagattctgcacaaaaagatgcgtataataatgcacttaaacaagcggaagacattattaataacagctcaaatcctaacttaaatgcacaagacattactaatgctttaaataatattaaacaagcacaagataaccttcatggagctcaaaaattacagcaagacaaaaatacaactaatcaagccattggtaacttaaatcatcttaatcaacctcaaaaagatgcgcttatacaagctattaatggagctacatctagggaccaagttgcagaaaaacttaaagaggccgaagcgcttgatgaagctatgaaacaacttgaagatcaagtgaatcaagatgatcaaatttcaaatagcagcccattcataaatgaagactcagacaaacaaaaaacttataatgataaaatccaagctgcaaaagaaataattaatcaaacatctaatccaaccttagataaacaaaaaattgctgatacacttcaaaatattaaagatgcagtgaataatttacatggtgatcaaaaattagctcaatctaaacaagatgctaataatcaattaaatcatttagatgacttaaccgaagaacaaaaaaaccattttaaaccgttaattaataatgctgatactcgagatgaggtaaataaacaactagagattgctaaacaattaaatggtgatatgagtacacttcataaagtcataaatgataaagatcaaattcaacatttaagcaattacattaatgctgataatgataaaaaacaaaattatgataatgctattaaagaagctgaggatttaattcataatcatccagatacattagatcataaagcattacaagatttattaaacaagatagaccaagcgcataacgaattaaatggagaatccagatttaaacaggctttagacaatgctttaaacgacatagatagcttaaacagtctcaatgttccacaacgccaaactgttaaggataacatcaaccatgtgacaactctagaaagtttagctcaagaattgcagaaagcaaaagagcttaatgatgctatgaaagcaatgagagatagcattatgaatcaagagcaaattcgtaaaaatagcaattatactaatgaagacttagctcaacaaaatgcctataatcatgcagtagataaaataaatcacattattggtgaagacaatgcgacgatggatcctcaaataatcaaacaagcaactcaagatataaatacagctataaatggattaaatggagatcaaaaacttcaagatgcaaagacagatgctaaacaacaaattactaactttactggtttaactgaaccacaaaaacaagcattggaaaacatcattaaccaacaaacaagcagagcaaatgttgctaaacagttaagtcatgctaaattcttaaatggaaaaatggaagaattaaaagttgcagtagccaaagcgtcattagtaagacaaaatagtaactatattaatgaagatgtctctgaaaaagaagcatatgaacaagctatcgcaaaaggtcaggaaataattaattcagaaaataatccaacaataagtagtactgatatcaatcgtaccattcaagaaattaatgatgctgaacaaaatcttcatggtgataataaattaagacaagcacaggaaattgcaaagaatgaaatacaaaatctagacggattaaattcagctcaaataacaaaattaatccaagatataggcagaacaacaactaaacctgcagtaactcagaaactagaagaagcaaaagcaataaaccaagctatgcaacaacttaaacaaagtatagccgataaggatgctactctaaattctagtaactatctcaatgaagattctgagaaaaagttagcgtacgataatgctgtaagccaagctgaacaactcataaatcaacttaacgacccaactatggatataagtaatattcaagctattactcaaaaggtcattcaagcaaaagattcattgcacggtgcgaataaacttgcacaaaatcaagcagattcaaatttaataataaatcaatcaacaaatttaaatgataaacaaaagcaagcattaaatgacttaattaatcatgctcaaactaaacagcaagtggcagaaataattgcacaagctaataagttaaataacgaaatgggcacactaaaaacactcgtagaagaacagtcaaacgttcatcaacaaagtaaatatattaatgaagatccgcaagttcaaaatatttataatgactccattcaaaaaggtcgagaaatattaaacggcactacagatgatgttttaaacaacaataaaatagcagatgccattcaaaacattcatttaactaaaaacgatttacatggtgatcaaaaattacaaaaagcacaacaagatgcaaccaatgaattaaactatttaacaaatctaaacaattctcaaagacaaagcgagcatgatgagattaactctgctccttcaagaactgaagtttctaatgatttaaatcatgctaaagcacttaatgaagctatgcgtcaacttgagaatgaagttgctcttgaaaacagtgttaaaaaattaagcgactttatcaatgaagatgaagcggcacaaaatgaatatagtaatgcacttcaaaaagctaaagacattatcaacggcgttccaagtagcactttagataaagctacaattgaagatgctttattagaattgcaaaatgctagagaaagtttacatggtgagcaaaaacttcaagaggctaaaaatcaagctgttgctgaaattgataatttacaagcattaaatcctggacaggttcttgctgaaaaaacattagttaaccaagcatcaaccaaaccagaagttcaagaagccttacaaaaagcaaaagaacttaatgaagctatgaaagcactgaaaactgaaataaataaaaaagaacaaatcaaggctgatagtagatatgtaaatgctgacagtggtcttcaagcaaattacaattctgcgttaaattatggttctcaaattattgcaactacccaaccaccagagcttaataaagatgtaataaatagagcaactcaaacgattaaaactgctgaaaataatttaaatgggcaatctaaattagcagaggctaagtcagacggaaatcaaagcatcgaacatttgcaaggattaacacaatcacaaaaagataaacaacatgatttaattaatcaagctcaaactaaacaacaggtagatgatatcgtaaataactctaaacaattagataactctatgaatcaactacaacaaattgttaacaatgacaatacagtaaaacaaaatagtgatttcattaatgaagattccagccaacaggatgcttataatcatgcaattcaagcagcaaaagatttgataactgctcatccaactatcatggataaaaatcaaatagatcaagctattgaaaatatcaaacaagcacttaatgatttacacggtagtaataaactatcagaagataaaaaagaagcttcagaacaactacaaaaccttaatagcttgacgaacgggcaaaaagatacgattttaaatcatattttcagtgcaccaacaagaagccaagtaggagaaaaaattgcaagtgctaaacaattaaataatacaatgaaagcacttagagattctattgctgataataatgaaattttacaaagtagtaagtacttcaatgaagattctgaacaacaaaatgcttataatcaagccgtaaataaagctaaaaatataattaatgatcaaccaacaccagtaatggcaaatgatgagattcaaagtgtcctaaatgaagttaaacaaactaaagataatttacatggtgatcaaaaacttgctaacgacaagacagatgctcaagcaacattaaatgcgttaaattacttaaatcaagcgcaaagaggtaatcttgaaactaaagttcaaaactctaattctagaccagaagtacaaaaagtagttcaattagcaaatcaacttaatgatgcgatgaaaaaattagatgatgctttaactggtaatgacgcaataaaacaaacgagtaattatattaatgaagatacttctcaacaagttaactttgatgagtatacagatagaggtaaaaacatagttgctgaacaaacaaatccaaatatgtctccaactaatattaacactattgctgataaaattactgaagctaaaaacgatttacatggcgtacaaaaactaaaacaagctcaacaacagtccatcaatactattaatcaaatgactggtctaaaccaagctcaaaaagaacaattaaatcaagaaattcaacaaactcaaacccgttctgaagtacatcaagtaattaataaagcacaagctttaaatgattcaatgaatactttacgtcaaagtattactgatgaacatgaagttaaacaaacaagtaactacatcaatgaaactgttggtaatcaaactgcatataacaatgccgttgatcgtgtaaaacaaataatcaatcaaacatctaatccaactatgaatcctttagaggtggaacgtgcaacatcaaatgtaaaaatttctaaagatgcacttcatggtgaacgtgaattgaatgacaataaaaattcaaaaacttttgcagtcaatcacttagataacctcaatcaagctcaaaaagaagcattaactcatgaaattgaacaagcaactatagtttcacaagtaaataatatctataacaaagcgaaagctttaaataatgatatgaaaaaacttaaagatatcgttgctcaacaagataatgtgagacaatcaaacaattatataaacgaggatagtacacctcaaaatatgtacaacgatacaattaatcatgcacaatcaatcattgatcaagtagcaaaccctacgatgtctcatgacgaaatagagaatgcaatcaataacataaagcatgccatcaatgcactcgatggagaacataaattacaacaagcaaaagaaaatgcaaacttattgattaatagtttaaacgatttaaatgcaccacaaagagatgccataaatagattggttaatgaagctcaaacaagagaaaaagtagctgaacaacttcaaagtgctcaagctttaaatgacgctatgaagcatttaagaaacagcattcaaaatcaatcatccgtaagacaagagagcaaatatattaatgcaagtgatgctaaaaaagagcaatataatcacgcagttagagaagtcgaaaatattatcaatgaacaacatccaacattggataaagaaataattaagcaactaacggatggtgtaaatcaagcgaataatgacttaaatggcgttgaattattagatgctgataagcaaaacgcacatcaatcgatacctacattgatgcacttaaatcaagcacaacaaaacgcattaaatgaaaaaattaataacgcagttaccagaactgaagttgcggctattattggccaagcaaaactactcgatcatgctatggagaatttagaagaaagtatcaaagataaagagcaagtcaaacagtcaagtaactatattaatgaagattctgatgttcaagaaacatacgataacgccgttgatcatgtgacagaaatacttaatcaaacagtaaatccaactttatctattgaagatatagagcatgctatcaacgaagttaatcaagcgaaaaaacaactcagaggtaaacaaaaactttatcaaactatcgatttagctgataaagaattaagtaaattggatgatttaacatcacaacaaagcagttcaatatctaatcaaatatatactgctaaaacgagaacagaagttgcccaagcaattgaaaaagcaaaatcattaaatcatgcaatgaaagcacttaacaaagtatataaaaatgcagataaagtgttagatagtagtcgattcattaacgaagatcaacctgaaaaaaaggcgtatcaacaagctataaatcatgttgattcaatcattcatagacaaacaaatcctgaaatggatccaacagtaatcaatagcataactcatgaactcgaaacagctcaaaataacttacatggtgatcagaaacttgctcatgcacaacaagatgccgctaatgtaattaatggtctaattcatcttaatgttgctcaacgtgaggtaatgataaatacgaatacaaatgctacaacacgcgaaaaagttgcaaagaacttagataatgctcaagctcttgataaagctatggaaacactacaacaagtagttgctcataaaaataatatattgaacgatagtaaatatttaaatgaagattcaaaatatcaacaacaatacgatcgagttattgctgatgccgaacaactacttaatcagacaacaaatccaacattagaaccttataaagtcgatattgttaaggataatgtcctagctaacgaaaaaatactatttggcgcagaaaaactatcatatgacaaatcaaatgcaaatgatgaaattaaacatatgaattatcttaataatgcacaaaagcaatctataaaagatatgatttctcacgcagcattaagaactgaagttaaacaacttctgcaacaagctaaaatccttgatgaagccatgaaatcacttgaagataaaactcaagtagtgattacagatactactttgcctaattacactgaagcttcagaggataaaaaggaaaaagtagaccaaactgtatcacatgctcaagcgattattgataaaataaatggctcaaatgtaagtttagatcaagtacgacaagcactagaacaattaactcaagcatcagaaaacctcgatggtgatcagcgagttgaagaagctaaagttcatgctaatcaaacaattgatcaattaacacatcttaattcattacaacaacaaactgcgaaagaaagtgttaaaaacgcaacaaaactagaagaaatcgctactgttagtaacaatgctcaggcattaaacaaagtaatgggtaaattagaacaattcattaatcatgctgattctgttgaaaatagtgataattatagacaagccgacgacgacaaaatcatcgcttatgatgaagcacttgaacatggacaagatatacaaaaaactaacgcaacccaaaatgaaacaaaacaagcgttacaacaattaatatatgcagaaacatcgttaaatggtttcgaaagattaaatcatgctagaccacgagctttagaatatatcaaatcactagaaaaaataaacaatgctcaaaagtctgctttagaggataaagtaacgcaatcgcatgatttattagaattagaacatattgtcaacgagggcacaaacctcaatgacattatgggtgaattagctaacgcaatcgttaataactatgctccaaccaaagcaagtataaattatattaacgccgataacctacgcaaagataactttactcaagctatcaacaatgcacgtgatgcactcaacaaaactcaaggtcagaacttagatttcaatgcaattgatacatttaaagatgatatattcaaaactaaagatgcacttaacggtattgaacgtttaacagctgcaaaatcaaaagcagaaaaactaattgatagtttaaaatttattaataaagctcaattcacacatgcaaatgatgaaattatgaatactaattctattgcacaattgtctagaatcgtgaatcaagcatttgatttaaatgatgcaatgaaatctttaagagatgaacttaataatcaagcttttcctgtccaagcaagctcaaattatataaattcagatgaagatttaaaacaacaatttgaccatgctttaagtaatgctcgaaaagttcttgcaaaagaaaatggtaaaaatttagatgaaaaacaaattcagggactcaaacaagtgattgaggatactaaagatgctttaaatggtatccaacgtttatcaaaagctaaagctaaagcaattcaatacgtacaatctttatcttatatcaatgatgcacagcgtcatattgctgaaaataatattcacaactctgatgatttatcatctttagcaaatacattatctaaagctagtgatttagataatgcaatgaaagacttacgagatactatagaaagtaattcaacttctgttccaaatagtgtgaattatattaatgctgataagaatttacaaattgaatttgatgaggcgctacaacaagcaagtgcaacaagttctaaaacttcagaaaatccagcaacgattgaagaagtattaggtcttagtcaagccatttacgatacaaaaaatgcattaaatggtgaacaacgacttgcaactgagaagagcaaagatctaaaattaataaaaggattaaaagatttaaataaagcacaacttgaagatgtcacaaacaaggtaaattcagcaaatactttaacagagttatctcagctcactcaatcaacgttagaattaaacgataaaatgaaattattgagagataagcttaaaactttagtaaatcctgttaaagcaagtttaaattatagaaacgctgattataatttaaaacgtcaatttaacaaagctttaaaagaagctaaaggcgtattaaataaaaatagcggtacaaatgtcaatatcaatgacattcaacatcttttaacacaaatagataatgctaaagaccaattaaatggtgaacgacgtctaaaagaacatcaacaaaaatctgaagtatttattattaaagaattagatatacttaataatgctcaaaaagctgcaataattaatcagattagagcgtctaaagacattaaaataattaatcaaatcgttgataatgcaatagaattaaatgatgctatgcaaggtttaaaagaacatgtagctcaattaacagcaactacaaaagacaacattgaatatttaaatgctgatgaagaccataaattacaatatgattacgctatcaacttagcgaataatgttcttgacaaagaaaacggtacaaataaagacgctaatatcataattggaatgattcaaaacatggatgatgctagagcacttctaaatggaattgaaagacttaaagatgctcaaacaaaagcacataatgacattaaagatacgctcaaacgtcaacttgatgaaattgaacacgctaatgcaacatcaaattctaaagctcaagctaaacaaatggtaaatgaggaagctagaaaagcgctttctaatattaatgacgcaacatcaaatgatttagttaatcaagcaaaagatgaagggcaatctgcaattgaacacatacatgcagatgaattacctaaagcaaaactagatgctaatcaaatgattgaccaaaaagttgaagatataaatcacttaattagtcaaaatccaaacttatcaaatgaagaaaaaaataaactaatatctcaaattaataagttagtaaatggaattaagaatgaaattcaacaagctataaacaaacaacaaatagaaaatgctacaacaaaactagatgaagtcattgaaactactaaaaaattaattatcgccaaagcagaagctaaacaaatgataaaagagttatcacaaaagaaacgagatgcaataaataacaacactgatttaacaccttctcaaaaggcacatgctttagcagatattgataaaacagaaaaagatgcacttcaacatatcgaaaattctaattcaattgatgatatcaataacaataaagagcatgcatttaatactttagctcatatcattatttgggatactgatcagcaaccattagtttttgaagtacctgaattgagccttcaaaatgctctagtaacaagtgaggtggttgttcacagagatgaaactatttcattagaatctataaaaaaaaaaatgactttaactgatgaacttaaagtcaatattgtttcattaccgaacactgataaagtagctgatcacctaaccgctaaagttaaggttattttagctgatggctcatatgtcactgtaaatgttccagtcaaagttgtagaaaaagaattacaaatagctaaaaaggatgctataaaaacaattgatgttctggtaaaacaaaaaatcaaagatatagattctaataacgaattaacgtctactcaacgtgaagatgcaaaagctgaaattgaaagattgaaaaagcaagccatcgataaagtgaatcattcaaaatcgattaaagatattgaaacagtaaaacgaactgattttgaagaaatagatcagtttgatcctaaacgctttacgctaaataaagctaaaaaggatatcattactgatgttaatactcaaatccaaaatggtttcaaagaaattgaaacaataaaaggtttaacttctaatgaaaaaactcagtttgataaacaattaactgcactacaaaaagaatttttagaaaaagtcgagcatgctcataatttagtagaattaaatcaattacaacaagagtttaataatagatataaacatattttaaaccaagcacatttactaggtgaaaaacatatagcagaacataaattaggatatgttgtagtaaacaaaactcagcaaatactaaataatcaatctgcttcttactttataaaacaatgggcacttgatagaattaaacaaattcaactagaaacgatgaattcaattcgtggtgcgcataccgtacaagatgtacacaaagcattattacaaggtatagagcaaatcttgaaagtaaatgtaagtattataaatcaatctttcaacgattccttgcataactttaattatcttcattcaaaatttgatgctagattaagagaaaaggatgttgcaaaccatatcgtacaaactgaaacattcaaagaagttctaaaaggaacgggtgttgaaccaggtaaaatcaacaaagaaacacagcaaccaaaacttcataagaatgataatgatagcctattcaaacatttagttgataatttcggcaaaactgtaggtgttattacattaactggtttactttctagtttctggttagttttggctaaaagacgtaaaaaagaagaagaagaaaaacaatcgataaaaaatcatcacaaagatattcgtctttcagatactgataaaatagatccaattgtaataactaagcgtaaaatagataaagaagaacaaattcaaaacgatgacaaacattcaattccagttgctaaacataagaaatctaaagaaaagcaattgagtgaagaggatattcattcaatccccgtcgttaagcgtaaacaaaacagtgataacaaagatacaaaacagaagaaagttacttctaaaaagaagaaaacgcctcaatcaactaaaaaagttgtaaaaaccaaaaagcgttctaaaaagtaa

SEQ ID NO: 327 - DNA, 174 bp, S.epidermidis
atcagaggcaacaattatctttatattatccatgtacttaccacctattctttaaataatgaaacgaataatttagtgattgttgttttagagatgcgacctattacttcaaatttgtcgttttctttaggtctaacaattggtaatgaatctatctctttatcaatcatttga

SEQ ID NO: 328 - DNA, 651 bp, S.epidermidis
tttttattaaacataaaagaggtgaaatcaatgctagaatttagaaatgtgtataaatcttttaagaagaaagaagtattatgtgatgttaattacaaattatctgctggagaaaaggttggtcttataggttctaatgggtctggaaaatcaacattaatgaaacttatagctaaaactcaattaccatctaaaggaaatgtttattttaacaatatagatatacataaatctcacaatatgataaaagatttttctttcatgataggacaaatatattatcctgagttaaatgcaagacaaaatattgaaaattacctaaaaattaataataagattagctatataagtgaaattcaaaagatgctaaacattgtaggtttagaagatattgaaaagaaggttaaaaattattcgtatggaatgaaacaaagactttgtttagctatttgtttaattaccaaaccaaaagtagctgtattagacgagccattcttaggtttagatccgcttggggtaagggaattaaataatatcactgagaaatattcaaaagaaaaaaacactttatttttaatatctagtcaccagttaaaagaattagaagatctttgtgatagatttctattactcgaaaacccatcaaattag

SEQ ID NO: 329 - DNA, 570 bp, S.epidermidis
aaccaattaaaaggaacgtgtttaaatatgagattaaacgaaaaaacaatcgatagaacagttatatataatggtagtattattgatttagaagtacatgatgttgaattacccgatggtagcacatctaaacgtgaacttgtatttcatcatggtgcggtggcagtgtgtgcaataactcctgaaaatgaagttttattagttaaacaatttcgtaagcctgcagatcaaccacttttggaaattcccgcaggcaaattagaaaagggtgaagatcgtaaagaagcggctattagagaactacaagaagaaacaggatatattgcttcagatttgcaatttgtcactaatatgtatgggtctcctggattttcaagtgaaaaactttctatatacttcacagaccaattaacggttggagaaaccaatttagatgatgatgaatttgtggagcttcacaaagtacctttaagtcaaatcgattcattgttaaaagataataaaattgaggatgccaaaacaatcattgcattgcaacatctattattaaattataatcattctaaataa

SEQ ID NO: 330 - DNA, 156 bp, S.epidermidis
tatgaattaaaattgtattcatatcaaatgaaatccataaacatatttgactatgcgattgagttacttttaatactacgcaataaaagtatcgtaactaaaattatgtttaatcataaagaatatcatcttttattatatttatttaagaattga

SEQ ID NO: 331 - DNA, 138 bp, S.epidermidis
atgatgttaaactttaatcacacatttaaatttacatttaagttgtcggtcccaattaaaaatttaaaacacatatttttattaaatatcgttttaaaactatgtccaattaaaaatagagatgaaatacttagctaa

SEQ ID NO: 332 - DNA, 1170 bp, S.epidermidis
tgtcagttaaaatatatttatacaagtaaaaagggggtaccatatatgattaatcaaaaacgtttattagattgttttctagaattagtgcaaattgattcggaaacagggcacgaagaaacaattcaaccttatcttaaagatacgtttgaaaaaatggggctccatgttattgaagatgaagcttcaaaaaataatagattaggtgctaacaatcttatttgtacgttaaaaagtaatataagtcatcagaatgtgccgaaaatttattttacaagccacatggatactgtcgttccaggaaaaaacatccaacctgtagtaaaagaagatggatacgtttatagcgatggaactacgatactcggggcggacgataaagccggtcttgcggcaataattgaagcgattaaacaaattaaggaatcaaatttgccacacggacagattcaaataattattaccgtgggagaggaatctggattagtaggtgctaaagcaatagatactcgccttcttgatgcagatttcggctatgctgtagatgcaagtaaagatgttggaactactgttatcggtgctccaactcaagtaaagatttatacaactataaaagggaaaaccgcccatgcaagcacacctaaaaaaggtattagcgcaataaatattgcatcaaaagcaatcagtcgaatgaaattgggacaagtcgatgcattaacaacagccaatataggtaaatttcacggaggttctgccactaatattatagctgatgaagtcactttagaggcagaagcacggtcacatgatgatcaaagcattaataaacaagtgaaacatatgaaagagactttcgaaacgacagcaaatgaattaggcggtcaagctgaagtgttagttgaaaaaagttatccgggatttgaagttagtgaagctgacaaagtaacacaatatgctatatctagtgcattagccctcggtctaaaaggtgatacttgtattgctggtggtggttcagacggcaacatcatgaatcaatatggcattccttctgtgattttaggagtaggatatgaaaacatacatactacttcggaaagaatagcaataaaggatatgtatatgctcacaagacaaataataaaaattattgagctagtagctgaataa

SEQ ID NO: 333 - DNA, 1386 bp, S.epidermidis
tcagagttaaataggaggaattcaatgatgtatcgatgtttgattgcaaatagaggcgaaatagcagtaagaattataagagcttgtagagagcttaacatagagacagttgccatttatgcaaaaggtgatgaaaatagcttacatgtaagtttagccgatcaagcaatatgcataggtgaagcaaatccattagacagttatttaaatattgatcgtattatatctgctgcaaaagttacagaatcaaacgtaattcaccctggctatggtttcttatcggaatctacgaattttgcgaaagccgttgaagacaatcatatacattttattggacctagtaagacaactatggaaatgatgggggataaaattactgccagacaaactgttaaacaagcaggagtacctgttataccaggttctaatgatgctgttcaaagtgtagatgaaattaaattattatccaaagaaataggatttccagttgtactaaaagcagctagtggtggtggtgggaaaggcatcagaattgttaaagaagcatctcatttggatcaggctttgaaagaagctaaaagtgaaggacaaaaatattttaatgatgatcgagtgtatgtagaggcgttcataccagtagcaaaacatgtagaagtgcagattatcggagacggtaaaaataactatgttcacttaggtgaacgcgattgttctgttcaacgaaagaatcaaaaattaatagaagaagcgccttgtgctgcattaactgaagaaagaagaacaagaatatgtggcgacgcagttaaagtagctcaagcttcaagatatcgtagtgctggaacaatagaatttttagttacagaagatgcacattattttattgaaatgaatgctcgtattcaagttgaacatacagttacagaaatgcgtgctgatagagacctattacaagctcagttatatttattaacacacggtgaattaccattcactcagaaagatattttatttaatggtcatgtaattgaggcgcgtataaatgctgaaaatcctgaaaaaaactttttacccactccaggaaaagttaataaattacacttaccacaaggatttaatatacgtgtagattctttactttacacaggttatcaggtttctccttattatgattcacttgtagctaaagtgattgtaaaggattctaatagacaaactgctattaataaattaaaagttgcgttagatgaaatggtcatcgaaggttttactactacagctgactttttatatgcggttttaaattatccaatatatgcaaaaggcgatgccagtaaagtagatataaaatttcttgaaaaacatcaaatcattaaagaggtgaaatga

SEQ ID NO: 334 - DNA, 162 bp, S.epidermidis
gcccaaataaaaagcaaacttacgaacaccacagatgactatcttatgaaaatatcataccacaatttaaaaagagaagtaaattttaaagacttatcatttaactcaaatgtgtattattttctcgtgtattctaaactagttaccaaaattataatataa

SEQ ID NO: 335 - DNA, 348 bp, S.epidermidis
caatcgataaaatcaacgcataatcgtatgattactgttgatattacggttaatgacgaaggtaaggtcacagatgtagtcatggatggtcatgctaatcatggtgaatatggtcatgatattgtctgtgcaggagcatcagcagtcttatttggaagtgttaatgctataatgggattaacatcagagaagccagatatcaactacgaagatgacggcggatattttcatataagaagtgttgatacgaataacaaagaagctcaattaattcttcaagcaatgttagtttctttacaaactatagaagaagaatataatgaaaatatcaaattaaattataagtga

SEQ ID NO: 336 - DNA, 1902 bp, S.epidermidis
agagggataaaaatgagtgatcgttttataaaattcaacgatgaacaattagatgcaaaacaagtaatgatgttacaagacttagcacgtttacttttaaaaaatgagcaaacgcaagttaaaatacaaaaattcccttactataatccttatagtaatacactcattgcgagttggttttggtctcatagaccgaaacatattgaacaagctggactaaaaacagatgtcttactcgcaacgtatggatatctgaatatggatctttcaatcatcaatcaagttttacacaacaacgattttgaacaccctaagttctttcatcaattatttaaacttttagaggacgtacgtatatttgaacatattagacaacaaagacctagtactacaaaaatgattgatttacgcatagaaacacgattatcttttacagaatctcaaattaatttctacaaaactaaaactgtatatactgatttactttttctttatttagaacatgcatttttaagtcaaaacttttttaatattccatccatacatccagcatttgatgatattttagttcatatgtatcagtacttaccaaatatttttcagaatcaaacatcagaagataatatgtatttagcagaacgtattatgtatcaagtggatgatttattaaaggaagatatgctaaatgaatattactacttacctcaaaaattatatgaagatatttatgcagatagttttgaagacttaaagcgtacagatgcgagcaatactgatggtaaagataatcaacagacagacgaagatgtagaaacagctgaagctgaaacaaaagccgcagacagtgagtctaaaggcggggcatatttagaaatggagctacatgagggtgaaaacagtgaagttatggctgataatgatacggctcgagaaggcgacagcactgatgatatgactgatatgatgaccaaaaaaggaaaagggtcagaaaatacacttgatcatgatgaaggtggatttataggacaaaaccaagcttttgctttaaaaggcattaataaagacgtaagtattgaatggaatatccctgatattacacctcaaaatgtgatagattatcaatattcaaaaaatgatgtacagtttgaaattaaagatttaatacaaattatcaaaaagaccatcgacagagaacatgaagatgaaagacataatttaacaaagggccgtttacaaaaagaccttattaattggtttattgatgatcaatttaagttattttacaaaaaacaggatttaagtaagacattcgatgcaacatttaccttactcattgatgcatcagcgagtatgcacgataaaatggatgaaacgattaaaggtgtcgtcttgttccatgaaacattaaaatctttgaatattaaacatgaaatactagcatttaatgaagatgcttttgaagctgaccaacgtcaacaaccaaatatcattgatgaaatcattaattataattactctatctttgaaaaagaaggcccacgtatcatgacattagaacctcaagatgataatcgtgacggcgtagctatcagaattgcgagcgagcgtttattacaaagaagtcatgaacaacgctttttaatcgtattctcagatggtgaaccgtctgcatttaattacagtcaagatggtattttagatacgtatgaagctgttgaacgtgcgcgtaaatttggtatagaagtatttaatgtctttcttagccaagagccaattactgaagacattgaacaaaccattcataacatatatggccaatttgctttatttgtagaaggtgtggaacatttaccgagtcacttatcaccattactaaaaaaattgttacttaaatctttataa

SEQ ID NO: 337 - DNA, 180 bp, S.epidermidis
attactgtaaaaataaataatgctaaattcccactattatgtgcaataggagtcacagtcatttcaaatgaagttgaagctgtacgtggtatcgcaaataatggtcctatagtgagatatatgataattaaaaagattaacgaaaatcgtggtgatattttattaaaagacccaatataa

SEQ ID NO: 338 - DNA, 411 bp, S.epidermidis
agaggagtaaaagtaatggctaaaatatattttgatgctgcgactaaaggaaatcccggccgaagtgcttgtgcgattattattaaagaaaattcacaaagatatacatttacccatgatttaggtaaaatggataatcatagtgcagaatgggcagcaatgttacacgctttggaacatgcacgcgaattaaaagtatctaacgcgttactttatactgattcaaaattaattgaagatagtatgatgcaaggtaaagttaaaaatgctaagtttaaagtttattttgaaaacatagaaatcttagagcaaagttttgatttgatgtttgtgagatggattccacgaaagcgaaataaagaagcgaatcaacttgctcaacaaacactataccaacttacatcacaataa

SEQ ID NO: 339 - DNA, 189 bp, S.epidermidis
ataacggtaaaaccttttctgaaccatacgcatagcgcatggttttctttatacaataaagaagccagtaatgaatttataaaaaattcatttactggctattttgctaggaattatatcccagactcattgaactcaaaatttatatatattactatccggaaccgagtttggaaagtacttcaatga

SEQ ID NO: 340 - DNA, 297 bp, S.epidermidis
gatttgtcaaaatataaatttaaagggtctttaattattgatgcattgctagccttttttatagttagtacaataacaatgattttaatacctatgttttcaaacttaaacaatcagtatcttatcaatttaaataatataaaaatcaagcaaatcatgataactagccttcaacactataaaaagaaagaactttatcaaggggttgtaatagaaaattatgaaatacaattattcaataataaaatatgtggggaggataaagcatttaatacgcgaacatgtatttcaatttaa

SEQ ID NO: 341 - DNA, 759 bp, S.epidermidis
ttaaccaaaaaggagagtcaaatgagtaaagaacaagagagattacaaaaaagaatcgctaatagcggatatacatctcgtcgaaaagcagaagtacttatcactgaaggacgagttaaagtcaatggacaaactgtaacagaattaggttccaaagtgatgccatcagatttagttgaagttgatggtattaaaatcgaacaagaagacaaaatttatattttattttataaaccaactcaagtcattacaagtgtctctgatgatcgtggacgtagggtggttacggattactttgatgatctagaatcacgtatttatccggttggacgattagattatgacacatctggagttttattattaactaatgatggagaatttactaatttgatgacacatcctcgatatcacattaaaaagaaatacgttgctaaattaaaaggttatttaatgagagaggaaattaagcaacttgaaaaaggaatagaattagaagatggttacacacaaccagcacaagttaaaataaaaaagcaagataaagaaaaaaatacgactttagttgaaattacaattagtgaagggcgaaatagacaagttagacgtatgtttgagtatttcggtcatcaagttaataagttaacaagaattcaatttggccctatagatttaaaaggtttgaacgccggtgaaggaagagttcttacaccacatgaagtaaaaatattaagacatttggcagaaaacggtaaataa

SEQ ID NO: 342 - DNA, 1020 bp, S.epidermidis
agaaatcgaaaaataaaaaggagcgatttaatgtttagtattggttttataatcattgcagtcattatagtagttgcactactcattctgttttcatttgttccggtcggattatggatttcagcactagctgctggagtacatgttggaataggcacacttgtggggatgcgtttaagacgggtttcaccaagaaaagttatcgcacctctgatcaaagcgcataaagctggtttaaacttaactacaaatcaacttgagtctcattacctagcaggcggtaatgttgatcgtgttgtagatgcaaacattgcagcacaacgagcagatatcgacttaccatttgagcgaggcgctgccattgatttagcaggtagagatgtattagaagcagtacaaatgtcagttaatccaaaagttattgaaacgccatttattgcaggtgtagcgatgaatggtatcgaagttaaggcgaaagctcgtattaccgtacgcgctaacatagcaagacttgttggtggtgctggtgaagaaacaatcattgctagggtcggagaaggtatagtatctacaattggttctagtgagcatcatacagaagtgctcgagaatccagataatatctcaaaaacagtactaagtaaaggtttggactctggaactgcattcgaaattctatctatcgatattgccgatgttgatattagcaaaaacatcggtgctgatttacaaacagaacaagcacttgctgataagaacattgcacaagctaaagcagaagaacgtcgcgcaatggctgttgcttctgaacaagaaatgaaagcgcgtgttcaagaaatgagagctaaagttgttgaagctgaatccgaagtgcctttagctatggcggaagcattaagatcaggcaatattggagttaaagattattataaccttaaaaatattgaagcggatacaggtatgagaaatgcaataaataagcgcactgatcaaaacgatgatgaatcaccacaacaataa

SEQ ID NO: 343 - DNA, 990 bp, S.epidermidis
ttcaggcgaaagagtacaagaggaggttttatcatgagtaaaaacaaaaaacaaagccttcaatccgctcatcaaaaacctttgttaaaaagaatgtgggaacacaaagtactttacttaatgattttaccttgtttactctttttcttgattttcaactatattccaatgacaagtcttgttctggcattcaaagatttccgcttcgatactggtatcatcggcggtgattggaaagggctatactattttaaacgctttttctctgaccctcgatgtattcaaattattatgaatacgctaattataagtggcatgaaattgattttagctctaccatttccaattattttagccattatgtttaacgaaattaaagattctaaattaggtaagatcagaggtttatttcaaggcgtactttacatccctcattttttatcttgggttgtagttatcagtattttcaagaaattactcgctccagatgatggacttatgaatcaactgatccatcaatttggtggcgacgggtcgacttactttatgatgaaccctgagtatttccacaccatcatgttttctagttatatatggaagaatgtagggtgggattccattatttattttgcagcaattatgagtattaatcctgaaatttatgaatcagctgcgattgatggcgcgaatcgtttcaaacaaattatacatattaccttacctatgttaacaccaacaattgttattttattcatcatttctctaggcgatattttaaaagcagggttcgatcaaatttacctactcaaaacaccaggtaacgctaacgtttcagaaatactggatacatttgtgattcgtactggtattgagcaaggcgatttcagttacgcaattgcgattagtctattacagggtgtgataggacttatcgctgtcgtcattattaataaattcgcagataagaaactggatacatcactatattaa

SEQ ID NO: 344 - DNA, 693 bp, S.epidermidis
tcgtgtagaaatgagggagaaaagatgcacgaacaaagtaagatataccaaaatattaaagatggtaaattagataccgctttgaaagacttgtttgaaaatatagaagaaaatccggccattgttgaaaattatattaacgcaggtattgtattatcagatgttggagaaattgaaaaagcagaacgttttttccaaaaggcattaactattgaacctgaaaatggtgctgtttattataacttggcaaatatttattataatgaagaacgttataacgaagcgataaagctatatcaaactgcactacaatatgaagtagcgaaaaaagattgtaattatatgattggtatgtcgtttaatcaactaggtgcttttaaagaagctttaccatttttaatgactgcagctgaaatggacgatgatagagatttagaagtacagtttcaatatgggttagtactatgccaactcgaaatgtttgatgaagctattaaacaattaaataaggttctttctatcgattcacagcacgtagatggtatatataatcttggtttagcaacatatatgaaaaatgaaaatttagatgaagcaattgcatattttgaacaagcaatatcaattgatgaaaaacatttacttagtcaacatgcattaaagacattcaaaacaatgaaagaggaggaataa

SEQ ID NO: 345 - DNA, 126 bp, S.epidermidis
aaaaacagaaagaaattaaaatcaatttccttctgtgatacggtatgtattgatataaaaaacaccttactgcttggtaaggtgttagttaaagtcaatgattacaatctatttattatagtttaa

SEQ ID NO: 346 - DNA, 246 bp, S.epidermidis
ctagggggaaaaataagtatggcagaggtaaaagttccagaattagcagaatcaatcacagagggtaccattgcagaatggttaaaaaatgtaggcgataatgtagataaaggtgaagctatcttagaactagaaacagataaagttaacgtcgaagtagtttctgaagaagctggggtattatcagaacaattagccgaggaaggcgatacagttgaagtatgtcaagctgtagctgtagtatga

SEQ ID NO: 347 - DNA, 519 bp, S.epidermidis
attaatttgaagagtattcaagtgcctattattttagttggtttcatgggaactggtaaaactactgttggaaaatatctttcagatttatataatttaagttatgtggatttagataattttattgaagtaaatgaatgtaaatctatacctaatatatttaatgatatcggagaaaaaggatttagatcattggagactagatacctaaaatcttgtctcaatactttcgatattatttcaactggaggaggtattatagaagatacgaattcattaaagctcttaaaaaatcaaaagcatgtagtttggctagactgtgacattgaaatcattttcaaacgagttaaaaatgattcacatagacccaatgctaaaagtaaaaatcttaaccaacttgatgccttgtattcttcaagactttcaagatataatgaaatcgcattcatgaaagttgatagtgcacagagtgtttctgaaatttgcactttaattaaaacaaaattattaagcgattga

SEQ ID NO: 348 - DNA, 240 bp, S.epidermidis
tgcatattgaaagaatttagtcttggaggtttcagaattatgaaacaaggtacagttaaatggtttaatgccgaaaaaggttttggtttcatcgaagttgaaggagaaaacgacgtattcgtacacttctcagcaattaaccaagaaggatacaaatcattagaagaaggtcaatcagttgaatttgaagtagttgaaggcgatcgcggtcctcaagctgcaaacgttgttaaactataa

SEQ ID NO: 349 - DNA, 129 bp, S.epidermidis
ataaaattgaatgctatcacacttattaagcttgttattaaaatatacataaaggaggagcgacgtgataggcaaacactttattataactggagcaacgagtgggttaggttttgcaataaccaatga

SEQ ID NO: 350 - DNA, 498 bp, S.epidermidis
aaaattatgaaatacaattattcaataataaaatatgtggggaggataaagcatttaatacgcgaacatgtatttcaatttaatataaaagcatttacttacatcgaagcattatttgctttatttgtgactactttaattctcgctttattacctactatacttaaattgacttcgttttatcttaatactgctcaaaataacgaagatattcaatttgaattttttagaagagatttacttaaagagaaaatgacgactcaaaacaattatgagatagaaaatgcatatacaattaaacttaagaaagataaagatgttattagatatatttataaaaaccgtaaaatttacaaaaacattaatcaaaaaggtaatattacattgttaaatcacgtcttgtctactcgtatattaaaaacgaacgataatatagtaaaattattaataacaacaggagaaacgaacgatgaacacaaagaaatcctgtttatatag

SEQ ID NO: 351 - DNA, 126 bp, S.epidermidis
aaaataatgaagaattttaaatggaaatattttataaaacccaaattaataaaactttcagaacaaaaagcaaaaaccatctacagtcaaagaaaatttggtctggaagcttttttggatttgtga

SEQ ID NO: 352 - DNA, 417 bp, S.epidermidis
cgtttgatgaactcactgacttcatcaacgacttgcagtggtctcaagatcaaagtttcgaatgaggtggaaaaaaagatgtcagatgtttcattaaaattatcagcgaaagatatttatgaaaaagatttcgaaaaaactatggcaagaggctatagaagagaagaagtagacgcttttttagatgatatcattacagattatcaaaaaatggcggatatgaacaatgaagtagtaaagctttctgaagaaaatcacaaattaaaaaaagaacttgaggaattaagattacgtgttgctacatcaagaccacaagacaataaaaacttttcttcaaataattcaagcagtgcttcaaataatgtagatattttaaaacgtatttcaaaccttgaaaaagcagtattcggcaaataa

SEQ ID NO: 353 - DNA, 633 bp, S.epidermidis
attatgatgaattatccaaatggtaaaccatactctaaaaataagcctttggacggacgtaagagttcgccattttcaagtaatattgaatatggtggacgaggtatgacactagagaaagatattgaacaatcgaatactttctatcttaaaagtggcatagcagttattcataaaaagccgactccggttcaaatagttaatgttcactatccgaaacgtagtaaggctgtaataaatgaggcttattttcgcactccttcaacaactgattataatggtgtctataatggatattacattgattttgaagctaaagaaactaagaacaaaacttcatttccactcaataatattcatgcacatcaagtagaacatatgaaaaatacatatcatcaaaaaggaattgtctttttaatgatacgttttaaatcacttgatgaagtgtatcttttaccctattcaaaatttgaaaaatattggcaaagatacattaataatattaaaaagtcgataactgttgaagaaattcggaaaaatggttaccatattccttatcaatatcaaccaagattgaattacctcaaggcagttgataagttgatattagatgaaagtgaggaccgcgtatga

SEQ ID NO: 354 - DNA, 1287 bp, S.epidermidis
aaaggtgtgaaaaatgtgagtacagaaccattagcctctcgaatgagaccgaaaaatatagatgaaattatatctcaacaacacctggttggtccgaaaggtataataagaaggatggtagatactagacgtctttcttctatgattttttatggtccacctggaattggtaaaacaagtattgcaaaagcaatttcaggcagtacacaatttaaattcagacaattaaatgccgtaacaaatacaaagaaagatatgcagctaattgtcgaagaagctaagatgtcaggacaagttatcttactattagatgaaattcatcgtttagacaaagctaaacaagattttttattaccacatcttgaaaatggcaaaattgtattaataggtgcaacaacttcaaatccttatcatgcgataaatccagcgatacgatctagagcacaaatatttgagctttacccattagatcaagatgatataagattggcattagatagagctataaatgataaggaaagaggtttaagtacttatcatcctattgtagatgaagatgctatcgaatatttttcaacgcaaagccaaggcgacgttaggagtgcattaaacgctttggaattagctgtactaagtgctcatattggtgaagaaaacgaaagacatattacattagatgacgcaaaagattgcttacaaaaaggtgcttttgtaagtgataaagatggagacatgcattatgacgtcatgagcgcttttcaaaaatcaattagaggtagtgatgtcaatgcagcactccactacttagcacgtctaattgaagctggtgacttacctacaatcgtacgtcgattacttgtaattagttatgaagatgttgggttagcatcacctaatgctggtcagaggactttagcagcaatacaatcagctgaacgtctaggttttccagaagcacgaattccccttagtcaagctgtaatagaattatgcttatcacctaaatcaaattctggtatcacagcaatagataaagctcttggcgatataagaaatggacatataggtcaaataccggattatctgaaagacggtcattattcaggtgctaaaaagttaggacgggctataggttacaaatatcctcataactatgaaaatggtcatgttgtacaacagtacttaccagaaaaattaaaaaacagagtgtattatgaaccaaaaaccacatcaaaaagtgaacaacaatttaaaacaatttacgataacttacgaaataaaacataa

SEQ ID NO: 355 - DNA, 1857 bp, S.epidermidis
atgactaagaacaagaaagaatttacagaggctcctgtaaacttcggcgcaaatcttggccttatgctagatttgtatgatgattatctacaagatccatcatccgtacctgaagatttacaagtcttgttcagtacaattaaaacaggtgaagctcatatcgaagctaaacctaccactgatgggggtggttcacaagcgggagatagcacaattaaacgtgttatgcgcttaatcgataatattcgtcaatacggacatttaaaagcagatatttatccagtaaatcctccagagcgtcaaaatgttcctaaattggaaatcgaagattttgatttagataaagaaactttggaaaaaatatcatctggaattgtctctgaacattttaaagacatttatgacaatgcctatgatgcaattgttcgtatggaaagacgttacaaaggaccgatagcttttgaatacactcacattaataataataaagaacgtgtgtggttaaaaagaagaattgaaacgccttataaagcaagtttaaacgataatcaaaaaaaagaacttttcaaaaaactcgcacacgtagaaggttttgaaaaatatttgcacaaaaattttgttggggctaaacgtttttcaattgaaggcgtcgacacattagttccaatgcttcaacacacaatcacattagcaggtaacgaggggattaaaaacattcaaatcggtatggctcaccgtggacgtttaaatgtattaacgcatgtcttggaaaaaccttatgagatgatgatttcagaatttatgcatacagatccaatgaagtttttacctgaagatggtagtttagaattaacctcaggttggacttcagatgtgaagtatcacctaggtggcgttaaaacgactaactcatacggaatagaacagcgtatttctttagcgaataatccaagtcatttagaaatcgttgcacccgttgttgctggtaaaacaagagcagcccaagataatacacatcaagtaggagctccatctaccgacttccataaagcaatgccgattattatacatggtgatgcggcatatccaggtcaaggtattaattttgaaacgatgaacttaggtagtttaaaaggatattctacaggtggttcacttcatattattacaaataatagaatcggttttacaactgaacctattgatggacgttcaacaacgtactcttccgacgtagctaaaggttacgatgttccaatactacatgtaaatgccgatgatgtagaagcaacaattgaagctattgaaattgcaatggaattccgtaaagaatttcataaagatgtcgttattgacttagtaggttatcgtcgctatgggcacaatgaaatggatgaaccttctattactaatccagttccataccaaaacattagaaaacatgattcagttgaaattttatatggtaaaaagttagttgatgaaggaattatttccgaagacgaaatgaatgaagtcattgacggtgttcaaaaagaaatgcgaacagcacatgataaaattgataaaaatgacaaaatgaataatccagatatggaaaaaccagaatcacttcaactacctttacaaagtgatacgaaagatttctcatttgatcatttaaaagaaatcaatgatgcaatgcttgattacccaaaagattttcatgtgctaaaaaagctcaataaagtactagaaaaacgtagagaaccttttgaaaaagaggaggggctcgtcgattgggctcaagcagagcaacttgcatttgcaaccatattacaagatggaacttcaattcgtttaacaggtcaagaatag

SEQ ID NO: 356 - DNA, 231 bp, S.epidermidis
caggtcaagaatagtgaaaggggaacatttagccatagacatgctgtgcttcatgatgaagacaatggtaatacattcacaccattgcatcatgtacctcaacaacaggctacttttgatattcataattcgccattatctgaagcagctgtagttggatttgagtatgtttataacgtcgaaaataaaggtaactttaacatatgggaagctcaatatggcgacttttag

SEQ ID NO: 357 - DNA, 909 bp, S.epidermidis
tgcaagaagaagttggtgataaaggaaatgaagaaactacagatgaataaattaataaatataattaatacatcactgaataagtcaatacaatcatcaccattaaaaactaatttagaagaaagtatgaaatattcattaaatgctggtggtaaaagaatcagaccagtcatattattattaacactaaaaatgcttaacaaagattatcaacaaggactaaatagtgctttagcattggaaatgattcatacttattctttaattcatgatgatttaccagcaatggataatgacgattaccgtagaggaaaattaacaaatcataaagtttatggtgaatggaaagccattcttgctggtgatgcattattaacaaaagcttttgaattagtttctaatgatactaccattgaagatagtgtgaaagtaagtattataaaaagactttcaaaagcaagtggacatttgggaatggtgggtggccaagcgcttgatatggaaagtgaagggaagtcaattcgtttagaaactttagaatcaattcatgaaactaagacaggcgctttactaaatttttcagttatggctgcggtagacattgctcaagtagaacaaaatattgctaagaatttagatgaatttagtcatcatttaggaatgatgtttcaaattaaagatgatttactggatgtgtatggtgatgaatcaaaacttggcaaaaaagtaggcagtgatatagtaaatcataaaagtacttatgtttctttacttggaaaagaaggagcagaagaaaagttaaacaatcatcaatatcttgctatgaactgcttaaatcaaatttctgatcaatatgatacttctgaattaagtgatattgtagatttattctataacagagaccattaa

SEQ ID NO: 358 - DNA, 210 bp, S.epidermidis
caacaggagaaacgaacgatgaacacaaagaaatcctgtttatatagccgaaaagcgttcattagtttatatttaatagtaattttttcaatttatttatcaattatatctttttatatctctcaatatagtttaaaattaaagacaatacataacttagatgtttactacaataaagttatcgttaataagttaaaagaggtagattaa

SEQ ID NO: 359 - DNA, 123 bp, S.epidermidis
aaaaggaggaaatttgaacaacaaaaaacctccattttctcccatccagactatactgtcggcttcagactctcactgaatcaagacaaagcaaaaattaatacgttgtcgtcgcaggcttag

SEQ ID NO: 360 - DNA, 2448 bp, S.epidermidis
aagaggaggaataatatgtctgaccctacactttttgattattcaatgatcaaaggtacagttgatgctattttatttcaaaatacggataatttttatactgttctaaaagtagatactatagaatcaaatgaaaaatttgatagtatgccaactgtggtagggtttcttcccaatgtagttgaaggcgatgtttatacttttaaagggcaagtcgtacaacatccacgttatggtaagcaattaaaggctgaaacatttgaaaaagaattacctcaaactaaagaagccattattagttacttatcaagtgatttatttaaaggcatcggtaaaaaaacggctcaaaacattgtaaatacactaggtgaaaatgctataaatgatattttaactcgtccagaaatcttagaaagtgtacctagtttaccaaagaagaaacaaaagcaaattgctgatcagattaatgcaaaccaagaatctgagaaaattatgatacgtttacacgacctagggtttggtccgaaattatcaatggctatatatcagttctatatgggtgatactttaaatgtcttagataaaaatccttaccaattagtatatgacattaaaggtattggttttaataaggctgaccaacttgctcgaaatgtcggtattgagccacattcacctgaaagattaaaagcagcattattatttacgttagaagaagaatgtatcaaacaaggacatacatatctacctcgtacaattgttatagaaacaacacaaaatttactcaatgaagatattgagaaaccaattgaaacagagcaattactagaaatcattgacgttttatcagaagagaaaaaattaatatctgaagctgatcaggtatcaattccaagtttatactattcagaattgaaaagtgtgcaaaacttataccgaattaaaacaaacacatctaaattaaaagaaatagaacagtctgatttacaaatacatattggtgatattgagtcacaaaatgaggttaattactctgcctctcaaaaagaagcgcttgaaacagcaataaattctaaaattatgcttttaactggtggtccgggtaccggtaaaaccacagtcattaaaggtatagttgaattatatgcagaaatacatgggctctcgctcgattatgatgattacaatgaagatgattatccagtagtgttagctgcacccactggtcgtgcttctaagcgccttcacgaatcgacaggtttagaagcaatgacaattcatcgtttaatcggttggaaccaagatacacaaccacaggatattttagaaaatgagatcaatgcaagactcattatcatcgatgaaatgtcaatggtagatacttggttgttccatcaatttttaagcgctgtgcctttagaagcacaaattgtatttgtcggagatgaagatcagttaccatcagtaggtccaggacaggtatttaaagaccttattgattctgaaataataccgcgtgttaatcttaccgaagtatatcgtcagcaagatggttccagtattattgacttagctcaccgtatgaaattaaatgaacctatcgatattactaaacgttatcatgatcgtagttttattcgttgtggtacgaatcaaattccagacgttgttgataaagtagttaaaagcgctgtagctaaaggctatgatatgagtgatatacaagttttggctcctatgtataaaggtaacgctggtattaagagacttaaccaagttctacaatctattcttaatccgaagcaacaagatgatcgtgaaatagaatttggtgaagctgtgtttagaaaaggggataaagtacttcagttagttaatcgacctaatgataatatatttaatggggatataggtataatagtaggtatattttgggccaaagaaaatgctctaaataaggatgtgttagttgtagattttgaaggtaatgaaattacatttactaaacaagatttaatggaactaacacatgcatattgtacatctatccataaatcacaaggttcagaatttcctattgtaattatgcctattgttagacaatattataggatgttacaacgtcccattctttatacaggattaactagagctaaacaatcacttgttttgcttggtgaacaagaagcatttgatataggtttaaaaacaaatggacaaatacgattaacgcaattaaatgatttgttaaaatcgtattttggacaaaacaaagataatttaactacaaataaacaaacgattaacgaacaaaaagaaaataacaatcatctggatttgaaaaatgaaaaagaaaatgatatccaattaaacgagtcgacaattttccaaatcgatccaatgattaatatgggggaaatgacgccatatgacttcgttgaacgttga

SEQ ID NO: 361 - DNA, 270 bp, S.epidermidis
gaaaagaacctagtgacaataactgaggttctttttattaattataggccattggtcgtatttattaaaatttatgcatttttatgtttaatcttcacaaatttgagatatatttatagtatatcaattagtaggtttagaaaaatattaacaagattcacattaacaattttgtttaattgtcgtgtgagtcgggaaaataatttaataattaaaacttttttgaaagcatattctttgttgcttataaatctacttgttatgatatag

SEQ ID NO: 362 - DNA, 210 bp, S.epidermidis
ttaaatattgaagagagaaaagtaggtattattataaaacttattataagagaaagaatcatcgataaaaattcacaatattcagataatttaaggtatgatattattccaatgcttatatttagtacaatagtagtaataataacaatacttagtgatatgaataaattatttagttttaatttttcaattttaaaatttaccatttaa

SEQ ID NO: 363 - DNA, 228 bp, S.epidermidis
gttataattgaaaaactaagtttgaatttatatcttataacatacaaaattatacttgagggaaatcttattaatagattagattctaatgactcattgagatgtaagattaaagcaaatagtaaagaaccaatagaaatagaagttaataaactgaagttatttagcaaaatgttaaatactacttccctaaataaaatttcttcccctaaagctataaagaaataa

SEQ ID NO: 364 - DNA, 615 bp, S.epidermidis
aggagtactgacatgtatgcatatattaaaggaacattatctcagttgttccctacacatgtagtggttgagacatgtggcataggttatgagatacaaacgcctaattcctatcgttttcaaaaatatcttgaaaaagaagtccaaatttatacttcactaattgtacgagaagatgctcaactactatatggctttattaatgaagaggaaaaagaaatgtttcttagcttaataaaagtgactgggataggacctaaatcagctttagcgatacttgcttcaagtacaccacatgaagttaaattggctatcgaaaatgaaaatgatgcttatttaacacaatttcctgggataggaaagaaaactgcaagacaaattgtgttagatttaaaagggaaggttacaattactgaagaaaatagtgacgatttattacaaactcaagttaatggtaatgaacaaaaccaaataatatctgaagcactattagctttacaagcactgggctattctaaacgagaattaaccaaagtagaaaaatccttaaacaaacataatgtgaatagtgtggatgaagccgttaaaataggactacaaacactagtttcttaa

SEQ ID NO: 365 - DNA, 651 bp, S.epidermidis
caacatgatgagaaaggaaattggctaatgaatcagacaacgattattggcattgcagggggttcaggctctgggaaaaccacagttactaatgcaatcatgaagaatttagaaggtcatagtgtcgcactcttagcacaagattattactataaagatcaatcacatttaacttttgaagaacggcttgaaacaaattatgaccacccatttgcatttgataatgatttacttattcataatttaaaagatttaagaaatggaaaaccagtagaggtacctacgtacgattattctcaacatacacgtagtaaagaaacaattgcatttgatccaaaagatgttattatcgtagaaggtatctttgctttagaaaacaacacattacgagacatgatggatgtgaaaatttatgtcgatactgatgctgatttacgaattttacgtaggcttacaagagatactaaagagcgtggtcgtacaatggaatcagtaattaatcaatatcttaatgtagtaagacctatgcatgagcaatttattgaacctacaaaaaagcatgctgacatcataattcctgaaggaggcagcaataaagttgccatagatattatgactactaaaatccagtcactcgtaagcaaaaaatag

SEQ ID NO: 366 - DNA, 1692 bp, S.epidermidis
ggatgcgatgaatttatgttacaaaccttatcaataaaacaatttgccattattgacgaacttgatataaacttttctgacggtctaacagttatgagtggtgaaactggctcaggaaaatctatcattattgatgccattggacagttaatcggtatgagagcttcttctgattacgtcagacatggtgaaaagaaagcaattatcgaaggtatctttgatatagacgagagtaaagatgcaattaatatactagaatcattagctatagatgttgatgaagattttttattagttaaaagagaaattttcagttctggtaagagtatttgtcgtattaataaccaaattgtcactctacaggacttaagaaaagtgatgcaagaactgcttgatattcatggtcaacatgaaacgcaatctttacttaagcaaaaatatcatcttcaactattagatgattatgcagacaatcagtattcagatttacttaatcaatatcaactttcttataaccaatataaaaataaacgtaaagaattagaggaattagaatccgcggaccaagctttattacaacgattagacttaatgaaatttcaattagaggaactaaccgaagcttcactgaaagaaggcgaagtggaccaacttgaatccgatattaaaagaattcaaaactccgaaaaattaaatctagctttaaacaatgcacatcaagttctaactgatgaaagtgcaatacccgataggttgtacgaattaagcaactacttgcaaacgattaatgatatcgttccagaaaaattcgtaagattaaaagaggacattaatcaattttactatttgctagaagatgcaaagcatgaaatttacgacgaaatggctaacactgaattcgatgagcaagttttaaatgagtatgaatccagaatgaatttacttaataatttaaaacgtaaatatggtaaggatattactgaacttattgcttatcagagtaaacttgcaaatgaaattgataaaatagaaaactatgaacaaagtacatcacaattaagggaagaaattaaaacgctttataacgaagtgatagatataggaaaaaaactttctcaagaacgtaggcgtgtagcgagagagttaagggaccatattgtttctgaaatacaaaatttacaaatgaaagatgctaaccttgaaatttcgtttaaaccattagatgaacctacaattgaaggtattgaatttgtggaatttttaattagtccaaatcgtggtgaaccacttaaaagtcttaataaaatcgcttcaggcggtgaactttcaagaattatgctagctctaaaaagtatatttgttaaatcacgcggccaaaccgcgattctttttgatgaagttgactcgggtgtatctggtcaagcagcacaaaaaatggctgaaaaaatgcgagatattgctcaatatatacaagtcatttgtatttcacacttacctcaggtagcttcaatgagtgaccatcatcttctaataagcaaggcatccaatgccgatagaactacaactcaagtcaaagaattgaaagatgaaaacaaaatagatgaaatagcacgtatgatttcaggagcaagtgtgactgagctcacgagagaaaatgcaaaagaaatgattaagcaaaatcacaatatttaa

SEQ ID NO: 367 - DNA, 348 bp, S.epidermidis
aggaggcgtgatgatatgattgaaaaacaggatttcaatcatatagaggaccaacttgatcaactagcaagtaataaacaactcaaaacaccagaagctagggaacttttagatagttatttcgatttaattattaattattttaaacaaataaataacatagatgaaattcattttaatcaactcgatacatatccagtagttccaatgaattttgatgaacgctatcattatatggttgcacgtaaacaccattttatgggctatcgtcaaatgaaaacattgaaatcagaattaataaaaatgaatgcatcttatctaattagaaagcaacgtcaacaaaaataa

SEQ ID NO: 368 - DNA, 780 bp, S.epidermidis
aaggttggtgatcaactgatgctaatgaaacaaaagggcatcattatcaaatctgttgattatggtgaatcagacaaaattattacaattttaaatgaatacggagctaaaataccactaatggccagacgagcaaaaaaagttaagtctggacttcaagcaaatacacagcttttcgtatatggcttatttatatataataaatggcgaggcatgggaacactaaattctgttgatgtgattaatcaacattatgaactccaactcgacttatttgaaagtagctatgcatctttatgtgctgaaacaattgaccgatcaatggaagagaatgaggtttcaaaatataattatgacttacttcaatttgttctttccaaaattaacgaaggaacccctgcacaattaatgtctgtaatcgtcttattaaaaaatatgtctaaatttggattcacagcttcatttgatcactgtgcaattaccggcattcaagatcaatcaaaacttatagcgtatagttttaaatttgacggtgctatttcagaatctgcattatatcaggatcaacatgcttttcatctctctaatcgcaccttatatcttcttaatatcctgcagcaattacctataagtaagatgaatcatttaaatattcagcaagacatattaaatgaaatgtctgaactacttatcatgctttatcgtgagtatgctggtatgttttttaaaagtcaaaaattaataaatcaattaaatagattagaaaaagattcattgtaa

SEQ ID NO: 369 - DNA, 726 bp, S.epidermidis
gggcgaggtgaaaaaatggataacttacatctaatacatatgctatttatggcaaaacctttaaatggaatgaattgggttgaaaaccttgcacagtttatcactcaaccttttgtttctcttattttcacttgtattatatttattggctttttataccaactatattcaaagcgcataaacttaatgggaataatagcattacttgctttactacttttatttttagcattcctaattaatggcgatgtcaatgtgatgtcagtattactgtttacaattggcctcatactactgattgttgaattatttgttataggcgctgtaataggtattattggtattattctaataacactaagtattattatacttggtgacaatattttattaatgcttggaaatgttatagttgcattaatattatcaattgtagaatgggtgattttagtgaaaatattcaatagaaaaattccatttttagataaagttattttaaaggattcaacaaattctgaagcaggttatcgttcacatgacgaccgctctcatcttgtaggaaaaactgcacatactgttaccgatttaagaccagcaggaattataacttgtgacaatgatcgaatagacgcagtatctgatggatcatttattttacgtaatcgacaagttaagattcttgaagttgaaggtacacgtgttgttgttagagaaatcgaaaaataa

SEQ ID NO: 370 - DNA, 213 bp, S.epidermidis
aggaggagcgacgtgataggcaaacactttattataactggagcaacgagtgggttaggttttgcaataaccaatgaattacttcaaagaggggcccatgttactatacttgcaagaaatatagataagttcaatcgaatcaaagaaaactattttaaacctgaacatatcaatgtgattaaatgtgatttaatgcaacgaaaagaatattga

SEQ ID NO: 371 - DNA, 630 bp, S.epidermidis
agacctatagaattaagtcaaagacaagaacaaataatagagattgttaaatcggaaggacctatcacgggcgagcatatagctgaaaaaatcaatttaactcgtgctacattacgtcctgacttggctatactcacgatgtctggttttatagaggcacgtcctcgagtaggttatttctattctggtaaatctaaaaataaaatcataaacgaaaaattacgaaaatatgttgtaaaagattatatgtcgcatcctgttgtcataaaagaaaacatgactgtttatgatgctatatgtaccatctttttagaagatgtcagtacattatttattacaaatgagaataacgattttgtaggagtatgttctaggaaagacttacttcgtgcctcaatgattggtgaggacatacatacaatgcctatcagtgtaaatatgactagaatgcctcatgtttcatatttaaaagaacaggaactcgttatttatgctgcaaatcaaatgattgataaagagatagattcattaccaattgttagacctaaagaaaacgacaaatttgaagtaataggtcgcatctctaaaacaacaatcactaaattattcgtttcattatttaaagaatag

SEQ ID NO: 372 - DNA, 1068 bp, S.epidermidis
ttattaatagattatcagtatttactaaaatcgggaggccttttcatgtctgacaaccaagttaaaattaaaaagcaaacaattgatccgactttaacactagaagatgttaaaaaacaattaattgataaaggaaaaaaagaaggtcatttaagtcacgaagaaatcgctgaaaaactgcaaaattttgaaatggactcagatcaaatggatgatttcttcgaccaattgaatgacaatgacattacacttgttaatgaaaaagatagttctgacacggatgataaaatcaatcctaatgatttgagtgcccctcctggtgtcaaaatcaatgacccagtgcgtatgtatttaaaggaaattggtagagttaatcttttaagtgctcaagaagaaattgagcttgcaaaaagaattgaacaaggtgatgaaattgctaaatcacgattagctgaagcaaacttgcgtttagttgttagtattgctaaacgatatgttggtcgtggaatgttattcttagatttgattcaagaaggtaatatgggcttaattaaagctgtggaaaagtttgattttagcaaaggatttaaattttcaacatatgccacttggtggattagacaagctattacacgagcaattgctgaccaagcacgtacaattcgaataccagtacacatggtagaaacgattaataaattgattcgtgttcaacgtcaattattgcaagatttaggaagagatccagctcctgaagaaattggagaagaaatggatttaccaccagaaaaagtcagagagattttaaaaattgcacaagaacccgtttcattagagacgccaattggtgaagaagatgatagtcatttaggagatttcattgaggaccaagaagctcaaagtccatctgaccatgcagcatacgaattgttaaaagaacaattagaagatgttttagatacacttactgacagagaagaaaatgttttacgtttacgttttggtttagatgatggacgaacaagaacactagaagaagttggaaaagtattcggtgtaaccacgtga

SEQ ID NO: 373 - DNA, 852 bp, S.epidermidis
cttttgatagatgcgttattaaattttgattttattagatattctttgattagcggtctgcttattggctttatcgcaccattaataggtgcatttattgtagttcggagactatctttaattgctgacgctttaagccacgtgacattaggtggtatttcctttggtatgtttttgcttaccattattcccgttttctcagtaataaaccctatgtggtttggtattctttttgctgttattggagcgttattaattgaaaaattaaggacttcgttttctaattatcaagaaattgcaattcctattataatgagcgctggtattgctctaagtgctatttttatttctctagcagatggttttaatcaagaaatcgtaggcctactatttggatcaattagtgcagtaaatattagtgatttaactacaattattatcattacaataattgttctcatatttattgttttattttataaagaattgtttattttatcatttgacgaagaatatagtaaggtcataggtataccaaagtggattcaatttttatttatagtaattgttgctatggtaatatctgcatcaatgagagttgtaggtatattattagtaagcgcgttaataactcttcctatagcaatttcaatgagaataactaaaggatttaaacaattaatagcattaagtgttatattaggagaattatctgtaattctaggattaattatagctttttatatgaatatatcacctggtggcgtcattgttgtactattggtattaatgctcatactaacgatgattattcagaagttaaaaattaagtttaaaaagggagtcgtttaa

SEQ ID NO: 374 - DNA, 741 bp, S.epidermidis
gaggtagtagaaagtatgactaacgaaattttaatcgttgatgatgaagatagaattagaagattacttaaattatatttagaaagagaatcttttgaaattcatgaagcaagagatggtaaagaagcctacgagcttgctcttgaaaacaactatgcgtgcatcctcttagatttaatgcttcctgaaatggatggaattgaagttgcctctaaacttagagaacataaagatacacctatcatcatgcttactgcaaaaggtgaagaaacaaatcgtgttgaaggatttgaatcgggagcagatgattatattgttaagcctttctcacctagagaagtagtattgagagtaaaggcgttattaagacgtacacaaactgcaaacactgagcaaagcgaaccgcatgcacgcgatattattgaatttagtcatctagtgattgataatgacgctcatcgagtccttgcggatgatcaacaagtgaatctaacacctaaagagtatgaattactcatctatttagctaaaactccaaataaagtatttgatcgagaacagttacttaaagaggtttggcattacgaattttatggggacttgcgtacagtagacactcacgtcaaaagacttagagaaaagttaaatcgagtatcaagtgatgctgcacaaatgatacaaactgtgtggggtgtcggttataaatttgaggtaaaacctagtgatgaaccgactaaatag

SEQ ID NO: 375 - DNA, 354 bp, S.epidermidis
atgaattcagaagaattattaaatattgctgtcgaagcggcagagaataagaaagcagaagatattatttctctcaatatgaatgaaattagtgatatgacagattattttgtagtctgtcacgggaacaatgaacgtcaagttcaatccattgctagatctgttaaagaagtggcacataaacatgatattgacgttaaacgtatggaaggctatcaagaagctcgatggatacttattgatttagcaaatgtagttgttcatgtttttcataaggatgaaagaagctattacaatttagagaaattatatcaagatgcacctattaaagaatacggtcaggcagtattttag

SEQ ID NO: 376 - DNA, 1425 bp, S.epidermidis
accatgtcagaaaaacaatacgatttagtcgtgttaggtggtggtacggcaggatatgtagccgccatcagagcttctcaattaggaaaaaaagtagcgatagtagaaaaatcactcttaggtggtacgtgtttacataaaggatgtatacctactaaagcacttttaaaatcggctgaagtcaatcatactattaaaaacgcgcatacatttggaattgatgtcaatcattttaaaattaatttccctaaaattttagaacgtaaagatgctattgttaagcaattgcatgaaggcgtcaatcaactgatgaaacatcatcatatagatatttataacggtattggacgaattatgggaacatctatattttctcctcaaagcggtacaatttctgtggaatatgaagacggcgaatcagatatactccctaataaaaatgtgcttatagctactgggtcgtcaccacagtctcttccgttcattaaatttgaccataaacaaatactatcgagtgatgatatcctaaggttaaatacactaccacaaagattagcaatcataggtggaggtgttattggtttagaatttgcatctctgatgaatgatttaggtgctgatgtagtagtaatcgaagcgaatgacagagttcttcctaccgagagcacacaagttgcgtcattactaaaagaagaattaactaatcgaggcgttacattctacgaaaatattcaattgaccaaagatcattttaaccaaactgataagggtgtaactattaatatttcagatgagcccgtccaattcgataaagtacttgttgcaattggtagaaagcctaatacaaatgatattggtttaaataacactcaaattaagacttctgatgctggtcatattattacaaatgcttatcagcaaactgaagataaacatatatacgcagcaggagattgtatagggcaattacaattggcacacgtcggttcaaaagaagctatagttgcagttgaacatatgtttgattgttctcctatacctatcaattatgacctgataccaaaatgtgtttatacaaacccagaaattgcttcaattggtaaaaatttagaacaagcaaaaaaagcaggcatcaaagcaaaaagtatcaaagttccttttaaagctataggaaaggcaataattgaggatgtaacccaatcaaaaggattttgcgagatggtagttaacaaagatgacgatgaaatcataggtcttaatatgatagggccacatgttacagaattaataaatgaaatttcattgttacaatttatgaatggctcatctttagaacttggtttaacaacacatgcacatccttcattatccgaggtagtcatggaattaggtttaaaagctaatggtcaagcaattcatgtatag

SEQ ID NO: 377 - DNA, 912 bp, S.epidermidis
gaggtggcagagacaatgaaagtttcacaagataaaagtgcgcttgtcattcgtattatctcattaatcattattattggcttagtaatcacaattatcctcccgatgattaatatctttgccttagcatttaactctggggtagatgctcaaaaaggtggcatcactttctacccgcgtaaattttcactagataattttaaggagatatttaaacaaggcacgttattaaatgcattatttattagtatcgcaaagacagtcataggaacgatactaagcgtcatattaacagctatggctgcatacgttctaacaatcaaaagtttaccgtttcgaagaatcatctcattcttcctagtctttacgatgttattcagtgtcggtgttgtaccactttatatcctattaaatcaacttcatttaactgatacattctgggtatacattttaccgtcactttatagcgtttataacattttaattatgcgtacattcttcaatcaattacctagtagtgtgattgaagccgctagagtagatggttgtaatgactttcaaatcttttggaaaattgtcttacccatgagtaaacccgtggtggcatcaattacattatttaacgccgtgagtcagtggaatgattggtttacaggtgcattcttcgtacgtaatccaaacctcaaaccgttagctactgttttacaagatatgttaacgaaacaagctgccattgcagatgctttaaaacaaaagtcaggttcatatgcgatgttagacaagttgacaattacaggggactcaatgcagatggcaatgattgtactattaacaattccagtattattcctcttcccatttgttcagaagcattttgtaaaaggtataactatcggttcgacaaaagagtaa

SEQ ID NO: 378 - DNA, 1380 bp, S.epidermidis
ttgctgaaagataatttaaagagatggtttggttttgatgaatttaaagaggggcaagaagaaattattgatagtgtccttcatggaaggcatacacttggaattttaccaactggtagcggtaaaagcttatgttatcaactccctacatatatattagaaaaaccgacattaattatatcaccactcatttcgcttatggatgatcaagttatgcaaatgaagttaaaaggtgaaacacatgttgcatgtgtacattccggcatggacgaagtagaaaaaagagacaatattaaacgactaagtaaaagtcgatttatttatttaagtccagaatatatactgcaacctcataattttaagtacatcgctcatatcaactttggattaatagtattagatgaagcgcactgtttatcagagtgggggtatgattttagacctcactatgctttagttggtaaaattattcatcattttaattcagcaacagtgttagcactaacagctacagcaccacctcaattagaaactgatttatctcacattttatcactcaaattaaatgtagttcaaaaaagtatgaatcgagaaaatattagcttacaacactataattttaatgatgatgaggggaagattgaatggctgttaccatttttatctaattctgggcctacaattatatatgtttcttctaaaaaaagatgtttagaactagctcaaatgatttatgactcaggatatctaacaggtatatatcatggagatttaagttatcaggaacgccaaacagttcaacaacagttttttaataatgacatccccgttatagtagcaacaagtgcttttggaatgggaataaataaaaaagatattcgtacagtcatacattttcatttatcatcttcaccatctaactatttacaagaaattggtcgtgctggtagggatggtaaacaaagtcaagccattagtttatttcaacctgatgatagttttattctagaaacactactattcactgatattatcacagatgacgatattacaatgtttgagacgggaaaccacttaccagatgaaaaggaaaaaattttaagtactttaaatatacaattcacatttagccaacttaaagatatatttcatcaatcatatcaacgtaagcgactaggttatatgagaatgatgggctatactaatttagatcaatgtcgacgtaaatacttactagaattttttggcgaacatcctcaaagtccaaaacaatgttgtgatcaagattcaagattagagcctattcagatattgaatcgtaaaaaggtgaaaagaaaactaagttttaatgaaaaattatataatttgttcgaaacctag

SEQ ID NO: 379 - DNA, 1248 bp, S.epidermidis
acaatggaagatatctacaaacttatagacgatatcaatctacaaaaaatagaaaacttagattctcgagtaaatgaggcattgagttcaaacaatgatgatgcattatttatacttggtgaaactttatataatttcggtcttacacctcaagggttagaagtttttagaacgttgtatcataaatacccagatgaaagtgaattactcatttactttatcgaaggtctcatgtctgaaaaccaaactgacgaagcacttgaatatttagcacaagtagaaccatctaccgaaaagttgatgctagaagccgatttataccaacaaataaatatgttagaagtagcaattgacaaattgcaagaagcattagatcttgaacctaatgatccaattattcacttcgccttagcagagctattatactacgatgggcaatacttacgagctacaagagagtatgaaacagtattagaaactggtgaatatgaagttaatggagtaaatattttttcgcgaatggcagattgtagtttacaaagtggtaattattcagatgctattagcttatttgatgaaattaatgaagaagagatgaattctgaagattactttaaaaaatcaattgcttatgaaaaaaacgatttaactcaagaagcaattaaaattatgcaaacattactttcaaaagatcctgattttatacaaggatatttttatcttcaatctctatttgaaaatgaaaaaaattatcctgatgctatagaaactggtaaggaaggattacgtttaagtcaattttacaaagaattaatggtttctacaggtagcttagaaattgagcatggagatgcaaatgaaggtgtagaattgctaaaacaagccttagaagtcgataatgcatatcatgaaccattgttgattttaagtgatttatatcgtaatgaagaagactatgaatcaattatacaattgttgacttatgtagatgaagaagatttagaccctattttcatgtggcatttagcatatgcatacggtcaagaagaacgagataaagaagcgcaacatttctttgaattagcatatccaacattacaaacccaagttgaatttttaagcgattattatttctatttattagaaattggacaaaaagaaaaagcaattttgattttaaatcaattattagaaattgatccaagcaatgaaaattggcatgacgagtcaatgagattgcaaatataa

SEQ ID NO: 380 - DNA, 444 bp, S.epidermidis
caaatcatggatttaaactttgatttatatatgaatgatgttgttgaacaagcacgaaacgaaattgagcatgctggttatcaacaattaacttctgctgaggatgttgatcaagttttacaacaaaaggggacatctttagtcatggtaaattccgtatgcggatgcgcaggtgggattgcacgtcctgcagcgacacatgcattacattatgataaattacctcaacgattagttacagtatttgcaggacaagataaagaggcaacacaacaagctagagaatattttgaaggatatgcaccctcaagtccatcttttgctttgattaaagatggtaaaatcaccgagatgattgaacgacatcagattgaaggtcatgatgtaatggacgtaatcaatcagttgcaagcattgtttgataaatattgtgaagaaagataa

SEQ ID NO: 381 - DNA, 531 bp, S.epidermidis
aatctaatggatcaatcattaatggattattattatcaatttcataagcatcaacattacttcctatgtcatgatattttagaagatgcttggaaatcacaaaatactttttcaaaacatgatgcagtagtaagtctcattttgtttgcaacagctaattatcactatcgtcgtgggaatttaaaaggcgcattaaaatcttttgaaaaagctttattaactattaaccacgctaaagatgacactcaattacaccttaatatcaatgaatttaaacaacttattgtgaaaatgattgaagcagtaaaattacaaaaacaatttactccgttacaattacctattgaaccagagtttcagacacttattaaacgtaaatatccggattatttgtttacctctcaaataattaaggaaccttatattgttgatcatcatattaaacgtgacagaactgaagtgataaaaaatagagaacgtgctttattccatagacagtatcgaaacaaaagcaataaaaaagaccagtaa

SEQ ID NO: 382 - DNA, 171 bp, S.epidermidis
aaaggtaaggaggagaaactcatgcgcgtaaacgttacattagcttgtacagaatgtggagatagaaactatatctcaacaaaaaacaaaagaaataatcctgaacgtgtagaaatgaaaaaatattgttcacgtgataacaaacatactttacatcgtgaaactaaataa

SEQ ID NO: 383 - DNA, 672 bp, S.epidermidis
aacaacaaggaaggttatcaaataatgagttcaattaatattgcactagatggcccagctgctgcaggtaagagtacaattgctaaacgtgtagccagtcgtctatcaatgatatatgttgatacaggagcaatgtatcgtgccattacatataaatatttacaaaatggcaaacccgaaaattttgattatctgattaataacactaaacttgagcttacttatgatgaagtaaaagggcaaagaatcttactagataatcaagacgtcactgattatttaagagaaaatgatgtaacacatcacgtatcttatgttgcttctaaagaaccagtgcgttcatttgcagtgaaaatacaaaaagaattagctgctaaaaaaggtatcgttatggatggccgagatattggtacagttgtattaccagatgccgaattaaaagtttatatgattgcatctgttgctgaacgtgctgaacgtcgacaaaaagagaatgagcaacgtggcattgaatcaaatttagaacaattaaaggacgaaattgaagcacgagatcactatgatatgaatcgtgaaatttcgccattacaaaaagccgaagatgctattacacttgatacaactggcaaatctatagaagaggtaacaaatgaaatattgtctctactttaa

SEQ ID NO: 384 - DNA, 1164 bp, S.epidermidis
tttgacaaggagtgtccaaacatggaagtatacgcagattatgctgcgactacgccagtaaaaccagaagtaatagatgctatgatggaaatatatcaatctcattttggtaatccatcgtcaatacattctattggtagagatgcacgcaaatatcttgatcagtcacgtcgtacagttgcacaattgttgggagcgaatccgaatgaagtaatatttacaagtggtgcaacagaatcgaataacactgctattaaaggattagtgaaagcgaatgaacaattaggtaatcatattattactaccaaaattgaacaccattcagtattacacgtatatgagcaacttgaaaaagaaggttatgatgttacgtatctagatgtagatgatactggtgcagttgatttagaccaattaaaagaaacaattaatgatagaacaattttagtatcaattatgtttgtaaataatgagattggaacagtacaaaatatttatgatattgaagatattattggagacactcatgcgttattccatgttgatgctgttcaagcaattggacatttagatttagattttcataattttaaaattgatacaatgagtatttcagcacacaaatttggtggtcctaaaggtgttggtctactattagtaaaagagcatacaccaatagcatataatcaacttggtggtgaacaagaaaccaaacgtcgagcaggtacagaaaatttacctcaaattgttggattaacaaaggcacttgaattagctataaccaatcaagatgtaaataatgttcatttaatgaatttaaaagaattatttttagttcagttacaggaaagggcaattccatttgaattaaacggttcaatgacagattcaacgggtcatattttaaatatttattttccatttatagatgttgaaacaatgttaacattattggatttagcccatgtatatgtatcttcaggttctgcttgtacagcaggttcaacgactccatctcatgtacttgcagctatgtttgaagatgaagaacgagcaaaacattcagtacgttttagctttaatgaacaaacaacaacgcaagaaattaaatatattgtagctgaaattcataaaatctatcataaatttaaggaggaatcatag

SEQ ID NO: 385 - DNA, 996 bp, S.epidermidis
tatatagaggaaggtgtacgtatgagcaacaatatcttcactgtctacggtgaagtaccagaattagtcgaaaagaaaacaaaagaaattgtaaatgattatctaggacaagagatagatgactttaattatgtaaaatacaacttgtatgagagtgacctaactccgattattgaagagacacttactatgccttttttctcaaataaaaaagcaattgttgtaaagaactcgtatgtttttacaggggaaaaattttctaaagatttaaatcacaattctgacgagcttataaaatttttagaaaaatatgatggtgaaaatctcattatctttgaagtgtatcagcctaaactagatgagcgcaaaaaactcacgaaaacgttgaagaaaaatgcacaacttaagaaaattgaacaaatgtctgaaaaggaattaaagcattggattaaaaatacactaaacaataattataaagatattaagcaagatgctcttgaattatttattgaattaactggtgttaactataatattgtttctcaagaattagaaaaattaattttattcataggtgagagacctataattaataaagaagatatcgatttaattattaatagaagtttagaacaaaatgtatttctactaactgaatacattcaaaaaggtaataagaataaagctatacaattagtcaatgatttaatcattatgaaagaagaacctataaaattactggcattaattactagtaattatagattatattatcaatgtaaaattcttagtcaaaaaggctatagtgggcaacaaattgcaaagactgtaaatgcacacccttatagagtaaaactagcactcaatcaatcccgacattataaactagaaagtttgtttaacatcataaacgcttgtgcagagactgactacaaactaaaatcatcttatatggataaacaactcattttagaattattcatactatctctataa

SEQ ID NO: 386 - DNA, 1332 bp, S.epidermidis
aaaagagaggaagtttatcctatgactaaaccgatagtagcaattgtaggaaaaccaaatgtaggaaaatctacaatttttaatagagttgtcggcgaacgtgtatctatcgtagaagatacgccaggcgttactcgtgatcgtatttattcatctggcgagtggttaactcatgaatttaacatcattgatacaggtggtattgaaattggagatgctccttttcaaactcaaatccgtgcacaggcagaaatagcaattgaagaagcagatgtcatcatttttatggtcaatgttagagaaggacttacacaaagtgacgaaatggtcgcacaaatgctttataaatctaagaaacctgttgtattagctgtgaataaagttgataatcttgaaatgcgtaatgatatctatgatttctattctttaggctttggagatccatatcctatttctggttcacatggattaggacttggagatttgctagatgcagttgttgaaaactttaataaagaatcagaagatccttatgacgaagatacgatacgtctttccatcatcggtagacctaatgttggtaaatctagcttggtcaatgctattttaggcgaagaacgtgttattgtgtctaatgttgctggtacaactcgagatgccattgataccgagtactcttatgatggacaagattatgtattgattgatactgctggaatgagaaaaaaaggtaaggtgtatgaatcgactgaaaaatattctgtattacgtgcattaaaagcgattgagcgttcagaagtagtattagtagttatcgatgctgaacaaggtataattgaacaagataaacgtgtagctggctatgcacatgaggaaggtaaagctattgtcattgtagtaaataaatgggatacaattgaaaaagatagtaagacaatgaaaaaattcactgatgatgttagaaatgaatttcaatttttagattatgctcaaatcgcgttcgtatcagcaaaagaagggctaagattaaaaacattattcccttatatcaatcaagccagtgaaaatcataaaaagcgtgtccaaagttctacactaaatgaagttgttactgatgccatctctatgaatccaacacctactgacaaaggtagaagacttaatgtattctatacaactcaggttgcaattgaaccaccgacatttgtagtatttgtcaatgatgttgaattaatgcatttttcttataggagatatttagaaaatcaaatacgtaatgcttttggttttgaaggaacacctattcatattattccaagaaaaagaaattaa

SEQ ID NO: 387 - DNA, 183 bp, S.epidermidis
gacttactactgcatcatgttttgaaaaagtattttgtgatttccaagcatcttctaaaatatcatgacataggaagtaatgttgatgcttatgaaattgataataataatccattaatgattgatccattagatttcacccataatttaaaagttgtatgtattcatgctataataatttag

SEQ ID NO: 388 - DNA, 159 bp, S.epidermidis
gttctttgttctaattcacttagtgtcatacccaatctttcacgtctacttttcaacacttcaccaatcgttttcactcaaagtcctcctagacattattcaaagaaaccaaaccctccaccaaatggatctccaaaatctaaattattcttgctttga

SEQ ID NO: 389 - DNA, 636 bp, S.epidermidis
agaagaatctctatgatagttaaattttgtggttttaaaaccgaaagtgatattaagaaaattaaaaaattagaagttgatgcagtagggtttatacattatcccgatagtaagagacatgtctcactgaaacaattaaaatatttggctaaaatagtgccagatcatatagagaaagtagtggtcgtagtaaatcctcaaatgtccaccataaagagaataattaatcaaactgatattaacacaatccaattacatggaaatgaaagcattcaattaattagaaatattaagaaacttaattcaaaaataagaatcataaaagcaattccagcaacaagaaatttaaataataacattcaaaagtataaagatgagatagacatgtttattatagatacaccatcaatcacatacggagggacaggtcaaagttttgactggaaattattaaaaaaaataaagggcgttgattttctcattgcgggtggtttggattttgaaaagataaaacgattagaaatatattcatttggacaatgtggttatgacatctcaactggcattgagtcatataatgaaaaagattttaataagatgactcgaatattaaaatttttgaaaggagacgaatga

SEQ ID NO: 390 - DNA, 195 bp, S.epidermidis
cgttcattatccaaaacgagacctcctactacagaaagttatctgtataatatcttatacttactatacaagcattttaagcaaaatacaagtcttttgcgaatatttgttcgcatttattgtgtgatagctgatacaaaaacgaacaaacgtacttatattttttgcaaaaatttaaaatatactatttattaa

SEQ ID NO: 391 - DNA, 2121 bp, S.epidermidis
gagaggagattcataatgtctcaagagaagaaagtttttaaaactgaatgggctgggcgttctttaactattgagacaggacaattagcaaagcaagctaatggtgctgttttagtgcgttatggagatacagttgtcctatcaactgcaactgcttctaaagaacctagagatggcgattttttcccattaactgtaaattacgaagaaaaaatgtatgctgctggtaaaataccaggaggattcaaaaaaagagaaggtcgccctggtgatgaagcaacgttaacagctcgtctcattgatagacctattcgtccactgtttccaaaaggatatagacatgacgtacaaatcatgaatattgtcttaagtgctgatccagattgctcaccagaaatggcagcaatgattggttcttcgatggcgttaagtgtttcagatattccattccaaggtcccatcgcaggtgtaaatgtaggttatatcgatggcaaatatgtcattaatccttccgtcgctgataaagaaatttctagattagatttagaagttgctggtcataaagatgcggtaaacatggttgaagcaggcgcaagtgaaattactgagagtgagatgcttgaggctattttcttcggacacgaggaaatcaaacgacttgttgcattccaacaagaaatcatcgatcacattcaaccgataaaacaagaatttgtaccggtggaaagagacgaagatttagttgaaaaagtaaaaagtttaactgaagataaaggacttaaggacacggttttaactttcgataagcaacaacgagatgaaaacttagatgctctgaaagaagaagttgttggtcattttctagatgaagaagatcctgaaaatgaaacgcttgttaaagaagtttatgcaattctaaatgacttaattaaagaagaagtaagacgtctaattgcagatgaaaaaatacgacctgatggacgtaaagtagatgaaataagacctcttgaatcagaagttggtttgttaccaagagctcatgggtcaggtttatttactcgtggtcagacacaagcactttcagttttaactttaggcgcacttggagattatcaattaattgatggtttaggacctgaggtagaaaaacgttttatgcatcattataactttcctaatttctctgtaggagaaactggccctgtacgtgcacctggtagacgtgagattgggcatggtgcgcttggtgaaagagcattacgttacattatacctgatactcaagatttcccttatacaattcgtattgtaagtgaagtattagagtctaacggttcatcatctcaagcatcgatttgtggttcaacattagcattaatggatgccggtgtaccaattaaagcgccagtcgcagggattgcaatgggactagtaacgcgtgacgatagctatacaattttaactgatattcaaggaatggaagatgcattaggtgatatggacttcaaagtagcaggtactaaagacggtattactgcgattcaaatggatattaaaattgatggtttaactcgagaagttattgaagaagcactagaacaagcgcgtcaaggacgattagctattatggatcatatgcttcacacgattgaacaaccacgcgaagaattaagtgcttacgcaccaaaagtggtaactatgagtattaatccagataaaattcgagacgtgattggaccaggtggtaagaaaatcaatgaaattatcgacgaaactggagttaaattagatattgaacaagatggtacaatctttataggtgctgtagatcaagcgatgattaaccgtgcaaaagaaattatcgaagatattacacgcgaagcggaagttggacaagtatatcatgctaaagtaaaacgtattgaaaagtatggtgctttcgttgaattgttccctggtaaagacgcgttattacacatttctcaaatttcacaagaaagaattaataaagtagaagatgttcttaaaattggagatacaattgaagtgaaaattactgaaatcgataaacaaggtcgcgttaatgcgtcacataaagtattagagcaatctaaaaattaa

SEQ ID NO: 392 - DNA, 948 bp, S.epidermidis
ttagatacatcaaaggggcaatctagtatggaggaagttttaaaacttaaaatccctgcatcaaccgcgaatctaggtgtaggttttgactcaattggtatggcattggataaatatttgcatatgtctatacgtaagattgaaagagctaattgggaatttctatattatagttcagaactagaaggtttacctaaagatgagaataattatatttatcaaactgctctaaatgttgcgcgtaaatacaatgttacacttccaagcttgcaaattgaaatgagaagtgatattccattagctagaggactaggttcatctgcttctgcattagtcggtgctctttttattgctaattactttggtaatattcaattatctaaatacgaattgttacaactagcgactgaaattgagggacaccctgataatgtagcacctacaatatatggaggtttgattgcaggtttttataatccaataactaaaataacagatgttgctagaatagaagttccgcacgtagatataattttaactatacctccatatgagcttcgtacagaagactctagaagggtcttacccgatacattttcacataaaggtgctgtgcaaaatagtgccattagtaacactatgatttgtgctctcattcagcataaatataaacttgctggaaagatgatggaacaagatggttttcatgaaccatataggcaacaccttattccagaattcaatcaagtacgtaaactatcacgtcaacatgatgcatatgcaactgttataagtggagctggacctacgatactcactctttgtccaaaagaaaaaagtggtaaattagttagaacactacgtgagaaaattaataattgtgcttcagaactagtaacaattaatgaaataggtgttaaagatgaagtggtgtacctaaagtcctaa

SEQ ID NO: 393 - DNA, 189 bp, S.epidermidis
attcagacatcatcgtggcttaatataagaaaagtaacagctcaacgagctgaaaataatcaaaaaaattataaaaaagacaatttctatattttttcaatagaaattgtcttttttacttatcttgaacctttttgtcccagcctcttcagggattcattttttaattatcttcaaagaaatttttga

SEQ ID NO: 394 - DNA, 906 bp, S.epidermidis
tggaggggattgattttggataaaatccaagaaacatttttatatatgttaaaggttgaaagaaacttttcagagtatacgttaaaatcttatcatgatgatttagttcaatttaacaactttttagaaagagaacatttacaacttgagacttttgaatataaagatgctagaaactatttggcttttttatattctaatcaattaaaaagaactacggtgtcaagaaagatatcaactttacgtaccttctatgaattttggatgactcaagataattcaattattaatccctttgttcaactagtgcatcctaaaaaagagaagtatttacctcaattcttttatgaagaagaaatggaagcactttttcaaactgtagagcatgataataaaaaaggcatacgagacaaagttattattgaattgttatatgcaacaggaatacgtgtgtctgaattaataaatattaaactaaaagatatagatatgaacttaccaggtgtaaaagttttaggtaaaggaaataaggaaaggtttatcccttttggagagttctgtagacagagtatagaaagatacttagaagaattccaacctaaacaattagccaatcatgattatttaattgtaaatatgaaaggtgatcctatcaccgaaagaggagtaagatatgtacttaatgatgtcgttaaaagaaccgctggcgtcaatgacatacatcctcataaattaagacatacttttgctacacatttattaaatcaaggtgctgatttaaggactgtacaatctttacttggtcacgtcaatttatcgactactggacgttatacacatgtttcgaatcaacaactgagaaaggtgtatttaaacgcacatcctcgagcaaaaaaaggagagtaa

SEQ ID NO: 395 - DNA, 879 bp, S.epidermidis
gtagtaatgtctttaacgattatcttatctataataattattattttgattatggctatggttcttaatcaaaaatttatgaaagatagggttgaaacagaagaatatgctagaaatcaattaatctctaaaaattcaattttaagtgaagaaaatttatcattgaaaaaccaaatgttaagtacaaacaatgacgtcggtcaacacgcttttaaaaacgccaagcgtgaattaagaaaaatattaaatagatttaaagaagagggtcgtttacgatcatatacaattgttcctacgagtaatttggctgttaaacatccccttttcgaatatgcacgttcattcgattttattatcattactgatgttggtttgataaatgtggatgttaaaaattggaaccaaaaaacgttttatcattttgatgtgccagatcaacatcttgaagaaggacaaccacaatataataccgaaaaagttgtcggtcattatattagcaatcgatatcatagtcagtttaaaacaacacgttctggtgtctatacttttattgagattttacaggataatcgtgtaatatatgaattttatgaccacgatccatacgataaagccgcaaacaatgcaaaagcattaaaagataaaattgaaaatgattataattttaaaattcaaagtattggcgtcatatattttagtgatggtagcgttaatattattgaaggatccgacgagagtgataaatacgtcgacaccgtatctacaccgatatcacttgaaaaagtaattgaggaagctatcgatttatctaagcacccccttactgataaacaaatcgaagaaatttctgaaaactttaaacaacatatgaataattaa

SEQ ID NO: 396 - DNA, 132 bp, S.epidermidis
ttcgaattgtttctttgcttgttctttaatattagaagccattttatatcccccttgatatttatatatatttatatgccgttaattaaattgtattattatatgtttatcaaaacaactatgtaccgttag

SEQ ID NO: 397 - DNA, 129 bp, S.epidermidis
tttcgccctcctacaaacgtacgttcgttattaaaactatacaatagttattcttatataaattcacctaaattgcaagtgtcatttaaattactaagttgtttgagtaactttattgaattaaattaa

SEQ ID NO: 398 - DNA, 447 bp, S.epidermidis
aagcggttgttgaagaacttggtggcgaaaaaatcgatatcgtccaatgggatgaagatcccgaaagtatttgttcgtaatgctttaagtccatcacaagttttagaagtaattgttgatgaagagaatcaatcaactgtagttgtagttcctgattaccaattatccttagctataggtaaaagagggcaaaacgcacgtttagctgctaaattaacaagttggaagatagatattaaatcagaatctgatgcccgagaagctggaatttatcctgttattgaatcagaagaagttgcagatgaaattgttaattccggtgacgaagatgttgagtttgataatgttaacttggaagagacaaacttaactagtacagaattagctgctgaaaatgatgaagataaaaaagataaaacagaagaagataatgacacagaatcatag

SEQ ID NO: 399 - DNA, 327 bp, S.epidermidis
atagctgctcctaaaccaatcggaactgctacgattgtagcaataacagtaattttcaatgtgccgatgatgagtgcccaaattccaaattctggtgatgaaccagttgggttccaagtaccagataaaaagaatttagataatggcactcgtgtgaaaaacgtaatcgtctcggttaaaagtgtaaataaaatagcaattgtagttaatatagatatagctgaaataatggctaaaataattgggacaattttatcacttagcccgccctttttagcattattcttagctatcatttctctcacctttgtttgtgaagccatgtaa

SEQ ID NO: 400 - DNA, 171 bp, S.epidermidis
attgacgatccgtttgagcatgtacaccgattaatacagcagtttctcgtttattttttgttttataagtcgcatgctgtgtcacgttatacatctccttttaaaagttactcaagacattttatcatagagtgtgaacaaagactaactacacaaattgtgttaaattag

SEQ ID NO: 401 - DNA, 336 bp, S.epidermidis
agaagagatcccaaaataatgactaaaatgaaaatttttaatttgcttggtttagctatgagagctggtaaaatcaaaagtggcgaatcggtcatcttaaatgagcttaaaaagaatcaaataaaacttgtcatattagctagcgatgcatctagtaacactctaaaacaaatgaataataaatgtaatagttaccaagtgccattaaaagtgtttggtactagaaatgaattagggttagcaataggtaaaagcgatagagttaatattggtataacagataatggttttgcaaaaaaattgttatcaatgatagatgaatatggtaaggagtga

SEQ ID NO: 402 - DNA, 213 bp, S.epidermidis
tacatgatgttaggagtgaaagaaatggatacatctaatgaaaataaaataacaatcattgccgttatagtagcaataattgttggtgtcgtactacaaattgtctttaaactacccttaatcgtgagtttagtggggtcagtatttttaggtatgttcgttggttttatcgtctacctaattcaatcatttcgtcgtaaaaaaaagaattaa

SEQ ID NO: 403 - DNA, 192 bp, S.epidermidis
acgataaaaccaacgaacatacctaaaaatactgaccccactaaactcacgattaagggtagtttaaagacaatttgtagtacgacaccaacaattattgctactataacggcaatgattgttattttattttcattagatgtatccatttctttcactcctaacatcatgtattatatcatgctcttataa

SEQ ID NO: 404 - DNA, 159 bp, S.epidermidis
gattctgaaccactaaacggtccagaatggtttacaaactggaaaataattacaagtattcctatcatcgctactactaaaagcgatgacattttcttagatttcaataatgtcaccttatttcacttaatatcccgatttatactaaagaaaatttga

SEQ ID NO: 405 - DNA, 3033 bp, S.epidermidis
gatttgaagcctttacatatagttatggagaactttggcccttttattaaagaaactattgattttgagcaagttgaaactgatcaactctttttaattagtggtaaaactggatctggtaaaacaatgatttttgatgctatagtatacgcattatacggtatggcttcgaccaaaactagaaaagaaggagatttaagaagtcattttgcagacggtaaatcgccaatgtctgtaatttatcaatttaaagttaataatcaaacttttaaaattcatagagaagcgccatttattaaagaggggaatataactaaaacacaagccaagttaaatatatatgaattagttgataatcaatttgaattaagagaaagtaaagtgaatcaaggtaatcaatttatcgtacaattattaggcgttaatgctgaacaatttcgtcaattatttattttgcctcaaggagaatttaaaaagtttcttcagtcaaatagtaaagacaaacaatcgattcttagaacactttttaatagtgagcgatttgatgagattagacatctacttgtagaaaatgtaaagcaagaaaaagtacaaattgaaaatagatacactcaaattgaaaatttatggaatgatatagatacatttaataatgatgaattggccttatataaagaattagagagttctcagacagataaaatgattgaaaaattcccacaatttaatgattatggatgcaaaattctcaagtcatttgaagaagctaagaataaaataactaaggaattagatgatttaaatcataaatataaagtgaatgttgaattaagtgagaatactaaaaaattaaaagcggaaaaaatcaaatttgacgatttgaaaaaagaacaaaattatattgataaattaaagcaagaattaaaaatgattcaggaatctaaagtattaatcacttattttactaggttacaaagtttaaaaaaagataaagatgaattagtgtcacttcatgagcaatcaaaattaaacgaaacaaactatcacaatgaaattaaaggttttcaaaaacaactcgaacatttatcaacacgagaaaatgaaataactcaatttaatcagtatctagaaaaaaaccaagttttcttcaatcaattagataagattattagtagttatcaacaaaaaccggtaattgaagaagaaataaaaagattatacagtgaatataatgatttaataaccaaaaaagaagaattgacgaaagaaatgaacaacaagaacaaagattttgcaattattgaacattacactgaagagatttataagctgaaaaagattatagatgaatctgaaagacaaaaaaaggatgagaaattatttgataaattacaactagataaatcatcttatcttagcaaattaaaagagaagaaagaacagttaaatgaaattgaatcatcaatcaccaatatagatgcgactttaattgatttgaatgacaaaaaggattttgtaaatgaaataaagtccgctatgtcaattggagatacctgtccaatttgtggtaatgaaatacattcattgggagaacatattgattttgaatcaattgctcaaaaaaataataaaataaaacggttagaaagtaagaaggtaaaaattcgtgatgaaataatcaaaatagaaactcgaattgaagaattaaatcatagagaaaatgaattaaattttgagaaacaagaaaagaaggatattagtgagcttcaaaaacagcttaatcatttgaatcaactaaaagacgagcaacaaagcataaataagttagtagaaaattttgagaaacaagaaaaagaaatagttaataaaatacatcagtttgatttagatttgagtcgaaagaacacgcaaaaagaaaaactggaaattcaaattaatgattttgaacgacattcacaattttcatcagtaaatgattttgaaacttattattctcatgctaaaaaacaagttgagacgtatgagtatgagaatgagaaaactaaagataaattgaacgagttgaataataagttaaagatagaaatgaatgatcaaaaacatttaactgagaatttaactcaaacaagtaaggaaataaataatttagaattaaaaatggaaaaagaaatgcaacaacttggttttgagtcttatgatcaagtcaaaagcgctgcagatttaagtgctcaaaaagatgaaatagaaagagaaattaatatttataataagaactatcaaagttatgaaatagagattaacagactcaaagaattggttaagggcaaaaaattattaaatttagaagaattacgacaatctatagaaaaaacaaacttgaaactagatgaaacgaattcacaaatagctacgattagctataaaatagataataactctaacaaatttaataaaataaaaaatataattcagattctcgatgatgaattaaaagtgcaaaaagaaattttcttgctatcagaaatattagctggtaaaaatgattataaattaacactagaaaattatgttttaatttattacttggaaaaaataatttttcaagcgaatcaacgactttcatttatgagtggaaatagatatcaactgattagaagagagaccatttccttagggttaagtggattggaaattgacgtgtttgattttcattcaaataaatcgagacacataagttcactttcaggaggagaaacatttcaagcatcactagctttagctttaggattaagtgaagttgtacaacaagaatcaggtggaatcactttagattctatgtttatagatgaaggatttggcactttagatcaagaaacactcgaaactgcgatagatacattaattaatttaaaatcatctgggcgcatggttggtataatctcacatgtaagcgaacttaagcaacgcatacctttgattttagaagtgacaagtaaccaatacgaaagtcatacacaatttagaaaaaattaa

SEQ ID NO: 406 - DNA, 132 bp, S.epidermidis
agaaaagggccatatagaataaatgacaatatacaactaactaaaacgattagtgtaaaacgtttaataggtttattccatatatttttaatcatggcgaatcctcatctttcttttccttatattctttaa

SEQ ID NO: 407 - DNA, 270 bp, S.epidermidis
gcgaataagtttatgtcaaaagagggtgtcaatttgacttatttagtcttttccattgtatttgcatttctaatgggtgctgtcgttatagtgataagaatgaaagcacaacagtttccagtcaatgaaaagaaaattatcttaccacctttttccatgctaccgtgcattgatgtattgtacccatactttcgattaactggtatggacaatgttagaatcattgatattaggtgttttgttttctactgttttaatctggacttctag

SEQ ID NO: 408 - DNA, 159 bp, S.epidermidis
tatttatttactaattcttgtcttttttgttcttttgctattttagatttcttcgccatatattataacctctttctacaaatcgtaataattacgttttatagaataacatatatttcaaaatatacaagtgaaaattcttctaagtacaaactataa

SEQ ID NO: 409 - DNA, 564 bp, S.epidermidis
aagatatttactctggtaaagctaaaacatggaaagaccgttaactctagttggccagataaaaaaatcaatgctgtttcacctaactcaagtcatggtacttacgacttctttgaagaagaagttatggacaaacaagatatcaaagctgagaagaacgctgatactaacgcgatcgtatcttcagtaactaaaaacaaagaaggtatcggttacttcggttataatttctacgaacaaaataaagataaattaaaagaagttaaaatcaaagatgacaatggcaaagttacagaaccaactaagaaaacaattcagaacggttcatacgcactaagcagaccattatttatctacgctaaagacaaatcattaaaagacaataaagtaatgtcagaattcatgaaatttgtacttgaagatgaaggtaaagcagctgaagacgctggttatgtagcttcacctaagaaaacttataaatctcaattagatgacttaaaagattttttagataaacatcaaaaatctgataagaaagacgacaaaaaatcagaagataaataa

SEQ ID NO: 410 - DNA, 135 bp, S.epidermidis
tcctcccttacaaaaacattatataagaacacgtgttctatttcaatatttataagaacatttgttcttattcattcttctcattttcatgctatactaaaagagccaacgttatatagcaaaggagaatgttga

SEQ ID NO: 411 - DNA, 309 bp, S.epidermidis
ttaaatcatactctaatcttaaatcttcttggaatctttttaactgatttattcttaatttgctatgttgttattttttctgtgaaatttaattctgggataactattattagtatgattttatgttacgtggtcataaagattacagacaatattaataaaatcaagttttccccttcaaatttcacaaatttagataccgataaaagttttattttcaacttatcaataatgagctctattactattgtttatatattcattatttacctcttagcaattacgattttcagaaaaattcaattttaa

SEQ ID NO: 412 - DNA, 1023 bp, S.epidermidis
cggcttgatacatatcccttgatgtatcaagccgctttatttttggcaagatttaaagtattgatgtcattgattcaatctctatataacagtaaaaaatttcaaaatagattccttttcaatttaggtattaagcattataattttaataatgatattagaaaggtgattatgatgagcaagtatgtaataacgaaaacactcaataacaatgtcatcatatgcacaaaaaatcatcaagaggttgttttaattggtaaaggtattggttttaataaaaaggttggtatgacagttcaagagaatgcttcaatagaaaaaatttataaattagaacaacaagagcaacaagaacactacaaaacacttttggagctcggagaagatcatgttgttcaagcggtgatagaatcagttaatattatcaatgaatctggtctaattacagatgataaaaatttggttgttgcacttacagatcacatcatttatgcctataaaagacttaagcaacatcaaatgattacaaatccatttgtgattgaaacaaaacatctctatagtaatgcatacaatgttgctcgaaaggtaatcgataaattaaataaaaccttagacgtacattttccagaagatgaaattggattcatcgcattacatattgcatccaactctgaaaaattatcaattcacgatatttcagtaataaacaagttaatcaataagagtattacaattattgaaactgatttacaacattcaattgataaacaaacaatacaatatcagcgttttataagacacatacaatttttaatatatcgattaactaaaggtgagtatttagaagcacaggagaattttatatcgatgataaaaactatgtatcctcgtagttttaatacggcttataaaatattaaaaatgattcaacgtgagtttagtgtgtatgtatacgaagcggaaatagtttatttaacattacatatcaatcattttgaagttcaaattagtagtgaataa

SEQ ID NO: 413 - DNA, 309 bp, S.epidermidis
ggtgataacactatgaatataaaattaactcaaaaggcagtagaatggtttaaaaacgaattggatttacctataagcaataaagttcttcaattttatgtaaaatatggaggagaattccaattaaaacaaggatttagtccagcgttcaccgtagaaaataaagatgctattgatataggttttgaacaaacattctatgaaataaatgtcgttattgcggaaaaagatttatggtattttcaagatgaaaaactaactgtagatgcaatcgatcatgaagatgagatcatctacaaacgaaattaa

SEQ ID NO: 414 - DNA, 135 bp, S.epidermidis
cttgacttaacatactctatggaaacttcagttcttatccccacaaatgatatttcacgacatgtaaatgatattgtagaaacaattcccgatactgaatttgatgaattcagacatcatcgtggcttaatataa

SEQ ID NO: 415 - DNA, 183 bp, S.epidermidis
gaattcctaacaacattagaaagggtgtttaacgtgcgcgtaaatattacattagcttgcacagagtgtggcgatcgtaactatattactactaaaaataaacgtaataatcctgaacgcattgaaatgaaaaaatattgtccaagattaaataaatatacgttacatcgtgaaacaaaataa

SEQ ID NO: 416 - DNA, 942 bp, S.epidermidis
gagagagggttttacatggcttcacaaacaaaggtgagagaaatgatagctaagaataatgctaaaaagggcgggctaagtgataaaattgtcccaattattttagccattatttcagctatatctatattaactacaattgctattttatttacacttttaaccgagacgattacgtttttcacacgagtgccattatctaaattctttttatctggtacttggaacccaactggttcatcaccagaatttggaatttgggcactcatcatcggcacattgaaaattactgttattgctacaatcgtagcagttccgattggtttaggagcagctatctaccttaatgaatatgcatctgatcgttcacgtagaatcattaaaccaatattagaaattttggctgggattcctacaattgtatttggcttctttgctttgacatttgttacacctatattgagaaatctaattcctaacttgggagagtttaattcaatcagtcccggtattgttgtgggtataatgattgtccctatgattacaagtatgagtgaagatgcaatgtcatctgtacctgataaaattcgtgaaggtgcatttggattaggcgcaactaaatttgaagtcgctacaaaagttgtattaccagctgcgacttctggcgttgttgcttcaattgtattaggtatatcaagagcaataggtgaaacaatgatcgtttctttagctgctggtagttcaccaacatcatctctaagtttaactagttcaattcaaacgatgacaggatatattgttgaaattgctacaggtgatgcagcatttggttctgatatttactacagtatttacgctgtaggttttacacttttcattttcactttaattatgaatttattatcacaatggatctctaaacgattcagagaggagtattaa

SEQ ID NO: 417 - DNA, 204 bp, S.epidermidis
ttgttgcaaactcatatttatgtgaaagtccgttttgaattaaccaaattgcatagttataacaataaacacaatttccatcataataaattattggcatgtgtatacactcctttttcattgcttaattatttatattcccatttaggtataataaataaacctatttttctcaattttaactcttttagaattacgcattga

SEQ ID NO: 418 - DNA, 282 bp, S.epidermidis
aataacagaacgaatttagtaaaatgcataaggataaagaaagcgggtgaaacaatggcaatttgggtagcaattattctaatcgttatagcacttattgcaggtttaattggtggtttcttattagctagaaaatatatgaaagattacttaaagaaaaatccacctatcaatgaggaaatgctacatatgatgatgatgcaaatgggacaaaaaccatctcaaaagaaaattaatcaaatgatgacaatgatgaataaaaatatgaatcaaaaaatgtaa

SEQ ID NO: 419 - DNA, 933 bp, S.epidermidis
acgttattgacctataacatcacatctaggtctcaatatataaaggagtttttaattatggctaattcacaagtagcagaaaaagagaaactagacgcacaaacaaataatcaagactcagttgccacaatagtaactactgaaaacaataagaaaaatacaattccagacagtgaaaagaagattgtttattcaactcaaaatctagatttatggtatggagaaaatcatgcgttacaaaacattaatttagatatattggaaaataatgtaactgcaataatcggaccttctggatgtggtaaatctacatacatcaaagctttaaatagaatggtcgaattagttccatctgtgaaaactgcaggtaaaattttgtatcgtgaccaaaatatatttgatgcaaagtattctaaagaaaagctacgtactaacgttggaatggtctttcaacaacctaacccattccctaagtcaatttatgataatattacttatggccctaagactcacggtattaaaaacaaaaaaattctagatgaaatcgtagaaaaatcattacgtggcgctgcaatatgggatgaattaaaagatagattgcatacaaatgcttatggattatcaggtggacaacaacaacgtgtttgtatagctagatgtttagcaattgaaccagatgtcattttaatggatgaacctacatcagcattagatcctatttctacgttaagagttgaagaacttgtacaagaattaaaagaaaattactcaattatcatggttacgcacaacatgcaacaagctgcgcgtgtttcagataaaactgctttcttcttaaatggatatgtcaatgaatatgatgatactgataaaatcttttcaaatcctgccgacaaacaaactgaagattatatatctggtcgttttggataa

SEQ ID NO: 420 - DNA, 996 bp, S.epidermidis
gtaaatatgactgaacagaaggatattaaagaaacagagtatcgacgacagaaaggaacaacttcgacaccttttaggcgaagaaataaaaaaagaatgcggaagttaccttttatcattttagtcatccttattattttaatttctatcattgtgtatattacccatcagtataacagtggtatgaagtatgctaaagaacatgctaaggatgttaaggtgcataaatttaatgggaatatgaaaaatgatgggaagatttcagttcttgtccttggcgcggataaggctcaaggtggtaaatcacgtactgactcgattatgattgttcaatatgattacgtacataaaaaaatgaaaatgatgtctgtcatgagagatatttatgctgatattcctggttatgataaatataaaattaatgccgcatattcacttggaggcccggaattgttaagaaaaacacttaacaaaaatttaggtgttaatcctgagtattacgctgtagtagattttactggatttgaaaaaatgatagatgaactacagcctaatggtgtcccaattgatgtggaaaaagacatgtctgaaaatataggtgtgtctttgaaaaaaggacatcataagttaaatggtaaagaattacttggttatgctagattccgtcatgatccggaaggcgattttggtcgtgtgagaagacaacaacaagtgatgcaaacattaaagcaagagttagttaatttcaatacagttgcgaaactaccaaaagttgctggtattttaagaggttatgttaatacaaatatgcctaactctgcgatttttcaaacaggtataagttttggaattcgtggagataaagatgtgcaatctttgacagtccctattaaaggaagctatcaagatattaatacaaataatgatggtagtgcgcttcaaatagactctgagaaaaataagcaagcaatcaaaaatttctttgaagataattaa

SEQ ID NO: 421 - DNA, 552 bp, S.epidermidis
aataaggtgacattattgaaatctaagaaaatgtcatcgcttttagtagtagcgatgataggaatacttgtaattattttccagtttgtaaaccattctggaccgtttagtggttcagaatctcaacatcaatcagataattccaatttaaatggtaaagacaaagtatatgtgaaacgagttgtagatggtgatacatttgttgctcaaaaaaatggagaggaaattaaagtcagattaattggtgtagatacgccagagactgttaaacctaatacgccagttcaaccatatggtaaacaagcatctaattatacgaagaagtatctcacgcatcaaaatgtttatttagaatatgataaagaaaaaactgataggtatggtcgtactttggcgtacgtatggttaaaaaatggagatatgtttaacgaatcgctggtgaaaaaaggtctagccagagaaaagtatttttctccaaacggaaaatatagggataccttcgtacacgctcaagaagaggcaaaaaagagaaaattaaatatttggagctag

SEQ ID NO: 422 - DNA, 300 bp, S.epidermidis
ctggtatggacaatgttagaatcattgatattaggtgttttgttttctactgttttaatctggacttctagattcgaagttaaagatgataatatttatatgaaacggtctaaagcatttccaattattttaatatcattattaataataagaacagttattaaaatatttataagtagcgaaattgatccaggtgaaattgctggtatgttttttttactcgcattttgtatgatagtaccttggagatgtgcaatgctttataaatataaaaaattgcaaaagaatcttattaagtaa

SEQ ID NO: 423 - DNA, 732 bp, S.epidermidis
aagcaagctgcaaaaggaggacaacatctaattatgattcaatttgatcatgtagattattcatatcatcgaaaacagcctgttttaaaagatattaatataagtattcaacgtggtgaaaaaataggggttttaggggaaagcggtgctggaaaaagtactattggttctttaatattaggtcaattaaagccaacaaaaggaaaaataagtatcgattcaggaaaggttctacctatttttcaacatgcgacagaaagttttgatcgtcaattcacgattgaacagtctttgagagagccacttttattttatcgacaattaatacgacaaaatatcaaaaatatcattcttaactatttaattgaatttaatttgtctacagatctaataacaaagtttcctcaagaggtaagtggtgggcaactacaaagattaaatattatacgttctctcttagcacaaccagatatattggtttgtgatgaaataacttcgaacttagacgtcatggccgaacaaaatgtaatcaatattttacttaacgaaaaaaacattcaaaataaaacactaatcgtcatctcgcatgatttatctgttttacaaaggttaacgaataggataatagttatcaaagacggtcaaatagtagatgattttaaaagtaaagatttatttagccataaaagacatccatatacaaaactattaattcaaacgtatgaatattga

SEQ ID NO: 424 - DNA, 132 bp, S.epidermidis
tatgtacatgcgacaattgctttattaaatatgataaaaatattaatcttaaaaaatataatctcaataatcaaatggtataacagtgcaataatagtgtacatcaaggtcgttttaacttataataaatag

SEQ ID NO: 425 - DNA, 243 bp, S.epidermidis
gttggtaacgcagagaattggtcgagtaatccacttggtgttgctaaaagtatcgtaggtatacctatcattacaagtggtgctgtttctcctaatgcgcgtgataaagataaaatgaaacctgttaaaataccaggtaatgctgcaggtaaaacaactcttctaattgtttgccatttattagcaccaagaccatatgatgcttctctgactgaactaggaactgctctgatagcttcctga

SEQ ID NO: 426 - DNA, 468 bp, S.epidermidis
gggatatattttaagatagatgggagacggcatatggaagataataatatgaaacgtggtctcaattcgagacatatatccatgatagcaataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttcactctgttgtttttaattcatatttttttctgttaa

SEQ ID NO: 427 - DNA, 654 bp, S.epidermidis
gatgcaatggcaattattagacaaaaatatgaaggtcagctagatggattaattaaagatttacggcgtcttggtcttcgtgtatattttaatattaacaatgcactagtatctttaggggaagaaaagaaatcattcgcaagacaaaccattgagaaagacaaagaaattaaccatttagatcatgaaattaacgagaaggtaatcatgctaattacgagacaacaacctattgccaaagatttacgtatgatgatggcagcactcaaaatctctactgactttgaacgaatgggggataatgctgctagtatcgctcatatacgtttaagagttaaaataaatgataactatgtgtttacacgtttaaaaaccatgggtaaattagcgatgctcatgttagaagatttaaataacgctattagaaataaagatttaccactgataaaagaagtcattgagagagatgaagatattgatgatttatacgttaacatcgtcaataccagttacttaattgataatgacccattcgtagctggtcaagcacacttagcagctagacacttagaacgaataggtgatcatataagcaatattgctgaaagtgtttattattatttaacaggccaacattttgaaacttttgattaa

SEQ ID NO: 428 - DNA, 123 bp, S.epidermidis
cacatgtgggcaattggcgagatagattctttactgagcgtaaaggtaagtatcagacagagaataaagaatcataaaaagaaaaaaatacaagaaaaagcaaaaaagaaattcctgatgtga

SEQ ID NO: 429 - DNA, 129 bp, S.epidermidis
acgttcaatttttatcatttaaatacatatatagtatttaattcattactagaacatataattaatatattaataataataaaaaaagagcgctacagttattcgataagtttctgtaacactcgttaa

SEQ ID NO: 430 - DNA, 132 bp, S.epidermidis
ccatcaaatttggttagtaaccttttagattttaaaatagaatttaataatatctttggctttgttatgataataattggagtactaatcgttattattcaagaatgtcttgaaataacagaacgaatttag

SEQ ID NO: 431 - DNA, 438 bp, S.epidermidis
gtattgttttatctatcattgcattattgcttatcgcttctttgctttgttacttcagctgactcagcaacattcgtattaggtatgcaaactacatttggatcattaaatccaagtagtctagttaaagtaacctggggagttgcgcaagcacttattgcctttgtactattattagctggtggaggagatggctctaaagccttgaatgctattcaaagtgctgccattataagtgccttcccattctcattcgtcgtcataatgatgatgataagtttctacaaagatgcaaataaggaacgtaaattccttggattaacacttacgccaaataaacatcgcttacaagaatatgttaaatatcaacaagaagattatgaaacagatattcttgaaaaaagagaagttagaagaaataaagaaaaagaagaatag

SEQ ID NO: 432 - DNA, 1272 bp, S.epidermidis
gaagggaattatctaattatgaaatttacagagttaacagttaaagaatttgaaaactttgtacaaaatccatcattagaaagtcattatttccaagtgaaggaaaatattgctacacgtgaatcagatgggtttcaagtagtgttattaggtgtaaaagacgacgacaatagagtgatagcagctagcctgttttctaaaatccctacaatgggcagttatgtgtattattccaatagaggccctgtaatggactattcagatttaggtttagtggatttttatttaaaagagcttgataaatatttacatcaacatcaatgcttatatgtaaaattagatccttactggttgtatcaagtttatgataaagatattaatcctttaacagaaaaaaatgatgctttagtaaatctatttaaatcacatggttatgatcatcacggatttacaacccaatatgattcttccagccaagttagatggatgggggtattagatttagaaggcaaaacccctgcatctctaaggaaagagtttgatagtcaaagaaaacgaaatattaataaagcgataaactacggtgtgaaagttagatttcttagtaaggatgaatttgatttattcttagacttataccgagagactgaagctagaactggatttgcttctaaaactgacgattatttctataactttatagagcattatggcgataaagtattagttcctttagcttacatagatttaaatgaatatatacaacatttgcaagaatcactaaatgataaagaaaatcgacgtgatgatatgatggcgaaagaaaataaaacagataaacagttaaagaaaatagctgagttagataaacaaattgatcacgataaaaaagaattgcttcaagctagtgaattacgtcaaacagatggcgaaattttaaatttagcttcaggagtatactttgctaatgcatatgaagtgaactatttctctggagggtcttcagaaaaatataatcaatatatgggaccatatgcaatgcattggcacatgattaattattgttttgataacggttatgatagatataatttctatggcttatcaggtgattttactgaaaacagtgaagactatggtgtttatcgctttaagagaggttttaatgttaggattgaggaattaatcggtgatttctataaaccaatcaataaagtgaaatattggttattcaatacattagatcgcatacgtaataaattgaaaaagtaa

SEQ ID NO: 433 - DNA, 1581 bp, S.epidermidis
aataatgattatgggcatatagaaaggattttcaaagtgaatgaagagcaaagaaaggctggaacgataaatattctagcagaacgtgatcgtaaagctgagaaagattatagtaaatactttgaacaagtgtatcagccacctagcttaaaagaagctaaaaaaagaggaaaacaagaagttcaatataacagagattttcatatagatgaaaaatacaaaggtatgggtaaaggtcgcacttttttaattaaaacatatggatgtcaaatgaatgcacatgacactgaagttatggcaggaatattaaatgcattaggatatagtgctacttcggatattaatgaagcggatgtgattttaattaatacatgcgccattagagaaaatgctgaaaataaagtctttagtgaaataggaaatttaaaacatttaaaaaaagaacgcccagattgtttaattggggtgtgtggttgcatgtctcaagaagaatcagtcgtaaataaaatattaaaatcttatcaaaatgtagatatggtttttgggacacacaacattcatcatttacctgagattttagaagaggcatatttatctaaagcgatggtagttgaagtatggtctaaagagggagacatcatcgaaaatttacctaaagtgcgtgacggtcacattaaagcttgggttaatattatgtatggttgcgataagttttgtacttattgtattgttccatttactagaggaaaagaacgtagtcgtcgtccagaggacatcattgatgaggttagagaattagcaagagaaggttatcaagaaattaccttattaggtcaaaatgtaaattcatatggtaaagatatcgaaggtctggattatgaattaggtgacttattggaagatatttctaaaattgatatacctcgtgttcgttttacaacaagtcatccttgggactttacagatcgaatgattgaagttatagctaaaggtgggaacatagtaccgcatatccatttaccggtacaatcaggtaataaccaagtattaaagataatggggcgtaaatatacaagagagagttatcttgatttagtttcaagaataaaggaagctatccctaacgtagctctaactactgatatcatagtaggttatcctaatgaaactgaagaacaatttgaagaaacattatcattatatgatgacgttcaatttgagcatgcatacacatatttatattcacaaagagatggaacaccagcagctaaaatgaaggataacgtacctttagaagtgaaaaaagaacgtttgcaaaggcttaataagaaggttggaatatattctcaacaagcaatgagtcagtatgaaggtaagattgttacggtattatgtgaaggttctagtaaaaaagatgagaatgttctagcaggctatactgataaaaataaacttgtgaattttaaaggaccaagagagagcattggtaaactcgttgatgtcaaaattgacgaggcaaaacaatattctttaaatggaacatttatacaagaacatcaacgttcaatggtgacacaataa

SEQ ID NO: 434 - DNA, 1347 bp, S.epidermidis
ccccttatctatattttttcaacagtacaattgtttttctcaaaagcacaaacggaggtaatttacatgaaagagttaaatatcgcattacttggtttgagaacagtcggatcaggtgttgtaaagattattgaagagaatagacaacagattaaagacaccatcaataaggatattgtcattaaacatattctagtccgagataaatctaagaaacgtccgttaaatattagtcaatatcatcttacagaagatattaatgacatcttaaatgacaattctattgatatagtcgttgaagttatgggtggtattgaacctactgttgattggttaagaacagcccttaaaaataaaaaacatgtgattacagcaaataaggatttactagctatccatttaaaattattagaagacttagctgaagaaaatggcgtcgctcttaaatttgaagcaagtgtggcaggtggtatccctattgtcaatgctattaataacggactgaatgcaaataatatttctaaatttatgggaatatttaacggaacttctaactttattctctcaaaaatgactcatgaacaaacaacttttaaagatgcgttagaagaagcacaaagattaggatttgctgaagctgatccaacagatgatgtagaaggtgtagatgctgcaagaaaggtagttattacatcttatttatcttttaaccaagtcattaaactgaatgatgttaaatcggtaggaattagtgacattacattagcagacatcaatgcagcaagcgcattaaattataaaattaaatcaataggtaaaggtacatatgaaaatggatatgtgaatgcttctgtggaaccgacactgatacataagaatcaccaacttgcagctgtagagaacgaatacaatgcaatatatgttataggtgatgctgttggcgatacaatgttttatggtaaaggtgcaggtagtttagcaacaggaagtgcagttgtaagtgatttattaaatgtggcacttttctttgaatcaaacttacacactttaccacctcattttgaattaaagacagaggaaactaaagaaatgatggatggtgcagaaccagtggttattcaagagaaatctaattactatatagtaattagtaacaataataaatctttggagaaagttgaatatgacattaaaaagaaattaccattccataaatcgttgcaacttgttgagagggatcaagatacttatgcaattatcgttactggaatagaaacatctccagaaaaagttctaaatcaatcaggatttaatatcaagaaagtttatcctgtagagggagtttaa

SEQ ID NO: 435 - DNA, 654 bp, S.epidermidis
aatagatactacatagtaatcaatattaaatataaaagtgagggggagcttgctatgtcaaaacaggatggaaaattaactggactttttggtgcgccagtttcggatagagaaaatagtatgacagcaggacaacgtggaccattattaatgcaagacgtttattatttagaacaaatttctcacttcgatagagaagtgattcctgaacgtcgtatgcatgcgaaaggttcaggtgcatttggtacgttcacagttacaaatgacatcacacaatatacaaatgcgaaaatattctcagaagtcggaaaacaaacagagatgtttgcacgtttttctactgtttcaggagaacgtggagcagcagatttagaacgtgatatacgtgggtttgccttgaaattctacactgaagatggaaactgggatttagtaggtaacaatacgccagttttcttctttagagatcctaaactatttattagtttgaatcgtgctgtaaaacgagatccacgtacaaatatgagaagtgcacaaaataactgggacttttggacaggtctaccggaagcattgcatcaagtgacaatattaatgtcagatagaggtatgcccaaaaggattccgaaatatgcatggattcggttctcataa

SEQ ID NO: 436 - DNA, 207 bp, S.epidermidis
gtacgtcactacaagttacgagaaactttggtaatttgtatactgttaataagaatgtatttaagtttgttaatcaaggtattatcattttttcataggacgagtgaatttgaataccgaaagattaataacttaaagtgcattcttttttttatgaataaaaaagaagaatgtacttttaaaagaattgttaaaccttttatttag

SEQ ID NO: 437 - DNA, 1041 bp, S.epidermidis
tattttttatattcgttgaaagtgaaaggatgccaacatatgtttaaaatgataatttataaactttcacaaatgattgtcgtactatttatattaactacaatcacatttatattaatgaaactctctccaggtaatcctgtagacaaaattttacatcttgatatttcgcatgtatctaatgagcaaatagaaacgacagagaataagcttggcttaaataatcctatttttattcaatggtgggactggttaaatcaattgtttcattttgatttaggaacaagttatcaaacaagcgagcctgtaattagggaaatagcaaattatcttggtcctacacttattattacttttggtacgcttatagtgtcattagttatttctataccattagggattatagcagcggtttactaccataaaatttgggataggataatccgtgttatgacatcattatccgtaagcctaccatcattttttatcggtcttatcttattatatatatttagcttgaagttgaatattttaccaacttcagatgaggggcgtttcgtttcatatattttaccaataattaccatgagtattggaatgtgtgcttattatattcgatttattcgttctactttattagaacaatatcaaacacctatagttgaatcgtctcgtctcagaggtatgcccgaaagatatatactttttcaagatatccttaaacctacgatactaccaatcatacctctattaggattatccattggtagtttgataggtggaacagtagtcattgaaaatttatttgatattcctgggttaggctattttttagttgacagtataaagtcgagagattatccagtcattcaaggttgtgtattatttattggtttctttgtagtgattataaacacaattgcagatttactttcattacttatcgatcctaaacaacgttatgctattactcagaaagaaacatcaaagtttaaatggtttaattcacatagaaaagaaggtcgtaacgatgaagtttaa

SEQ ID NO: 438 - DNA, 147 bp, S.epidermidis
tgcatcatatataaattaatcattggattccaccttgaacatatttttttatctacacaattattctatgtcgttattcattatttaatttacgcagtgcagacacaatctcacgttttgagtcttgaacttctgaagtttgtttaa

SEQ ID NO: 439 - DNA, 183 bp, S.epidermidis
acggaggtatatctcatggagaacaatcaaagtaatattactgaagaaacgaaacacaatgataatttagaaacaacttatgaacaaacgcaacaaaaagagaaaacattctctcaagaagaagtatctcaaatgattaaggatcgtttagctagaaaaaaaagaaatctgaataacgtatga

SEQ ID NO: 440 - DNA, 810 bp, S.epidermidis
ctattgtcatatatgttaaaaatttatatttgtattttaaaatcatccaatatcactcctagaacatttgtttgtataagtaatttatcagaacataaattctgtgtcaacaacattacgaacaaatgtgtgttagaaaatgtaattaatgatataataatctcaaacaacaataaggagtgcctatttatgagagaactcactaagcgacaaagtgaaatatatgattatattaagaaaattgttcagacaaaaggttatccaccaagtgttcgagaaattggcgaagctgtcggtttagcttcaagttctacagtacatggacatttatctagattagaagaaaaaggatatataagaagagatcctactaaacctagagctatcgagatagttagtgaacaattagatgaggtaaatgtagaggaaacaatacatgttccggttatcggtaaagttacagccggcgttccaattacagctgtagaaaatatagaagaatattttccactaccagagcacttaacttcaacacataacagcgatatatttattttaaatgtagttggggaaagtatgattgaagctggaatattagatggcgacaaagtaattgtacgaagtcaaactattgctgaaaatggtgatattatagtagctatgactgaagatgaagaagctactgttaaacgcttctataaagaaaaaaatcgttatagactacaacctgaaaatagtactatggagcctatttacttagataatgtcattgtagtaggtaaagtaataggattatatagagaaatgtaa

SEQ ID NO: 441 - DNA, 2676 bp, S.epidermidis
atttatacatataatataaataaagatataagaataagggttgtgaaaatagaaatggctaacattacaccaatgatgcaacaatatttaaagataaaatctgaatatgatgattgtttgctattttttagactcggagatttctatgaaatgttctttgatgatgctaaagaagcatcaagagtacttgaaataacattgacgaaaagagatgctaaaaaagaaaatcctattccgatgtgtggcgtaccatatcattctgctgataattacattgaaacattgattaataatgggtataaggtcgctatatgtgaacaaatggaagatccaaagcaaacaaaaggaatggttagaagagaagttgtaagaatcatcacaccaggaactgttatggatcaaaatggtatggatgaaaagaaaaataattatattttaagttttatcgaaaatgaagaatttggattatgctattgtgatgtttctacaggcgaactcaaagtaactcatttcaaagatacagcaaccttgcttaatgagattacaacaattaatcccaatgaaatcgtcataaagcaagctctatctgaagaattaaaaagacaaatcaacatgataactgagacgattactgttcgcgaagatatatctgatgaagattatgatatgaatcagttgacacatcagttaatgcatgacacaactcaattattgttagattacattcatcacacacaaaagcgagatttatctcatattgaggaagtaattgaatatgctgcagttgattatatgaagatggattattatgcgaagcgaaatttagagctgacagagagcatacgattaaaatcaaaaaaagggactttgttatggttaatggatgagacaaaaacaccgatgggtgctagacgtttaaagcagtggattgatcgtccattaattaataaacaacaaatcaacgacagattaaatattgttgaagagtttatggaccgttttattgaaagagatacattacgtaatcatttaaatcaagtgtatgacatagaacgactagtaggaagagtgagttatggaaacgtaaatgcaagagatttaatacaacttaagcattctatatccgaaatacctcacattaaagcattactcaatgaattgggtgcacaaactaccacgcaatttaaagaattagaacctttagatgacttgttacaaattttagaagaaagtttagttgaagaaccacctatttccatcaaagatggaggattatttaaaaatggcttcaacgcgcaacttgatgaatatttagaagcttcaaaaaatggtaaaacttggcttgcagaattacaagctaaggaacgtgaacgtacaggtattaagtcattgaaaattagttttaataaagtgtttggttattttattgaaattacacgtgcaaacttaaataattttcaacctgaagcgtttggctataatcgaaaacaaacattatctaatgctgaacgatttattacggatgaattaaaagaaaaagaagatataatacttggtgctgaagataaagcagtagagttagaatatgaattatttgttaaattacgagaacacattaaaacgtacactgaacgtttacaaaagcaagcgaaaatcatttcagaacttgattgtttacaaagttttgctgaaattgctcaaaaatataattatgtcaaacctacatttagtgatgataaagttttacatttagaaaactcaagacatcctgttgttgagagagtgatggattataatgattatgtacctaatgattgccatcttgatgatgaaacgtttatttatctcattacgggacctaatatgtcaggtaagtcaacatatatgagacaagttgctataataagtatcatggctcaaatgggagcatatgtaccatgtgattcagcaacattacctatatttgatcaaatttttactaggattggtgcagcagatgaccttgtatcaggtaaaagtacatttatggtagaaatgttagaagctcaaaaagctttaacttatgctactgaaaatagtttaattatctttgacgaaataggaagaggtacatctacttatgatggtcttgcgttagcgcaagcgatgattgaatatgttgctcaaacttcccatgctaagacacttttctcaacacattatcatgaattgacatcacttgatcaaatgcttaagtgtttaaaaaatgtacatgttgctgcaaacgagtatcaaggtgaactgatatttttgcataaagtcaaagatggcgctgtggatgatagctatggtattcaagtggcaaaattagcggatttacctaatgaagtcattgatagagcgcaagttatattaaatgcatttgagcaaaaaccttcgtatcaactctctcatgagaatactgacgatcaacaaacggttccgtcgtataacgattttggtcgaacagaagaagagcaatcagttatagaaacacatacatcaaatcataattatgagcaagcgacctttgatttatttgatggttacaatcaacaaagtgaagttgaatgtcaaattcgagaattgaatctatccaatatgacaccattggaagccttaatcaagctgaatgaattacaaagtcaattaaagtag

SEQ ID NO: 442 - DNA, 231 bp, S.epidermidis
tttaatcaatataatgaaaggggtatgggatttatgcaacaaataaaatttaaaactttaactgaggaaacactggagagcttagagaaaagtgttaattcgtttttaaagtctcaagagggtaatggttacaaattattaaacattactattaaacaaatcgaagaacgtgcatttccgcataatgacgaggactttaatgctattttaacattggtaacggaagcatag

SEQ ID NO: 443 - DNA, 1029 bp, S.epidermidis
ttttataaatatagcaacgagaggaagttgaaaatgacccttcttgagaaaattaaacaaaataaatctttatctaaaaaagatatgcaatcatttattgttacactgtttgattcaaatatagaaaccaatgtaaaggttgaattattgaaagcttatacaaataaagacatgggtcaatatgagctaacgtatttagttgaatattttatccagacaaactatccaaaccaaccattttataataaagctatgtgtgtttgtggcacaggtggagatcaatcaaatagctttaatatttctacaactgtagcttttgttgtagcaagtgcaggagtgccagtcattaaacacggtaataaaagtattacttcacattcaggaagtacagatgtattacatgaaatgaatataaaaacaaacaaaatgaacgaagtagagcaacaattaaatttgaaaggattagcattcataagtgcaactgattcttatccaatgatgaaaaagcttcaatcaattagaaaatcgattgcaacacctacaatttttaacttgattggaccattaattaatcctttcaaattaacttatcaagtgatgggggtatatgaagcttcacaacttgaaaatatagcacaaacattaaaggatttaggtagaaaacgagcaattttaattcatggtgcaaatgggatggatgaggccacgctttctggtgaaaatatcatttatgaagttagcagcgaaagagcattaaaaaaatatagtttaaaagcagaagaagtcggtttagcttatgcaaataatgacacgttgataggtggttcacctcaaacaaataaacaaattgcattgaatatcctaagtggcacggatcactcaagtaaacgagatgtagttttgttaaatgctggaattgctttatatgttgctgagcaagtggaaagtatcaaacatggcgtagagagagcgaaatatctcattgatacaggtatggcaatgaaacaatatttaaaaatgggaggttaa

SEQ ID NO: 444 - DNA, 1758 bp, S.epidermidis
aatcacaaatatcatggaaagtgggcggtcagcaagggcgaaggtattgaatctaccggtgaaatctttgctactgcgatgaatagaaaaggttattttttgtatggatatagacacttttctagtcgtataaaaggtggccatactaataataagataagagtttcaaaatcgcctgtgcatgcgattagtgatgatttggatatactcattgcttttgaccaggaaacgattgaattaaatcatcatgaaatgagagaagatagtattataattgcggatgctaaagcaaaaccccaaaagccagagaactgtgtggctcaattaattgagttaccattcactagcacggcaaaggaacttggaacagcattaatgaagaatatggtggcaattggtgcgacatctgcactgatggatttaaatacatcaacttttgaaactttaatcgataacatgttttcaaaaaaaggtaataaagtcgttgatatgaatatacaagcccttaatatgggttatgatttaatgaagcaacaagttaccaacgttaatggagactttacattagagaatggtagcggtcatcctcatttatatatgataggtaatgacgcaatcggattaggagcaatagcagctggatcaagatttatgtccgcttatccaattacgccagcttctgaaattatggaatacatgattgccaatctacctaaagttgatggtactgttgttcaaactgaagatgaaatagcagcagcaacgatggcgattggagctaactatgctggcgtacgaggctttacagcgagtgcgggtccaggtctttctttaatgatggaatctattggattgtctggtatgactgaaacgccattagtcattattaatactcaaagaggtggtccttctactggcttaccaacaaagcaagaacaatcagatttaatgcaaatgatttatggtacccatggtgatattccgaaaattgtcgttgctcctacagatgctgaagatgcgttttatcttactatggaagcatttaatttagctgaagaataccaatgtccagtcattctgttaagtgatttacaattatcattaggaaaacaaactgttaaaacactcgattataataaaatcgatattcgtcgtggagaaataatacagtcagatatcgagagagctgaagatgataaagcatactttaaaagatatgcattaacagctagtggcgtatcaccacgaccaataccaggtgttaaaggtggtatacatcatgtaacaggtgttgaacataatgaagaagggaagccaagtgaggcgcctatgaatcgtcagaatcagatggaaaaacgaatgcgcaaaactgaaagcttggttatcaataatcctgtgttactcaatgaacatgaagacgaagcagatatactgtatataggatttatatctactaaaggtgctattggagaaggtgcagaaagactagaacgacatggtgtaaaagtgaatacgatgcatattcgacaattacatcctttccctaaagatattgttcaacaagctattaataaagcttcgaaagtaatagttgcagaacataattatcaaggacaattatcaagtattttaaaaatgaacacacaagttaatgataaattagttaatcaaacaaaatacgatgggaaacctttcttaccttatgaaattgaagaaaaaggtttggaaattgctaaagagttaaaggagttggtgtaa

SEQ ID NO: 445 - DNA, 1332 bp, S.epidermidis
atgagtgattttaggaggggcaaaatgacgcaaaaagtaaacgttgtaggagctggtttagctggctctgaagctgcatatcaattagctcaacgtggaattaaagtgaatttaattgagatgcgtccagttaaacagacaccggcgcaccatacagataaatttgctgaattggtatgttcaaattcattgagaggtaatgcacttacaaatgctgttggtgttcttaaagaggaaatgagacatttagactcgttaattatcacatcagcagataaagcacgtgtgccagcgggtggtgctttagcagtggatagacatgattttgctggctatattacagataccttaagaaaccaccctaacatcactgtattaaatgaagaagttaatcatataccagaaggttatacgattattgcaactggccctctaactactgagcatttagctcaagaaattgttgatattactggtaaagatcaattgtatttttacgatgctgccgcaccaataatagaaaaagattcaattaatatggataaagtatatttgaaatcacgttatgataaaggtgaagcagcgtatcttaattgtcctatgactgaagaagagtttaaccggttttatgatgcagtattagaagctgaagttgcaccagtcaatgagtttgaaaaagaaaaatattttgaagggtgtatgccttttgaagtcatggctgaaagagggcgaaaaactttgttatttggtccgatgaaacctgttggacttgaagatcctaagactgggaaacgcccttatgcagttgttcaattaagacaagatgatgcagctggaacattatataatattgttggctttcaaacacatttaaaatggggtgcgcaaaaagaagtcattcgtttaattccaggattagaaaatgttgatattgtaagatatggtgtgatgcaccgaaatacctttattaattcacctgatgttttaaacgaaaaatatgaattaaaaggacatgataatttatattttgctggacaaatgactggcgttgaaggttatgttgaaagtgctgccagtggattagttgcaggtattaatcttgcgcataaaattttagacaaaggtgaagttattttccctagagagacaatgataggtagtatggcttactacatatcacatgccaaaaatgagaagaattttcaacctatgaatgccaattttggtcttttaccatctctcgaaaaacgtattaaagataaaaaagaaagatatgaaacacaagccaaaagagcgttagagtatttagataattacaaacaaacgctgtaa

SEQ ID NO: 446 - DNA, 1257 bp, S.epidermidis
aaggagatgtataacgtgacacagcatgcgacttataaaacaaaaaataaacgagaaactgctgtattaatcggtgtacatgctcaaacggatcgtcaatttaattttgaatctactatggaagagctcgatgctttatcacaaacttgccaacttaatgttaaaggacaaatcactcaaaatagagagcaatttgaccataaatattatgttggaaaaggaaaaatcgatgaaataaaatctttcatagaattccatgatatagatgttgtcgtaaccaacgatgaattaacgacggcacagtctaaaacgttaaatgataatttgggcattaaaatcatcgatagaacccaattaattttagagatattcgcgttgcgagcgagaagtagagagggaaagctacaagtagaacttgcacaactcgattatttgttaccaagactacatggtcatggtaaaagcctatctcgtcttggtggtggcataggaacaagaggcccaggtgaaacaaaattagaaatggatcgtcgccatattagaacacgtatgaatgagattaaacatcaattaaaaacggtcgtggatcatcgggaaagatatagaaataaacgtgaacaaaatcaagtttttcaaatcgctttagttggttatacaaatgcaggaaaatcgtcatggtttaatgttttagctaatgaggagacctatgaaaaaaatattttgtttgcaacattagatcccaaaacacgacaaatacaagtgaatgaaggatttaatttaattatttctgatacggtaggatttattcagaaattaccaacgacattggtggctgcgtttaaatctacactagaagaagctaaaggtgcagacgtacttatgcatgtcgtcgatgcaagtcattcggaataccgtactcaaattgacactgtaaatcaaattattaatgatttagatatggaccatattccacaagtagttatttttaataaaaaagacttatgtaacgaacagatggatgtacctgtatctaaatctgcgcatgtttttgtatctagtcgtgatgaaaatgataaacaaaaggtgaaaaatttagtaattcaagaaataaaaaatagtctcagcccatacgaagaaattgtagatagtgctgatgcagatagattatattttcttaaacaacacacgcttgttactgaattaatatttgacgaaacacaagcatcttatcgtatcaaaggatttaaaaaattataa

SEQ ID NO: 447 - DNA, 153 bp, S.epidermidis
aatccaacgtacccacgaaaatttcatcaatcatgtgaagaagcattaaatatacgcaggacaactaaaatggataataaacttaatcccgtaagcatagatactaaaataataaaaatatattgtacaagttttttcgtgtcattagtataa

SEQ ID NO: 448 - DNA, 180 bp, S.epidermidis
gactttaggtacaccacttcatctttaacacctatttcattaattgttactagttctgaagcacaattattaattttctcacgtagtgttctaactaatttaccacttttttcttttggacaaagagtgagtatcgtaggtccagctccacttataacagttgcatatgcatcatgttga

SEQ ID NO: 449 - DNA, 954 bp, S.epidermidis
atttattatcacaatggatctctaaacgattcagagaggagtattaatatgtctacacattcaaatactgctaacaaaacattgattgataaagatgccgtagaaaaaaatatttcttctcgtgataggaaaaactcggtaaacaaatggttatttttattatgtacattaattgggctcattgttttagtagcactattaattcaaactttcgttaaaggggcgggacatctaactcccgaatttttcactaatttttcatcttcaacaccagcagatgctggtattaaaggggctttagtaggttctatttggttaatcttaagtattattccaattagtatcattttaggaataggtacagcaatttatttagaagaatacgcaagagacaatatttttacacaaatcgtaaaggtgagtatatctaatttagctggtgttccttcaattgttttcggtttactaggttatacattatttgtaggcgcggcaggtttaggtaatagcgtgctagccgctgcgcttacaatgtcactactaatcttgcctgttattatcgttgctagtcaggaagctatcagagcagttcctagttcagtcagagaagcatcatatggtcttggtgctaataaatggcaaacaattagaagagttgttttacctgcagcattacctggtattttaacaggtttcattttatctttatcacgcgcattaggagaaacagcaccacttgtaatgataggtatacctacgatacttttagcaacaccaagtggattactcgaccaattctctgcgttaccaactcaaatttatacatgggcaaaaatgcctcaagcagaattccaaaacgttgcatcagcaggtattatcgttctactcgttatcttattattgatgaacactgtagcgatacttcttcgtaataaatttagtaaaaaattctaa

SEQ ID NO: 450 - DNA, 708 bp, S.epidermidis
gaatgtagtcaggaggactatgctatgcaacaagaacgacaatcgtggtaccaaaaatcttggtttattattctcacattgctatttatttttccattaggtctctttctaatgtggaggtatgcgcattggaagaattggttaaaattgactgtttcatcagtctatattattagtttagttttaacacttttatttcaagttagtctattaaatgagaataaaacaaatcaaatagaacatgcatcaactatgaaagaaaagtctaatataaataatgtaaaaacaactaaaaataaaaatatggaaaaatcaacgcagacagacaaacaaaactctgtgaacttaaagcaaaacacaaaagatcaaaataataacgcaaatgatgaagcagcttctccaactagcgaacaaaatgcagctatagcacaagcaaagtcatatgcaaatacattacctatctctaagaaaagtttatacaaacaattaacttcggaatacggagagaaatatccggcagacatagcacagtatgctgttgaccatatcagtgtagattataaaatgaatgcactgagattagcaaaaagttacgtaaaaaatataaacatttctaatcaagcgttatatgatcaactcgtttcagaaaatggagaaggatttactcctgaagaagcacaatatgcaatgaatcatttagataggtaa

SEQ ID NO: 451 - DNA, 420 bp, S.epidermidis
tacttaatccattattttgatttttatttaaatcaacctacctggttcctcaccaaattctctgcactaagattttccgttaccattctgttctcatatttatattttcaattgaaatatctatcaaaaattaaactattcttctatttaagtattcaacaaatgatgatacacctatatgggatggaatacttaccaacatatgtatatacctttgcttcaattattttacaattttccactcacatcattgacacaagggatttcctataccttatttcttttccatatatcactagcctgctatatctgggctcaaaaacaatgtgctacttacaatttcattatgtatgtgctaaactgtttgtgtcggatgacattaaaaagcatctcttcgtgttgaatattttggttggctga

SEQ ID NO: 452 - DNA, 147 bp, S.epidermidis
tgtaaatgtcttctgtgcaatgtaacgaattctaactcgttcataaaattatccatcccttatataactatttctttaatatttcaatgtgtatcattctataataaaaaggcgaaattaatgattaatgcatcatatataaattaa

SEQ ID NO: 453 - DNA, 150 bp, S.epidermidis
tataaaatacaaaatgaagttataaaaactgtatcactacaggcagctaagaatgtagtcaggaggactatgctatgcaacaagaacgacaatcgtggtaccaaaaatcttggtttattattctcacattgctatttatttttccattag

SEQ ID NO: 454 - DNA, 2397 bp, S.epidermidis
gtattgccacaagcaaaaaaaagaacatcgacgaagagaaagggtaataaaaaaacgaataaaaaaaagcaaaatgaaacgcctttaagatatatattctcaataattgtagtaattcttattatactaggcgcttttcaattaggaatcattggtagaatgattgatagcttttttaattatctttttggtatgagtcgatatttaacttatattttagtacttattgcaacaatttttataacatactctaagcaaatacctagaactcgacgtagtatcggtgcaatagttttacaattagctttgttatttatagcgcaattgtattttcatttttcacataatatcacttctcaaagagagcctgtactgtcctttgtttataaagcttatgaacaaacacattttccaaattttgggggaggcttaataggtttttatttacttaaactatttatacctctcatatctattgtaggtgtaataataattactatcctattactagcttcgagtttcattttattacttaatttaagacatagagatgttacaaaaagtttattcgacaacctcaagtcatcaagtaatcatgcatctgagtcaataaaacaaaaaagagaacaaaataagattaaaaaagaagaaaaagcccaattaaaagaggcaaaaattgaacgaaaaaaacaaaaaaaatcacgtcagaataataatgtcattaaagatgttagtgattttccagagatttctcagtcagacgatattccaatatatggtcataatgagcaagaagataaaagaccaaatactgctaaccaacgtcaaaaacgtgttttggataatgaacaatttcaacaatcattaccaagtaccaaaaatcaatcaataaataataatcagccatctacaaccgctgaaaacaatcaacaacaaagtcaggctgaaggctcaatatctgaagctggtgaagaagccaatattgagtatacggtgccacctttatccttattaaaacagcctactaaacaaaaaactacttcaaaagctgaagtccaacgtaaaggtcaggttttagaatctacactaaaaaactttggagttaatgctaaagtaacacaaattaaaatcggtcctgcagttacgcaatatgaaattcaaccagcgcaaggtgttaaagtaagtaaaatagtcaatctccataatgacattgcattagctttggctgcgaaagatgtacgaatagaagcacctattccaggtcgctctgcggtaggaattgaggttcccaatgataaaatctcacttgtcactctaaaagaagttttagaagataagttcccatctaagtataaattagaagtcggcattggtagagatatttctggtgatccaatatcaattcaattaaatgaaatgcctcacttactcgttgctggttcaacaggaagcggtaaatcagtttgtattaatggtattataacgagtatattactcaacacaaaaccgcacgaagttaaacttatgttaatcgatcctaaaatggtagagttaaatgtttacaatggtattcctcatttacttataccggttgtaacaaacccacataaagcgtctcaagctttagaaaaaattgtttcagaaatggaacgtcgttatgatttgtttcaacattcatcgacacgaaatattgaaggatataaccaatatatacgcaaacagaatgaagaacttgatgaaaaacaacctgagttaccgtatatcgtcgtaatagtggatgaattggctgatttaatgatggttgcaggtaaagaagtagaaaatgctatccaacgtattactcaaatggctagagcagcgggtatacacttaattgtagctactcaaagaccttccgttgatgttattactggtattattaaaaataacattccatcaagaattgcgttcgctgtaagttctcaaactgactctagaacaataattggtgctggtggagctgaaaagctacttggtaaaggtgatatgctatatgttggtaacggagaatctactacaacccgaattcaaggtgcttttttaagtgatcaagaagtgcaagatgttgttaattatgttgtagagcaacagaaagcaaattatgttaaagaaatggaaccagatgcacctgtagataaatcagaaatgaagagtgaggatgctttatatgatgaagcttatttatttgtaatagaaaagcaaaaagctagtacttctttattacaacgacaatttagaatcggttataatcgagcttcaaggctcatggatgatttggaacgtaaccaagttattggtccacaaaaaggaagtaaacctagacaaatattagttgatttagaaaatgacgaggtgtaa

SEQ ID NO: 455 - DNA, 165 bp, S.epidermidis
agcattgcacatctccaaggtactatcatacaaaatgcgagtaaaaaaaacataccagcaatttcacctggatcaatttcgctacttataaatattttaataactgttcttattattaataatgatattaaaataattggaaatgctttagaccgtttcatataa

SEQ ID NO: 456 - DNA, 873 bp, S.epidermidis
ttgatacaacatacgatgttaaaactatattgggcaaatttcactacggcacaacttcatcatcttacaagtacatatcctgactttctatcagaaaacgtatttcatcaacatgacatgataaaaaggtggcttacagagcgtaattctgaaaggctatggaacaaatatgaacgtttcaaagaattaaagctgatggacattattaaagaaatgaaaaaagcaaatgttagttttacaacatactttgatgataactacccttctctttgcaaagaaatgtatgattatccttatgtgatattctacaaaggaaatccacagttctttaatcattctcactctttagctgtaattggctcacgtaatgccacacaatatacaagtcaatctttaaactatctttttccttcatttagacaattaaatatggcgattgtttctggattagcgcgcggtgcagatagtgtagcacatcaaaccgcacttaaatacctattaccaactattggcgtacttggatttggccattgttatcattatcctaaagcaaccttaaatttaagaactaaagttgaaaggaatggcttagtgataagtgaatatccaccattttctcctataagtaagcataaatttcctgaaagaaacaggcttataagtggtctgtccagaggggtacttataactgaggctgaagaaagaagtggtagtcaaatcactatcgattgtgctttagagcaaaatagaaatgtttatgttctacctggttcaatgttcaacaaaatgactaaaggtaatttaagaaggataaatgaaggtgctcaagttgttatagatgaaagtagtatattatatgattatctattttag

SEQ ID NO: 457 - DNA, 138 bp, S.epidermidis
ttaattaaacaatcatctatcattttatcatactcatttattccattgaataagcaaataaaaaaactgtaccaaagtcttagttggtacagtttagactatgaagatattcaatgtctaacagatgtttcattttag

SEQ ID NO: 458 - DNA, 810 bp, S.epidermidis
gaggatgaacagagaatgagaatattgtttataggcgacatcgttggtaaagtgggcaggaaaatgattactacttatttacctaaaattaaacaaacttatcacccaacagtttctatagtaaacgctgaaaatgccgcacacggtaaaggattaacagaaaaaatttacaaacaacttttgagagaaggcgtggatttcatgactatgggtaatcatacatatggtcaaagagaaatttacgattttattgatgatgctcatcgaatggtgagacctgcaaattttcctgatgaagctccaggaacaggtatgagaataataaaaattaacgatattaaattggctattattaatttacaaggccgttcatttatgcaagacattgatgatccatttaaaaaggctgaccagctaatcgaagaagctcaaaaatctacaccatatatatttgtagattttcatgctgaaactacatctgaaaaaaatgctatgggttggtatttagatggtagagtgagcgctgttgttggtactcacacacatattcaaacttctgatgatcgtatattacctcatggcacaggatatatcacagatgtcgggatgacaggttattacgatggtattttaggtatcaatagagatgaagttattcaacgttttattactagtttgccacaaaggcatgttgttccagatgatgggcgaggcgtattatcaggagttatcatagatttagataaagaaggtaaaacgactcaaataaaaagactgttaataaatgaggaccatcctttccaaatttaa

SEQ ID NO: 459 - DNA, 1254 bp, S.epidermidis
aaaggaagacagattatgcaagattttagcaatttagttgaagaagttgaaaacacacttattccttactttagaaaaattgaaaagcgtgcattatttaatcaggaaaaggtcttaaatgcttttcaccatgttaaagctagcgaaagtgatttacaggggtctacgggttatggatatgatgattttgggagagaccatttagaacaaatttatgcgcacacatttaaagcagatgacgcacttgtaagacctcaaattatttcaggtactcatgctattactttagctttacaaagtacgttaaaaaacaatgatgaactactttatattacaggtagtccatatgatacacttctagaagtcattggtataaatggcaatggtgttgaaagtcttaaagaatatggtgttcgctataatgaagtcgaattacgtgacggtcgaattgatattcctaaagtcatcactgcaattaatgacaatacaaaagttgtagcaattcaacgatcaaaaggatatgatcaacgtccatcaattacaattaatgaaattgaacaagcaataacatctattaaagaggtttatcccaatatcattatttttgttgataattgttatggagaatttgtagaagataaagaaccgattgaagtaggtgctgatttaatcgccggatcattaattaaaaatccaggtggaggtttagctaaaattggaggatatattgctggtagacaagacttaattgaacgctgtggttatcgtttaacagcaccaggcattggtaaggaagcaggagcctcacttaattctttacaagaaatgtatcaaggattctttctagcgccacatgtggttagccaaagtttaaaaggtgcactgtttactagtttgttattagaaaaaataaacatgaagacctcccctaaatataatgtttatcgtacagacttaattcaaacggttcaatttgagaccaaagagcaaatgatttcattttgccaaagtatacaacacgcttcaccaattaacgcacattttagtccagaacctagctatatgcctggatacgaagatgatgtcatcatggctgcaggtacatttattcagggctcgtctattgaattatccgcagacggacctatacgtccgccttatgaagcatatgttcaaggtggtttaacttatgaacatgtcaaattagctgttacacgtgcggtgcaacatatgcaagaaaacaatttactataa

SEQ ID NO: 460 - DNA, 972 bp, S.epidermidis
acacaattgcagatttactttcattacttatcgatcctaaacaacgttatgctattactcagaaagaaacatcaaagtttaaatggtttaattcacatagaaaagaaggtcgtaacgatgaagtttaagttgtcaaagaaaaacactatatttttcatttttacggtctatattatatgtcttattgtattgcaatttataatcaatgatgaagctgcgtatcaggtacatttgtcaaactcatttgaacctatgagtatgaatcatttacttggcacagatgattacggacgtgatttattcagtcgtttagtcgtgggctctcgtgcaacattgtttgttacactacttactttacttttcactgtagtggttggagtacctttagggttacttgcaggctataaaaaaggttggattgatacgattatcatgcgaattattgatataggattaagcataccagaattcgttattatgattgccttagcaagtttttttcatcctagtctttggaatttagtaatagctattacaatcataaaatggatgaattatactcgcgtgacaagagggattgtcaataccgaaatgaatcaatcgtatatacagatggcacaattttttaatgtctcaactttgaatatcttatttaaacacttattaccaaaagttttaccatctatatttgttattatgatagttgattttggaaaaatcattttatacattagttcattatcatttttaggtttaggtgcacaaccaccatctccagagtggggggcaatgttacaagcagggcgtgaatttattacttcacatcctatcatgattatcgctccagcatctttgatatcaggtacaatattgatatttaatttaactggtgatgctgtaagagatcgtttattagaacaaagaggtgtaaaagttgaaacttttaacaataaaaaatctaaacatcaatga

SEQ ID NO: 461 - DNA, 1596 bp, S.epidermidis
tatacaaagcaaaccctagataaaggaggtgtttatgtgaatttattaagcctcctactcattttgctggggattattctaggcgttgttgtagggtatattgttgcccgaaatttattacaccaaaaacaagttcaagcaagacaaactgccgatgatattgttagctatgctaataaagaagcagacaatattaaaaaagaaaaattacttgaggcaaaagaagagaaccaaattttaaaagaacaagctgagaatgaactgcgtgaaagacgtggtgaacttcaaagacaagaaacccgacttcttcaaaaagaagaaaatttggatcggaaatctgatcttttagataaaaaagatgagattttggaacaaaaagaatcaaaacttgaagaaagacaacaacaagtagatgcaaaagagagtagtgttcaaacattaataatgaagcatgaactagaattagaacgcatctccggtctcactcaagaagaagctgtgaaagaacagcttcaaagagttgaagaagaactgtcacaagatattgcaatacttgttaaagaaaaagaaaaagaagcgaaagaaaaagttgataagacagctaaagaattacttgctacaactgtacaaagattagcagccgaacatacaactgaatcaactgtttcagtcgtaaatctgcctaacgatgaaatgaaaggtcgtatcataggtagagaaggtagaaatatacgcacattagaaacacttactggcatagatttaattattgatgacacaccagaagcagttattttatcaggttttgacccaattagacgtgaaattgctagaactgcactagttaatttggtttctgatggacgtattcatcctggacgtattgaagatatggtcgaaaaagctagaaaggaagtagacgatatcattagagatgctggagaacaagctacctttgaaataaatgtacacaatatgcatcctgatttagtgaaaattttgggtcgattaaattatcgaactagttatggtcagaatgtacttaaacattcaattgaagttgcccacctttcaggtatgcttgcagcagaattaggagaggatgttactttagctaaacgtgctggattattacatgatgttggtaaagccattgatcatgaagttgaaggtagtcacgtagaaataggtgttgaattagctaagaaatataatgaaaataacataattattaatgctattcactcacatcatggtgatgttgaaccaacctctatcatttctattttagttgcagcagctgatgcattatcagcagcgcgaccaggtgcacgtaaagagacacttgaaaattatattagaagacttgagagactcgaaacgttatctgaaagttatgatggggtagaaaaagcatttgctatacaagctggtagagagattcgtgtagtcgtctcacctgaagaaattgatgatttaaaatcatatagattggcaagagatattaagaaccaaattgaagaagagttacaatatcctggacatatcaaagtgacagttgttcgagagactagagcaatagaatatgctaaataa

SEQ ID NO: 462 - DNA, 801 bp, S.epidermidis
gaggaatttaaaatggcagtaatttctatgaaacaattacttgaagccggtgttcacttcggtcaccaaacacgccgttggaacccaaaaatgaaaaaatatatcttcactgaaagaaatggtatttatatcattgatttacaaaaaacagtgaaaaaagttgaagaagcatacaactttgtaaaacaaatctctgaagaaggcggaaaagtcttatttgtaggtacaaaaaaacaagcgcaagaatcagttaaagctgaggcagagcgtgctggtcaattctacgttaaccaaagatggttaggtgggattttaactaactacaaaacaatctcaaaacgaattaaacgtatttctgaaattgaaaaaatggaagaagacggattatttgaagtattacctaaaaaagaagttgttgaacttaaaaaagaatacgaccgtttaattaagttcttaggcggtattcgcgatatgaaatcaatgcctcaagcattattcgttgttgatcctcgtaaagagcgcaacgctattgctgaagctcgcaaactaaatattcctatcgtaggtattgttgacactaactgtgatcctgatgaaattgattacgttatcccagcaaacgatgatgctattcgtgccgttaaattattaactggtaaaatggcagacgctatcttagaaggtcaacaaggtgtatctaatgaagaagtagctgcagaacaaaacatcaatttagatgacaaagaagaatctgaacaagcagaaacaactgaagaaaacacttctgttgaatcaaactaa

SEQ ID NO: 463 - DNA, 417 bp, S.epidermidis
ttaatcattaaatctgatatttcacatttatttgtgagtaaagtaaaaataaagagaggtgagatgatgaataatataagagcagaacgtgtaggagaacaaatgaaacaggaaatcatggacattgttaataataaagttaaagaccctagagttggttttttaacaattactgatgttgaactaaccaatgacctttcacaagcaaaggtatatttaacagtgttagggaatgataaagaagttgataatacgtttaaagctttgcataaagcaactgggtttataaaatctgaacttggttctcgaatgcgcctaagaattatacctgagttaacattcgaatatgatgaatctatcgaatacggtaataagatagaacgcatgattcaagagttacacaaaaatgataaataa

SEQ ID NO: 464 - DNA, 1266 bp, S.epidermidis
atggtagttaattataatgataatggcgaactgacaatgggaggtacaagcttaaaaactattgcacaaagttttggtacaccttcgattgtttacgatgaagaccaaattcgtaatcagataagaagatatcataaagcatttgaagcaagtggtttaagctacaatatatcttatgcctcaaaagctttcacttgtattcagatggttaaattaattgatgaagaaaatttacaattagatgttgtttctgaaggtgaactttatactgctcttgaagcaggatttgattcgaaacgtattcacttccatgggaacaacaagacgaaacgcgagattcaatatgcattagataatcagattggttattttgtagtggatacgctcgaggaaatagagcttattgataaatatgctgatagtaatgtagatgttgtattacgtgtaaatcctggggttgaagcccatacacatgaatttattcaaactggacaggaagatagtaaatttggattatcaatcaaacacggtctagcattaaatgcagttaataaagtaaaagcaacgaaacatttgcaacttaaaggtatacatttccatattggctctcaaatcgaaggcactgagccgatgattaagacagctaaaattgtgcttaattggttagcaagtgaacgaattgaagtgagtttactaaacataggcggtggtttcggaattaaatatgtcgaaggagatgaaagtttccctattgagcaaggaatatctgaaattactgaagctattaaagaaactgcgcaagcattgcagtacaatattcctgaaattgggatagaacctggccgttcaattgttggagaagcaggtatcactttatatgaggttggtacaattaaagatatccctggagttaataaatatgtatcagttgatggcggaatgagtgatcacatacgaactgcactttatggtgcacagtatgaggcgttgttagttaacagaaatgaaaaagctaatgaatctgtaacaattgcaggtaaactctgtgaatctggtgatattatcgtacgagatgccccattaccctcttctgttcatagaggtgattacctagcaatactttctactggtgcgtatcattattcaatggcttcaaattataatcaaatgcaaaaacctccagtatttttcttgaaagatggaaaagcacgtgaagtgattaaacgtcaatcattgagacagttaattattaatgatacgaaataa

SEQ ID NO: 465 - DNA, 255 bp, S.epidermidis
tatgaaactaataaaaatataggagttgtttattcattcatgtctattaatattgatcctgaaaaatttgctgaattagttgtaacttcaaatccagccaaatctgatgacgctgaagatatcgctaaagaaagtttaattttatacattaatgcttatcgtttagcagagaaatatgcaaatatcgctacaaattgctatgatacagctgaaattttaaaagaaataaatgaagttgatttacaattaaaataa

SEQ ID NO: 466 - DNA, 534 bp, S.epidermidis
acaaagactaactacacaaattgtgttaaattagatgtatatcgaaagggtgataaaatggaaagtatttatgattttgttgtacaaaaaaacaatggtgaaagttataaattagagcagtataagggtgacgttatgcttattgtcaacactgctagcgaatgtggttttacacctcaattcgaaggtttacagaagttatatgatgagtataaggatcaaggatttattattttaggatttccatgtaaccaatttggcggtcaagaaccaggatcgggagaagaagctgctcaaaattgcaaaattaactatggtgtgactttccctattcatgaaaaagttgatgttaaaggtgataatcaacatccattatttcactttttaacaaacgctgctaaaggtatgataaacgaaaaaatcaaatggaatttcactaaattcctaatcgaccgtgaaggtaatgtgattaaacgtttctcccctcaaaagaaaccggaacaaattaagactgaaattgaaaaattactataa

SEQ ID NO: 467 - DNA, 144 bp, S.epidermidis
ataacctataatggtatatgtatttcttacagttctcatgttacatatcttttattaaatcaaaatagagttattgtaaattttttgttaagaatgggatttgaattaatgaaacgtgtattaaaatttaatttgctaacatag

SEQ ID NO: 468 - DNA, 258 bp, S.epidermidis
gctaaaaataagacaacgagtaataccatcattgaggtacgtgttaacaacgatttatatttaataaatataaataacactatgattaaaatcaatgcaacaaacatccactttactgatctttccgacagtgcgataaatatgaaaccgtatatgaatactggtatagcaacaaaggtgtattctttaattgatatttcacttaaatgttgtatgaacaatgcaattaatacacttgttgataatgctaaaaagtaa

SEQ ID NO: 469 - DNA, 987 bp, S.epidermidis
aggagaaataatattatgaaagtgatagaagttacacatcccatacaaagtaatcaattcataactgaaaatgttgctatggcttttggtttcttcgatggtatgcatagaggtcacgacaaggtgtttcaagtgcttgatgaaaaagcaaaagagcatcaacttaaaaaggctgttatgacgtttgatccacacccctcagtcgtattaaaccctgagcgtaaacgtacaacctatcttacaccactttcagataagttagaaatgatagcagaacacggtatagactattgtatcgttatcaatttttcatcaagatttgctaatgtgacatctgacgatttcataaaaaattatattattaataatcatgttaaagaagtgattgcagggtttgatttcacctttggtaaatttggaaaaggaaatatgacggtacttcaggaatcaaaagcttttaatacgactattgtaggaaaacaagagatggattctgaaaaaatttctacaactgcaatacgccaagcgcttacagatggtcatttacagaaagcaaatgacgaattagggtatatatataggattaaaggaactgtagtacaaggtgaaaaacgtggaagaacaattggttttccaacagctaatgtgcaacccagtgatgattatgtactaccaaaaaaaggtgtttacgcagtgagtatggaaattggtccagagagtaaattacatcgtggtgtagctaacgttggagttaaaccaacattccacgatccaactagggctgagttagttattgaagtgaatatatttgattttaatgaaaatatttacggtgaacgtgtgactgtgtattggcatcactttttaagaccagaagttaaatttgatggtatcgatccattagttaaacaaatgaatgaagataaagcgcaggctaaacatttattatctattgatttcgatgatgatatatcatataatatataa

SEQ ID NO: 470 - DNA, 546 bp, S.epidermidis
tttatggataattctttacacgctacaacaatttatgctgtacgccataatggtgaagcagctatggctggtgatggtcaagtcacattaggtcaacaagttattatgaaacaaactgctagaaaagtaagacgtttatacgaaggaaaagtattggctggttttgcaggtagtgttgctgacgccttcacacttttcgaaaaatttgagacaaagcttcagcaatttagtggtaatttagagcgcgcagctgttgaactagcacaagaatggcgtggagataaacaattacgacaattagaggcgatgcttatcgtaatgaataaagatgccatacttattgttagtggtacaggtgaggttattgcacctgatgatgatttaattgccattgggtcaggtggtaactatgcacttagcgcaggtcgagcactaaaaagacatgcagcacaactttctgctagtgaaatggcatacgaaagtttaaaagttgcagctgatatttgtgtgtttacaaatgacaatataattgtagaaacgctataa

SEQ ID NO: 471 - DNA, 1167 bp, S.epidermidis
gggatggataattttatgaacgagttagaattcgttacattgcacagaagacatttacatcagtatccagaattaagtttacatgaatttgaaacgacatcgtatataacatcatttttagaggatttaggcgtaccttacgaccgaccacttaaaactggtgttattgcttatttggaaggtaatagtcaccacactattgcattcagagcagatatagacgcgttaccaatttatgaagaaaatgatattgattttaaaagtaagaatgataatgtcatgcacgcgtgtggtcatgatggtcatacgacagcacttatgctttttgttaaaaggtgtaaagcattgtatgacaaatctgaattacctcataatgtagtgtttatatttcaacctgccgaagaaaccggtggaggagctaatcgtttaatcaaagctggcgcttttgacaagtaccctattgaagcggtgtttggttttcacgttaatccgtttgaaaaagaaggtaaaattgtaattcgagatgaagaaatcactgcaagtgccactgaatatcgcttctttttaaaaggattatctagtcatgttgctgataaggagcaaggtcattcatgtggtgaggggttacagcatgtcttaagtcaaatcggccaaatccaacaatttcatttgaatggattgaaacgtaacattattcatatgggtcattttgaagctggtgaagctattaatacagtaccgagtcatggttatcttgaaggtacaattcgtacatatgacacagaagatttagctattgtaaaacaccaaatgcataaaattgcgaaaagtgttcaattattatttaatgttgaatgtgaggttaaatttgaagaaggatatccaccaacaatgaatcatccacaattacgtcaagccgttgagaacgctataaaaggtgcaaatttagaaatagttgaaaaaaaactacccttcctgttcggtgaagattttagtttttatggtcaacaacttgccccttcatattttgtatttgttggtacacaaaacaatgaaaaaggttttgtgactggtcttcatactgcccatcttaattttgatgagaaaatattaattgacgttgtaaattattacgagcatttgttaagaaattataaagaggtgtaa

SEQ ID NO: 472 - DNA, 1287 bp, S.epidermidis
tgtttttgtaagggaggatcagttatgtatgattacaatttattagaagatagggatgtactctgcatagaccaaaaaagcttttttgcgagtgtatcatgtatggaaaaaggattggacccattaacaactaaactagcagttgtagcagatacgaaaaggcaaggttcggtcgttctagcagcaactccaaagttaaaagaattaggtattaaaacgggatcaagactttttgagataccacatcgtaatgacatttatattattaatccaagtatgagaaagtatttaaatgtatctgttgcaatttcaaagattgcactgcggtacgttccacctgaagatttacatcagtatagtattgatgaatttttcatggatgtaacggatagttaccatagatttaattcaacagtttttgctttttgtaaaagatttcaaaatgaaatattagaagaaacaggtattcactgtaccattggaataggctcgaatatgctattgagcaaggttgcaatggatattgaagctaagcattcggaaaacggtatagctgaatggcgttatcaagatgtacctgaaaaattatggccaattcaaccacttagagatttttgggggattaataagcgtacagaaaagaaattgaataaaagaggaatatttacaataggagatttagcaaagtatccatatcattatttaaaaagagattttggagttttaggtatagatatgcatctacatgcaaacggtattgatcaaagtaaagtaagagaaaaatataaagtaacaaatccttcaatatgtaaaagtcagattctaatgcgagattatcaatttgaagaatccaaagttgtcatgcaagaattgatagaagatgtagcaagtcgtttaagagcagaaaagaagcttgctcgaacaattcatttttctttcggttatgctgaaggtggtggcatacataagcaatatactttggaggatcctacaaatttagaaagagatatattcaaagtcattaattattttgcaaatcgtctgtgtgacaaaaaagcattgtatagaacgttaagtgtatcgttaactcagtttattaaagaaagcgatcgacaactcaacttattcattgatgaatatgaacgtaagaaagatgtaaaacttgctaaaaccattgatcacttacatttaaaatatggaaaaggaattgtgtcaaaagcgacttcatacaccgaagctggtacaaagcatggtcgattaggactaatggctggtcataaaatgtag

SEQ ID NO: 473 - DNA, 1002 bp, S.epidermidis
ttctattgtaaggggttaaaaaagatgaaaatttttgattatgaagatatacaattaattcccaataaatgtattgttgaaagcagatctgagtgtaatacttcggttaaatttgggcctcgtacttttaaattgccagttgttccagcaaatatgcaaacagtcatgaatgaagaacttgcacaatggtttgcagaaaacgattatttttatatcatgcatagatttaatgaagaaaatagaattccatttataaaaaaaatgcatcatgcagggttatttgcttctatttctgttggagttaaagaaaacgaatttaattttattgaaaaattagcttcttcatcgctcataccagaatatataacaattgatattgctcatggtcactcaaattcagttataaatatgattaagcatataaaaaaacatttaccaaatagttttgtgatagctggtaatgttgggacgcctgaaggagtaagagaacttgagaatgccggtgcagatgctacaaaagtaggtattggtccaggaagagtatgtattactaaaattaaaactggatttggtacaggaggttggcaactttctgcgttaaatctttgtaataaggcagctagaaaacctattattgcagatggagggttaagaacccacggtgatatagccaaatcaattcgttttggtgccactatggtaatgattggctctttatttgctgcccacgaggaatcaccgggtgaaaccgtcgagctagatggcaaaaaatataaagaatattttggtagtgcctcagaatatcaaaaaggtgaacataagaacgttgaaggtaaaaaaatgtttgtagaacacaaaggatctcttaaagatacccttactgaaatggaacaagatttacagagttcaatttcatatgcaggaggaaaggacttgaagtcattaagaacagttgattacgtcatagtaagaaattcaatctttaatggtgatagagattag

SEQ ID NO: 474 - DNA, 456 bp, S.epidermidis
agagtaggtaatattatgtttaaatttaacttcttttatatttcaaagattcgtgcaacttggatgctttacctcattgggatttatcctctcttgatattcctagctgaattacttaatagtaattttctttcattatcagcaactcataagaatagtgtaagctttttagaattatttatcgcaatatatgatactcaacaaaaagtaatgctatcacttataattattggatatttatcttctttattattttatagcgaaattagcacaggaagactattgttttataaggatcaaagtcgctacaaaatttttaattctaaattaacatctattatttctagttactttatattcttattcattttattattatcaacgttagtagtttatgtgttttatgttaacaaccatgaatattcatctcattcttttatgttaaataactcataa

SEQ ID NO: 475 - DNA, 516 bp, S.epidermidis
atgaatatcaatactgcatactttgctggtggctgtttttggtgtatgactaaaccttttgatacattcgatggtatcgaaaaagtcacgtcgggatatatgggaggaaacttagttaatccttcttatgaagaagtaaaaactggatctactgggcattatgaagtggttaaaattgagtatgatgttgctctattttcatatcataaattattagaaattttcttttcagttatcgatcctttggatgatggtggtcaatttcaagatagaggttctcaatataagactgctattttctattcaaatgaacatcaaagacagttagcagaacaatatatatgtgaactccaagatagttttaacgctgataaagcaattgcaacaaaaattttaccggcatcaactttttatgaagcggaagcataccatcaagatttctacaaaaagaaccctgaacgttatgaacaagaacaacaagatcgtgctagttatgtcaaaaataatcatatgtaa

SEQ ID NO: 476 - DNA, 378 bp, S.epidermidis
ataataaccaaggtggaggcccacattattatcctaataatcaaggtatatatgagtcacagcctgaacacaagaaacccaccattcccgacagatggtgatggttatgaatataattatcgccaggatgatgacaattactttgaacagccaggtaaattattcagattacagtctgaagatgcaaaagagcgtatcttcacaaatacagctaatgcaatggatggggtttctaaagatgtcaaagttcgccacattcgccattgctataaagctgatccagaatatgggaaaggtgtagcaaaagctttaggtattgatatcaatcaaatagatttagagacaaatcaagacgaaacatatgaaaactttaaataa

SEQ ID NO: 477 - DNA, 129 bp, S.epidermidis
aaaagatacaagaagagaaacacaataaataaaacaatagagctcgacccatcattgatatataagttgaaaattttcgtagtcattgatgatttacttagaaataatttatttttaattaacttttag

SEQ ID NO: 478 - DNA, 405 bp, S.epidermidis
attaataacaagttcaaaagtagaggagaggttcaagtaatgtctaatgattcaatcagacgaaacatggccgttttctctatgagtgtggttagtaaattgacagatttatcaccaagacaaattcgttactatgaaacacatgaacttgtgatgcctgaaagaacagatggaaataagagattattttctatgaacgatttagagaggttgttagaaataaagtctcttatcgaaaagggatttaatattagaggtattaaacaaattatattcgatgagcaagggcatttaactactgatgaacaagagacaagaaagagaatgattgttgacgcaacgcagaaaccacgtagtgaaacattaccaataaatcgtggcgatttatctcgatttattaaatga

SEQ ID NO: 479 - DNA, 930 bp, S.epidermidis
aggtgtgacaacatgtataatggcatactaccggtatttaagaaacgaggtttaacaagtcacgacgtcgtttttaaattacgtaaaattttaaaaatgaaaaaaattggtcatacaggaacattagatcctgaagttaatggtgtgttaccaatttgtttaggcgatgcgacaaaagtcagtgattatatcatggaaatgggaaaaacttatcacgctatgataacgctaggaaagagtacgactactgaagaccaaactggagatattttagaaactagggctgttgataagaatgatattaatgaagatacgattgaccaagtgttgcagcaatttgaggggcatattcaacaaattccgcctatgtattcttctgttaaagtaaatggaagaaaattatatgaatatgcgagaaataatgaaactgtcgaacgccctaaacgacaagtttttattaaagatatacatagaatatctgaagttactttccaggagcagacatgtcattttgaagttgaagtaacatgtggtaaaggaacttatattagaactttagctacagatattggacttaaacttggttttccagctcatatgtcacgtctaactagaattgcttctggcggttttcaattagaaagtagtttaacgattgatcaaattaaagaattacatgagcatgattcattacataatgaattgtttcctatagaatatggcttaaaaggtctgaaatcattccaagtgaaagattcaaattttaaaaagaaaatctgtaacggtcaaaaatttcataaaaaagtgttaagtcaaaatgttaaagaaccttttatatttgtcgatagtagcactcaaaaagttttagcaatatatatagttcatccagataaaccttatgaaataaaacctaaaaaagtttttaattaa

SEQ ID NO: 480 - DNA, 450 bp, S.epidermidis
gtttctcgcaagaaagtgcaccaatttactgaaaattatgatacattattaatagggattgacatgtcccgtgacacattatatttaagaataaataaacgtgttgatattatgttgggccacggattatttaatgaagtgcaacatctcgttgaacaaggttttgaagcgagtcaaagtatgcaagccattgggtataaagagcttgtacccgttattaagggaaatataagcatggaaaatgctgtagagaaattaaaacagcattctcgacaatatgctaaaagacagttgacttggtttaaaaataaaatgaatgttcattggttaaataaagaaaggatgtcacttcaaatgatgttagatgagattacaacccaaataaataaaaggagttctaaccatgattgcaaacgaaaacatccaagaccaagcactagagaactttaa

SEQ ID NO: 481 - DNA, 159 bp, S.epidermidis
aatatcttaaattgtaattttacattccaacttattaaattatctattatcaacaatgttgtcatatatatttttaattttaacgttttaatacgattcagtagtcatagcacacatttatatgacaacacttatagcaattatttcatgaataaataa

SEQ ID NO: 482 - DNA, 894 bp, S.epidermidis
tttttattaaacataaaagaggtgaaatcaatgctagaatttagaaatgtgtataaatcttttaagaagaaagaagtattatgtgatgttaattacaaattatctgctggagaaaaggttggtcttataggttctaatgggtctggaaaatcaacattaatgaaacttatagctaaaactcaattaccatctaaaggaaatgtttattttaacaatatagatatacataaatctcacaatatgataaaagatttttctttcatgataggacaaatatattatcctgagttaaatgcaagacaaaatattgaaaattacctaaaaattaataataagattagctatataagtgaaattcaaaagatgctaaacattgtaggtttagaagatattgaaaagaaggttaaaaattattcgtatggaatgaaacaaagactttgtttagctatttgtttaattaccaaacccccagtagctgtattagacgagccattcttaggtttagatccgcttggggtaagggaattaaataatatcactgagaaatattcaaaagaaaaaaacactttatttttaatatctagtcaccagttaaaagaattagaagatctttgtgatagatttctattactcgaaaaccatcaaattagagaaattgacttacataatagaatattcactcaaaagttaatattcaaaaatactttaaacaatgctccagaactaaaggctaatttcaatttcattaaaaaaattgatagcaattcaataacaattataaataaagatgaagaagtagatcttacaaatttacttaatttagtaggtaaaaatcccttaataaaaattgaaagtaatgataatctattatcttcatatttctataaagagtag

SEQ ID NO: 483 - DNA, 318 bp, S.epidermidis
gtattattaaaactaacagaatatttgttaattattatgatagcaataataaaatttaatgcattaagaaagaggtttcaaatgagtaaagaaaatttaaatattgatagaataaatgaattagccagaaaaaagaaagaacatggcttaaccaatgaagaggctaaagaacagactaaattaagaagacagtatttagaagaatttagaaaagggtttaagcaacagatagaaaatactaaggtcattgaccctgaaggaaatgatgtgacacctgaaaagttaaaaaagatacaagaagagaaacacaataaataa

SEQ ID NO: 484 - DNA, 2745 bp, S.epidermidis
cggcatataaatatatataaatatcaagggggatataaaatggcttctaatattaaagaacaagcaaagaaacaattcgaattaaatggccaatcatatacttactatgacttacaaacattagaagaaaaagggctagctaaaatttctaaattaccatactcaattcgcgtattgttagaatctgtgttacgacaagaggatgattttgttataacagatgatcatatcaaagcattaagtaaattcggaaatgcaggtaacgaaggtgaagttccattcaaaccttctagagttattttacaagactttacaggtgtgccagcagtagtagatttggcttctttacgtaaagctatgaatgatgttggtggggatattaataaaatcaacccagaagtacctgtggatttagttatcgaccattcagttcaagttgatagttacgctaatccagaagcattagaacgtaatatgaaattagaatttgaacgtaactatgaacgttatcaatttttaaactgggcaacaaaagcttttgataactataatgcagtacctcctgctacaggtattgtccatcaagtaaacttagagtatttagcaaatgtagtacatgtaagagatgttgatggtgaaaaaacagcatttcctgacactttagtaggtactgattcacatactacaatgattaatggtattggtgttctaggttggggcgttggtggtatcgaagccgaagcaggtatgttaggacaaccatcatatttcccaattcctgaagttatcggagtgcgtttaactcactctttaccacaaggctcaacagctacggatttagctttacgtgtgactgaagaattacgtaaaaaaggtgtagttggaaaatttgttgaattcttcggtccaggtgttcaacatttaccattagcagacagagctacaattgctaacatggctccagaatatggtgcaacgtgtggtttcttcccagtagatgaagaatcattgaaatatatgaaacttacaggccgtgacgaagaacatattgaattggttaaagaatatttacaacaaaaccatatgttctttgatgtagaaaaagaggatcctgaatatacagatgttattgatttagacttatctacagtagaggcatcactttctggtccaaagcgtccacaagacttaattttcttaagtgatatgaaaaaagaatttgaaaaatcagtaactgctcctgctggtaatcaaggacatggacttgatcaaagtgaatttgataaaaaagcagaaattaattttaatgatggatctaaagcaacaatgaaaacaggagatatagcaattgctgctattacctcatgtactaacacttctaatccatatgttatgttaggtgctggtttagttgctaaaaaagctgtagaaaaaggattgaaagtaccagagtttgttaagacgtcacttgctccaggttcaaaagttgttacaggatatttaagagattctggattacaacagtatttagatgatttaggtttcaatcttgttggttatggttgtactacatgtattggtaactcagggccactattaattgaaattgaaaaggcagttgcggatgaagatttattagtaacttcagttttatcaggtaatcgtaattttgaggggcgaatccatccattagtgaaagcaaactatttagcctcaccacaacttgttgtagcttatgcgcttgctggtacagtagatattgatttacaaaatgaaccaattggtaaaggtaaagatggtaaagatgtatatttacaagacatttggccttcaatacaagaagtttctgatactgtagataaagttgttacacctgaactattcttagaagaatataaaaatgtatatcataacaatgaaatgtggaatgaaatagatgtaaccgatgaaccattatatgatttcgatcctaattcaacatatattcaaaatccaacatttttccaaggattatctaaagagccgggtaaaattgaaccacttaaaagtttgagagttatgggtaaatttggtgattctgttacaacagaccatatttctccagcaggtgctatcggtaaagatacaccagcaggaaaatacttattagatcatgatgttgcaattcgcaactttaactcttatggttcccgtcgcggtaaccacgaagttatggtacgtggtacatttgccaatattcgtatcaaaaaccaacttgctccaggtactgaaggcggatttacaacatattggcctaccggagaaataatgcctatatatgatgcagcaatgaaatataaagaagatggaactggcttagttgtcttagctggtaatgactatggaatgggatcttctcgtgactgggctgcaaaaggtaccaatttattaggagttaaaactgtcattgcacaaagctatgaacgtattcatcgctctaacttagttatgatgggtgtactaccgcttcaattccaacaaggagaatctgcagaagcactgggtcttgatggaaaagaagaaatatctgtagatattaatgaagatgtacagccacatgatcttgtaaatgtgactgcaaaaaaagaaaatggtgaaatcattaatttcaaagctattgtacgttttgattcactagtagaattagattattatcgtcatggtggtattttacaaatggtactaagaaataaacttgcgcagtaa

SEQ ID NO: 485 - DNA, 177 bp, S.epidermidis
attgcaataaatactggcaatcagtttacaatagcgcttacattttttataattaaagggcaacttaacctaagaaacaggaggatggaagatgaatatccacgagtatcaagggaaagaaatatttcgttcaatgggcgttgcagttccagagggacgagtagcatttactgctga

SEQ ID NO: 486 - DNA, 726 bp, S.epidermidis
cgaggtgtaaaaatgtcggaaatgagtgcaatctatagagtaaaacaatacattttaaatttaatcaaagatggtgaactaaccaatggaagtaaattacctagtaatttgtcaattgcgagagcattaaatgttaaaacagatgatgtttatgatggtatagatgagttgattactgaacaagtagtaacggataattttgaagaggggactagcgtaaaagtaaagccccctttctattacccgttaaataaaattattagtatagggactatgattaaagaagcgggttatgaagcaggaacagaatatctgaatcttgacgagcaacctgcaactattttagatgctgaacatttaggtatagaaacaaaagaacctataacaattattgagagactaaggactgctaatcataagcctgtcgtatattgtttagacaaaatagcaaaaacttatctaacttgtacagattatcaacagagtagtggttcaatgttagaagctattaaagcatctacaaatcatcaaatcatgcatgcagaaatggatttagaagcaattagttacgaaccccatatctctgaagtgcttaatgcttcacctcacgaagggcttatgttacttaaagtagtacattatgacgaaaagcatcaaccaattttgtattctttaaattatattaagagtagtttagttaaattcactattactaaaagtgaataa

SEQ ID NO: 487 - DNA, 1089 bp, S.epidermidis
agaggtgtaaagcaattgacagcaatttggtcattagacacagaagcattttatcagaatgcagtaaaagtaaaaaataacgaaccaataatggcagttgtaaaaaacaatgcatatcattatggacttgagtttgcagtgaaaacatttttaaaagcggaaattaatacatttagcacaacttcattaaatgaagctatacgagttagaaaaatagcacctgaagcaactatatttttaatgaatcctgtttatgattttgatttagtaaaacgttatgatattcatatgacactcccctctttaaactattattataaatataaacaagatttaaaaggcattcatgtacatttagaatatgaaaatttattacatcgttccggttttagaaatatcgaagaaatacgtgaagttttaaaagatcatgatcaaaataatcaagataaaatgattatttcaggaatatggacgcattttgggtatgcagacgaatttgacgtagatgaatataaaatggaacgtgatgcttggttaaacttgataaatacacttttaaatgaaaattatcattttgatatgatacattcacaaaatagtgcaagttattttcgtgagaatcaaatgttacttcctcatcacactcatgctagagttggaattgccctttatggttcaagaccatatagtcttataaatgaagaacgcattactcaatctttgactgttaaaggtaatgttatacaagttcgtgatgtaaataaaggtgattattgtggatatagtttcgcctttgaagtaaagaatgaccacactcaattagctgttgttgatataggttatggcgatggtattctaaaatcaagagcaaaacacgaagctataattaatggcaagcgatatccaattagagcactaatgatgagtcatatgtttattgaagttgatgacgaagttcatgcacaagacgaagtcatattatataataaggatatacgtatagatgaatttacatttaaaggtgttggcgcaaattcagaacaattaagcgcaatgaatcacgattctcttatgaaggagtatttataa

SEQ ID NO: 488 - DNA, 144 bp, S.epidermidis
agtttggtaaatatgaaagtgaatctaaataatctaagttgttcttgcctctttcatcttattaaaaatacatataagtatatattcaaatgggatgaatactctaaatatagtaatgatgagagattaaaaaagaaggtgtag

SEQ ID NO: 489 - DNA, 1095 bp, S.epidermidis
ttgagagcaaatcaacacttttcatcgaataaattaataaatatcgatttaacattggagggaacgcttgtgatttcatttgaaaatgattatttagaaggtgcacatgaaaaagttttaaatcgattagtagagacaaatcgaatacaagctgctggatatggcttcgatgacttttcggcacaagctgcagataaaattagacaacgtattgactgtccagatgctaccattcgttttttagtaggtggtacgcaaaccaatcaagtagttattaactcaatgcttgatagttatgaaggtgttatatccgctgatacaggacatgtggcagtccatgaaggtggtgcgatagaattcagtggacataaagttctaaccataccctcccaagaaggtaagattactgctcaagacgttgagaattatatagaaacttttgaaagtgattttaaaaaagaacacatggtgtatccagggatggtttatatttcacatccaaccgaatatggaactttatacacgaaagaagaattacaatctttatctagagtttgccgtagacatcagattccactatttatggatggtgcacgtttaggctatggccttatgagcaatcaaactaatgtaactatcgaagatgttgcaaaatactgtgatgtgttttacataggaggtactaagattggagcactttgtggtgaagcaattgtcttcactaaacaaaatgaacctaaaaacttcactacaattataaaacatcatggtgctttattagcaaaaggccgtctaactggtgttcaatttttagaattattcactgatgatttatattttgatataagtcgacatgctattaaaatggctgaaaaggtaaaaaaaggatttatagataaaggatatcaagtctattttgattcaccaaccaatcaacaattttttattttaagcaacgataaaattgaagaactaaaacaaaaggtaaaattcgcagtttgggagaaatacgataatcaacatcgtgtagttcgcttcgcaacaagttgggccacaactgaagaaaatgttaatcaactacttgaactaatataa

SEQ ID NO: 490 - DNA, 129 bp, S.epidermidis
gctaataaaaaggaaacgtgtgaggtgtcttcttccttgttaaactttatgacagattatttcatttgtcctttaacttcttcagcaaagttttcttcacgtttttccataccttctccaacttcataa

SEQ ID NO: 491 - DNA, 957 bp, S.epidermidis
caaataaaaaaaggaataggggcagatgttgtgagtcaaagtcattttaaaataacagttgaagatggaacaatgttagaggtgaaaattgataaagcaaaaaagagtactattggtattgttcatcttttccatggcatggctgaacatatggaccgttatcaagagttagttgaggctttaaatacacaaggttatgacgttgttagacataatcaccgtggacatggtaaagaaatagatgagaatgaacgtggtcattttaatagcatgaatcaaattgtagatgatgcttatgaaattattgagacattatatcttgaagagctcaatgtaccctatattatcataggtcattcaatgggctccattattgctagatcatttgttgaaaagtatcctgacattgctcaaggtttaattcttacaggaacaggtatgttccccaagtggaaaggtgtaccaatacgtttagcaatgaagttagttacatttatttttgggaaacgacgtcgactcaagtgggtgaatcaattattgaataaaactttcaataaaaaaatcactcaacctcgaacagatagtgattggatttctacacgtcaggatgaagttgataaatttgtggaagatgaattttgtggattcaaagtatctaatcagctcatttatcaaactttaaagaccatgatgaagacagtagaacgacaacaactaaaaagaatggacaaagaactacctatactatttatttctgggaaagatgatccttttggtgaatatggtaaaggtataaagcatttagctagattatataaaagagcaggtattaaacatataacagtacaactatataaacataagcgtcatgaaatattatttgaagaagattatttgaaaacatggcaacacatgtttgaatggatggaaaagcaaattttgaaaaaacaaaagtga

SEQ ID NO: 492 - DNA, 396 bp, S.epidermidis
aaagaaaaaaatacaagaaaaagcaaaaaagaaattcctgatgtgatacgtagtggtaaaataaaattagatataaatcctgaaaaacaaaatagacattccttaaatcatagtttatatttgaaaaataaaaattttgcattaaaaaataatgaaagattaccaagttatactacgttatctatcaatgaattaaatagattagtacaacagtactcaacttctggtaaaatcttaataaataaaaacggttttaaccataaaaaagtaataaattttgagaggattataggaaaagcatttatagatggaaaatatattgagactacatttggtaaagtgcattattcaaaaacagactctcatataataccttttataagtaaggagaaataa

SEQ ID NO: 493 - DNA, 870 bp, S.epidermidis
ggaggaaaaaacgtgtcaagtaatgaattattattagctactgaatatttagaaaaggaaaagaaaattcctagagaagttttaattgatgcaattgaagcagctttaattactgcgtacaagaaaaactatgatagtgccagaaatgtaagagtagaattaaatatggacgaaggttcatttagagtgattgcacgtaaagaagtcgtagaagaagtgtttgatgacagagatgaagttgatttaagtactgctttagtcaaaaatcctgcctatgaagtaggagatatttatgaacaagatgtaacaccgaaagacttcggacgtgtaggagctcaagcagctaagcaagctgtgatgcaacgacttagagacgcagaaagagaaattttatatgatgaatttatcgataaagaagaagatattctaacaggtgtgattgaccgtgtagaccatcgctatgtatatgtgaatttaggaagaattgaagctgtgctgtcagaagctgaaagaagtcctaatgagaaatatattcctaatgaacgtatcaaggtgtacgtaaataaagttgaacagactacaaaaggtccacaaatttacgtatcaagaagtcatcctggattactaaaacgcttattcgaacaagaagttccagaaatttatgatggtactgttattgttaaatcagtagcgcgtgaagctggagatcgttctaaaattagcgtgtattctgataatcctgatatagatgctgttggcgcatgtgtaggttctaaaggagcacgagtagaagcggttgttgaagaacttggtggcgaaaaaatcgatatcgtccaatgggatgaagatcccgaaagtatttgttcgtaa

SEQ ID NO: 494 - DNA, 153 bp, S.epidermidis
gcaatgaaaaaggagtgtatacacatgccaataatttattatgatggaaattgtgtttattgttataactatgcaatttggttaattcaaaacggactttcacataaatatgagtttgcaacaattaaaggtcaaataggtaaacaatttttt

SEQ ID NO: 495 - DNA, 135 bp, S.epidermidis
aattggaaaaagagattcgcaaatatgatgatgaagagtcacttcgtcgtcataaataacaacttttcaactttgctaccatcttatcttaagcaaagttgttttttatttcttttttatctcttttcctattaa

SEQ ID NO: 496 - DNA, 138 bp, S.epidermidis
ataagtcgaaatctgacttctattgaggtgatgcattatgaatgcactttgattacaactttttattcttcactattcacttcagttgcttcagacgattcattatctacagtgaaagtgctgatcgcatgtttgtaa

SEQ ID NO: 497 - DNA, 126 bp, S.epidermidis
attatacgaaagggctttatttttataaagtattttggcgagactcttgagggaacaggacaagctgaagactacaggctgaagctgtcccctaagaaagcgagccaacaatacgaagtattgtaa

SEQ ID NO: 498 - DNA, 129 bp, S.epidermidis
gcaattagaaatttgagttacatccatttaattttaggttcttctcctttaaaaattctaactatattagatttgtgtcgaattattaatatgattgaaacaattccgctaacagcaagtaaaatataa

SEQ ID NO: 499 - DNA, 2601 bp, S.epidermidis
atgagaagaaaagcatgtttcattatattattaattacattatcattaattggtcatagttatattatttttcgcttccatcatgatggtgttctttcaactggcccaaatgatggtatggaacagatgattcctattcaaatgtatctttatcatcaatggactcaagggaacttattttattcaacacatttgggtcttggcggagattttttcactgacttaagttattatttttcaacaaatttaatatttattttaaatgtccctatcatcaaattatgtgaaatattcttttcattgaacacaaatcaaattcttctttggatgtacaacgcactaattgtttcaattattaaatcaactattgctctgttttgcacttatttatttagttattatatttctaaaaataaaataatcagtttattgatttcatttatctttgttatgtcacctttgtactttagatttacaatttactggccattctttagtgatactttcatttggttaccactcttattattagggattgaacgtttattaagggattttaaagcaggtttatttatactaactgtaagtctaattctaattaataacttttattttgcatattatttcctcattattggtataggttataccctgattagaattatttacagacatcctaaagatagtttaactcgttggcaagcttctcttacaattatatgtagtgctctgctcgctttaggaaatagtatgtttgtgttctttcatggtgttcaaagttttcttaataatcgtcgacaatcatttacaggacaagtgaattggattgaacatttaaataaagataccaatatatttttcgataattacttgattgttgtgatatttttatctattcaagctcttttgacaatcaaattatacaaacatttttattataaattatttgcattgttattattggcaacaattatttttgcatttctcccatttgttgaccaactatttaatgggttttcagcacctcaaaaacgatggcattttatcttagcttttaatagttcaattttaattgggttatttgtaaaatattttaaaacaattcgaccaaagacttatatttatactaatctgatagctcaaagtgtcatctacataagttcaattagctacaatacttttttaccttggctctctttagttccagtagtgtcagtgattggactattaattttattaataaaagagaaaaaagtacgttattatcttacttacctttatagtatttcaatcgctgctctcagtcttatgattactttcgtattcataaaaaatcaaattttctttcaagatcatatcaatcgtgcgaacaagcgatacattaattcaagtttctataactcggctatacaaagatcgttagtaaaagaaatgaaccaaactaagaatgacgatcaacgaataaattggcgtgtcgatgaacaagataatacccctatgtatcaaaattttaaaggacttagtatttactctagtatatttcatcacaacattctcgatttctattatgatgccttaaaaattaatttagctgaagaatctgtcagtcgataccagtctactaatgctcggcaaaatatcgagagtctgttttcagtaaaatatttaatgatgaaagattatcaaaattttattccatcttattttaagaaagttaagtcacgtggacaatatattatttataaaaatcaacttccactaccaagtgtaaaagtaacacaaaacatttataatcataaaagtttaaaaaaacctatagatagagagcatgcaatgattaatggtgctattgtgacatcaaaaggtacagcatatcactcaaaagttaaaaatttgttagaccaaacacgtgtatcaacacaaaatataacacgatattcaaacaatgaactaaccgttaataaagagagcggaataatcaaattacatttacctaagaatataagagacaaatacaaagatttttatctcactatgaatattaaacgaggcgatcctgacagtaattacactgtgagcatcaatcaatatcataatcatcgtctatacaatgattctatatatcgcacgggaataagcaaagtgctttatcgaagtttaccagacaaaaatggtgatattacgattcaactatcaccgaaaggtaagttcaatttggaactgttagaattaaacggtgaaaattatgatacgctaaaacaagcacaccatcatgctaactttaatatgcgttataaagatataaaaaacggggtaaaagttaacttagatcaccattctaaaggacttgcagtcattaatattccatatcgtaaaggtatgcgtgcatacgtggatgaccgacaaagcaatatcaaaaaggtgaattatatgatgacaggtgtcccagttaataaaaatgataaaacaattacgattcaatatcgaccaccttttctaaaaacgatgttttctatctcaatatttagtatagtggtgagtattgtattcattagattaaagaatataaggaaaagaaagatgaggattcgccatgattaa

SEQ ID NO: 500 - DNA, 210 bp, S.epidermidis
gtaaggagaaataaaatgttaattaaagatgcttatcgtaaaaatgttattgtcacacttaaaaataatgaaaagtttaaaggttttgtgtttgattatgaaaacccattagaaagtgatactggaaactattccctggatttagagacagatttaggaatatattcaattgatgaatcggaaataaaaagtataaaattaatatcttag

SEQ ID NO: 501 - DNA, 174 bp, S.epidermidis
agcataacccttcttttaaaatatatttctgattatacaacatataaatattttagcaaatactataattatgtaaatttgataatgttgaagacctttgttaatctattaaagtgtattggtaaagttaaaaattttaaaataaaatttaattttttgattttactgccttga

SEQ ID NO: 502 - DNA, 708 bp, S.epidermidis
aatgtactgaagaaatcttgtgatgaggcaaacaaagcacttaaactttataatttgtctatgaaagtatctagagaaaagctattaaagcagcaattagatttgatagtcaaagactccgctttagacattcatgatgaaatagaaaataagttggttgatagagaagttgaaagacaagcacatatacttggtgaacatgtgaaaattgatgacactgaagtaaaagcggttgttaacagtaactttaaaggtgtgaactggtctacaagattatgtcaagatatggctgtagttcaaaaagaagtagaaaaaacaacgagtaatgtattacttagagggagacatcctaatgagtacgtagctaagtttaaaaagcaaacaaataccacaacatataatgcaagtagattgttagttactgaatcagcatgtgtgcaggctgaatcacagaagttaacttatcttaaagatttaggtgaagatggcgaatataaatacgtggccaaaatcgacaagaaaacatctaaaatatgtcactctttaaatggcaaagtatttaaagttaaagatatgatgcctggagttaatgctccacctatgcacccttggtgtagaagtactacagtaacacatgtgggcaattggcgagatagattctttactgagcgtaaaggtaagtatcagacagagaataaagaatcataa

SEQ ID NO: 503 - DNA, 1272 bp, S.epidermidis
ttaattatgaattcttcttcacaagagaagaaaaataaaaagttttcttcggttttcatctatagttcaattattgcagctatagtagtgattatcggtgctgtttggcctgagaaattcgatagcgttactaatacggctaagatgtggattactaataatttgggttggtattaccttattttaacaacagtaattgtattcttctgtgttttcttgattttcagtccaattgggaaacttaaattaggtaaacctaatgacaaaccagaatttaatacaatttcttggttcgcaatgctattcagtgctggtatgggtattggtttagtattctatggtgcagctgaacctatggcacattttgctgctccaccaacagctgatcctgaaacgacaaaggcctacactgagtctttaagatctacatttttccattggggattccatgcttgggcaatttatggcgtggtagctttagcacttgcttattctcaattccgtaaaggtgaacctggattaatttctagaaccttacgtccattattgggagataaagttgaaggaccaataggtactcttattgatgtactttctgtttttgctacattagttggtgtagctgtgtctctaggtatgggcgcacttcaaattaatggtggcttgcattatttatttggtgtgccgaacaacacttttgttcaaggtattattattgttgtcgtaacaattttatttattgctagtgcttggtcaggtttaagcaagggaattcaatatttaagtaatttaaatataggtcttggtacgatattaatgattgtaaccttaattgttggaccaactgttttaatcttaaatatgatgacaagttctacgggtagcttattaaattcattcttatttaacagttttgatactgctgcgttaaacggtcaaaagcgtgattggatgtcaacttggacattatactattggggttggtggctaagttggagtccattcgttggtgtattcatcgcacgtgtatctaaaggacgttctataagagaatttatttcaggtgttttattagtaccggcacttgttagctttatatggttcagtgttttcggcgtattaggcattgaagctggtaaaaaagattcgggtctctttaaaatgtcacctgaaacacagttatttggtgtattcaaccatattccgttaggtattgttttatctatcattgcattattgcttatcgcttctttgctttgttacttcagctga

SEQ ID NO: 504 - DNA, 771 bp, S.epidermidis
ctaataatgaattttatttttgatattgatggtacgatttgttttgatggatgttccatcgattcatctattaagcaacgacttttcaagctacgtcaagctaatcacaatgtaatatttgcttcagcacgtcccattagagacttgcttccagtcattcctgaatttgcggatgataccttgattggtggtaatggctcaattatctctaaaaatggacaaatcgaaattgtttcggtaatcaatgagcatgatatcagtctaattaaaaaaattataaagaaatatcaattatcatacatcattgatgataaatttaattatgcttcaaatttggatagtaataatgaactgtatcaacgcattgatcctgatggtaaagcacaatctctagatatggatgagattcgaaatcctataaaagcaattctattaaatatagataacaaagattttgacatgattgctcatcaattagtaagtcagtctcatggtattgaattaattcgtcattacagtgagtcctatattgatgtaacggcacgtggcgttgataagtatactactattcaatatattttaggaactaatagtgattatatcgcttttggtaatgatcacaatgatgttcatatgcttgaacatgcgagccaaggttattttgtgactaatcaatttatagaacacacatcattttttaaaaataaaaatattacagttattgatgacacaatatatgcaatatgtgaggttttagatcgatatctgtaa

SEQ ID NO: 505 - DNA, 729 bp, S.epidermidis
acaataatgaacatactattaattggatatggtgcaatgaatcaaagagttgcacgattagctgaagataaaggtcatgaaattgttggagttatagatagaacttcaaaagcgtcgacaccttattcacaatatcaacacattagtgaatgtaaagaagctgatgttgctattgacttttcaaatcctgaattgctctttcctctattagaagaacaattcaatttgcctcttgtcatagcaactacaggtgaaaaagaaacgttaatacaaaaattggaaacgctaagtcaaagaacacctgtattttttagtgcaaatatgagttacggtgtccatgcattaactaaaatattagaaactgcagttcccctactacaagatttcgatatcgaactaacagaagcgcatcataataaaaaagtcgatgctcctagtggcacattagttaaattgtatgatgtcattaaagaattacgtgacaatgtctcacctgtttatgatagacacgaaaaaactgagaagagaactcatgatgagataggtatacatgctgttcgtggtggtacgattgtcggggaacatgacatattatttgcaggtactgatgaaacaattactatctcacataaagcacaatcaaaagatatctttgcaaatggtgccattggcgctgcagaaaaattaattcacaaaaacccaggtttttatacttttaataatctataa

SEQ ID NO: 506 - DNA, 126 bp, S.epidermidis
actttcgtgaatttttatgagagccctatcatatgcgtagcgaatagtgatatagtaactttttatgaaaataattttattgaaaataaaataaattttactaaatgttcacatttatttgtttga

SEQ ID NO: 507 - DNA, 1233 bp, S.epidermidis
ggcgtggtgaatttaatgaaaaatgaaaaagaaataaatggaaaaaaaagccatttttttagtttgtcagagtctagatttatgaggtttttaggcggaaatgaccttatttatgctttaattgcattggttcttttaggtattgtcatttttatctttgataaaatttcatatgtctttcaaccatttattattgtatttaatacaatagcagcacctattattgtttcattagtgctattttatttattcaatcctattgtaaatatgatggagagatatcgtattccaagactattaggtataacaattatttatgttgcaattgttggtattattacattaatagttaatttacttattccaattattggatcacagatagaaagttttatcaaaaatacacctaattatttacataaaattacgcgttcacttgataaacttaataataataccattttatctggttacatgggacaagtgaacgaatggttagaatctgctcagaaaaagataccatctatggtttcagattactcagacggatttggatctaaactcgcaacttttgctgaggcagtcgcaaatatcggtattgttattgggactacaccttttgtgttattctttatgttaaaagatggtcataaatttaaagattatactacaaaaattatgccacctaaatttagaaaagattttcatgacttgttagaaaagatgagtgtacaagttggttcatacattcaaggtcaaattattgtgtcattttgtattggattattactatttattggctattcaattattggtcttaagtacgccttagttttagcaagtattgctgcagtaactagtgtggttccttatttaggaccgacaatagcaatatcacctgcgattgttatcgcgattattacttcacctttaatgttattaaagttagctgttgtatggacgcttgtccaattctttgaaggccactttatctctcctaacgttatggggaaaacattgaaaattcatcctttaacaattattttcattttattatgtgcaggaaatttaatgggcattgttggtgtgattattggtattcctctatacgctgtacttaaggtattggtttcacacatatttatgttatttaaacgaagatacaatcgctactatggaaatgatgctggtgagtacattatcactgaagaagaaaaaggaattaaacaataa

SEQ ID NO: 508 - DNA, 273 bp, S.epidermidis
tatatggcgaagaaatctaaaatagcaaaagaacaaaaaagacaagaattagtaaataaatattacgagttacgtaaagaattaaaagcaaaaggggactatgaagcattaagaaagttgccaagagattcatctccaactagattaactagaagatgtaaagtaactggtagacctagaggtgtgttacgtaaatttgaaatgtctagaattgcatttagagaacatgcgcataaaggtcaaattccaggtgtaaaaaaatctagttggtaa

SEQ ID NO: 509 - DNA, 528 bp, S.epidermidis
ctcaggcagaagagtgggcataaacccgctcttttctatttgccaaaaaaggaggcctgtatgagtaaaattactgagcaagttgaagcattgattcaaccagttttaaatgatttgaactttgaattagtagacattgagtatgttaaagaaggtaaagaccattttttaaggatttccattgataaagaaggtggcgtagatcttaatgattgtactatagcttcagaaaaaattagtgaagttatggatgaaaatgatccaatacctgaaatgtattatcttgatgttgcatcgccaggggcagaaagaccaataaaaaaagaaacagatttttataatgctatcaatcaacccatttttgtatctctttatgcaccaattgaaggagataaagaatggttaggtgttttaaaatctgtaaatgatgaatcaattaatatggaagttaaagaaaaggcaaaaacaaaagaaattgaaattccaagaaataaaatagcaaaagcacgtcacgctgtaatgatttaa

SEQ ID NO: 510 - DNA, 912 bp, S.epidermidis
attaaggagaatagaatggcactagataaagatatagtaggttcaatagaatttttagaagtcgtaggattacaagggtcaacatatttacttaaagggccaaatggtgaaagtgtcaaactcaatcagtcagaagttgctgatgaagataattttgaattaggtgaggaatatagttttttcgtttatccaaaccgttcaggagatttatttgcgacgcaaaacatgcctgatattacaaaagataaatatgattttgctaaagttataaaaaccgatagagacggtgcacatattgacgtaggacttcctcgtgaagtcttagttccatgggaagatttaccgaaacttaaagaactttggcctaaagcaggtgattacttgctagttactttgagaatagacagtacgaatcaaatgtttggacgattagctagcgaaacgattgttgagtcaatgttcaccccagtaaatgacgatagcaaacaaaacgaatatatttctgcacgcgcttatagattactcagagtaggtagcttcttattaagtaatgagggttataaaatctttgttcacgaatctgaacgtaaacatgagcctcggttaggtgaggcagtagaggtccgaattataggtcataatgaaaaaggtgaattaaatggttcgtttttaccattagctcatgaacgccttgatgatgatggacaggtcatatttgatttacttgttgagtatgatggtgaattacctttttgggataaatctagtcctgatgcaatcaaagaagtctttaatatgagtaaaggctcgtttaaacgtgcaatcggacatttatataagaaaaagataatcaatatagaaacaggaaaaatcactcttaccaaaaaagggtggagccgtgtagatgattaa

SEQ ID NO: 511 - DNA, 1392 bp, S.epidermidis
aaaggtaggaaaattatgaaagttgctaagtttggtggaagttctgtatcaactgcagaacaaattaaaaaggtattaactatagtgaatgaagaccctgaacgtaaaatcattatcgtttcagctccaggcaaaaggcataatgacgacattaaaactactgatttattaattcgtctctatgaaaaagtacttaataaattaaattatgaaagtaaaaaacaagaaattatccaaagatatgctgatatagtagaagaattaggtataggaaatgacattttaataacaattaatgacactttagaggaatacattaaacatctttctgacaaacctaaccgtttatatgatgctttattatcttgtggcgaaaattttaatgctcaattaatagcccagtataataatagtcaaggtattcctactcgttatatttctcctaaagaagctggattaactgtaactgatttaccacagcaagctcaaattttagattccgcatataatgaaatatacaaattgcgtgattatgatgaaaagctaattattcctggttttttcggagtttcaaagcaaaattatatcgttacgtttccacgcggtggttctgacataactggtgctatcatagcacgtggcgtccgagcctcactttatgagaacttcactgatgtatcaggaatatataaagctaatccgaatatcataaataatcctgaactcatagaggaaataacttatagagaaatgcgagagctatcttatgcaggatttggagtttttcacgatgaagctctacaacctttatacaaagatcgaattcccgtagttatcaaaaatactaatcgtccaaatgataaagggacctacattttacatgaccgtgaaatcgattctaaaaatgtcattagtggaattagttgtgataaaggctttactgtgattaatattaaaaaatatttaatgaatagattagttggatttacacgaaagattcttggcgttttagaagaatttaatatatcatttgaccacatgccttctggtattgataacataagtattatcatgcgtacaaatcaaattcaaggtaaagaaagtcaagttcttaatgccatacgcaaacgttgtgaagttgatgaattaagtatcgaccatgatttagcagtactaatgattgttggtgaaggtatgaatcaagttgttggtacagctagtaaaattactcacgccctttcagaatcaaacattaatttaataatgattaaccaaggtgcttctgaaatttcaatgatgtttggaattcatgaagcagatgctgaaaaagcagtattatctacgtacgaattttgttacaacggtgtttgtttaaaaaatttgtgtaaataa

SEQ ID NO: 512 - DNA, 288 bp, S.epidermidis
ttaaggaggaaattgataatggcaatttcacaacaacgtaaagatgaattaattaaagaatatcgtgtgcacgaaactgatactggttcaccagaagtccaaatcgctgtattaactgcagaaattactgcattaaatgagcatttacgtgaacacaagaaagaccaccattcacgtcgtggtttattgaaaatggtaggtcgtcgtcgtcacttattaaactacttacgtagtaaagatattcaacgttaccgtgaattaattaaatcattaggtattcgtcgttaa

SEQ ID NO: 513 - DNA, 1722 bp, S.epidermidis
atagggaggaaaaagagaatgaaacaatctaaagtatttataccaacgatgagagaagtccctgcagaggcggaagcattaagccatcgtttattattaaaagcagggttaattaaacagagtacaagtggtatatatagttacttaccacttgctacacgtgtactaaataatatatctaaaatcatacgtgaagaaatggaaagtatagatgctgtagaaattcttatgccagctttacaacaagcagaattatgggaagagtcaggacgttggagtgcatatggtccagaactaatgcgtttaaaagacagaaacggacgtgaatttgcattaggacctactcatgaggaagtagtcacttctttagtaagagatgaattaaaatcatataaacagttaccccttactttatttcaaattcaatccaaatatagagatgagaaaagaccacgctttggattattaagaggacgcgaatttcttatgaaagatgcatattccttccattcagatgaagcttcattagatgcaacttatcaagatatgtatcaagcatatagtcgcatattcaaacgtgtaggcatcaatgcaagaccggttgtggcagattcaggtgcaatagggggaagtcatacacacgagtttatggcattgagtgaaattggggaagatacaatagtttatagtaatgagagtgactatgcagcgaatattgaaaaggctgaagttgtttatcatccttctcataagcattctgcacttgcggaattgactaaagttgagacgcccaatgttaaaacagctcaagaagttgcagaatatttaaagagaccattagatgaaattgtaaaaactatgatctttaaaatagatggcgaatttattatgtttctagttcgtggacatcatgaattaaatgaagtgaaattaaaatcatatttcggcacggaacatgttgaaatggctactccagatgaaattgttaatcttgtagatgccaatccggggtctcttggtcctatttttgataaagatattaaaatttatgccgataattacttacaagatttaaataactttgttgtaggagctaatgaagatcattatcactatataaatgtcaatattggtagagactttgatgtaacagaatacggtgactttagattcattacacaaggtgagatgttaagtgatggctcgggagtagcacaatttgctgaaggcattgaagtaggacaagttttcaaattagggacaaaatattctgaatcaatgaatgcaacttttctagataatcagggaaaagctcaaccactcattatgggctgttatggtattggagtatcaagaacattaagtgcaattgttgaacaaaacaatgacgagaatggaattatttggccaaaatcagtaacgcctttcgatatccatctaattactatcaatcctaaaaaggatgatcaacgtactttaggtgatcaactttatcaaaaattaatggattcatacgatgttttatatgatgaccgaaaagaacgtgctggtgttaaatttaatgattcagacctaattgggttaccggtacgagttgttgttggtaaaagagctgaagaaggtattgttgaggtaaaacaacgcattaacggtttaagtgaagaagtgcaaattgatgaattagagtattacttacaagaattatttaagaatattaagtaa

SEQ ID NO: 514 - DNA, 981 bp, S.epidermidis
acgatggggaaaataaaagaacttgagacgtctctagctaataaaatagctgcgggtgaagtggttgaaagaccaagttccgtagttaaagagctcttagaaaatgcaattgatgcacaagcgacagaaattaatattgaagttgaacagtctggagtttcatcaataagggttgtagataatggcactggtattgctcaggaagatttagggttagtatttcatagacacgcaacgagtaaaatagtcgcagatgatgatttgttccatattcgtactttaggttttaggggagaagctttagctagtatttcatcagtagcaaaggtgacattaaagacctgtactgataatgaaaatggacatgaaatatatgctgaagatggtaaaattattcatcaaaaacctgcaaaagctaaaaagggtacagatatacaagtggattcattattctacaatacacctgctcgattaaaatatataaaaagtttgtataccgaactgggtaaaattacggacattgtaaatagaatggcgatgagtcatcccgaaattagaatttctttagtttcagatggtaaaaaacttttaagtacgaatggctcaggaagaacaaatgaagtaatggctgaaatttatggaatgaaagtagcaaaggatttagtgcatatttcgggtgatactagtgattatcatcttgaagggtttgtagctaaacctgagcattctagaagtaataaacattacatttctattttcatcaatggtagatacatcaaaaactttgtactcaataaagcaattttagagggatatcacacattgcttacaataggaagatttcctatatgttacattaatatccaaatggatcctattttggttgatgtaaatgttcatccaacaaaattagaggtgagactttctaaagaagatcaactttatgatcttatcgtaaccaaaatcagagagggcttttaa

SEQ ID NO: 515 - DNA, 495 bp, S.epidermidis
gttaaagttgaaagaaggattattccaatgatatacagtttgactgaaattgaagcaagatatcaagaaaccgataaaatgggggttatctatcacggtaactacgcaacatggtttgaagttgcgagaacagactatataagaaagcttggcttcagttatgcctctatggaagaacaaggtgttatttcaccagttgtagatttaaaagtgcaatataaaaaatcaatttactatcctgaaaaggtgacagtaaaaacatgggtggaaaaatattctagattacgttcaacttattgttataaggtttataatgaaaatggagagttagctactactggttcaacagaacttatctgtattaaagcagatacatttaaacccatacgcttggatagatattttcctgagtggcatgagacttatagtaaagttaaccagttaaataaagaaggtaaagatgctgaggttacgtttggcattaatcatttataa

SEQ ID NO: 516 - DNA, 249 bp, S.epidermidis
caaagggttgagaaggaatatagcccttcgctcatgacatcattgtttactgaatcgaatccattaactcataaagaacaagttgttttaagagaaataggcaatgggttaagtagcaaagagattgctagcaaattgtatttatcgaacgggactgtgcgtaactatacgagtactattatagacaaaatgaattcagatcatcgttttgaggcatggaaaaaagcaaatgaaaaggggtggatttaa

SEQ ID NO: 517 - DNA, 132 bp, S.epidermidis
tgttttaatgaattatacgagaatgcttttattctatattcttatattgagcccaaccttttatactttgatctcaatctcttaaaaattatagtaaattgttttcttgcatatgttgcaccgcacgtgtaa

SEQ ID NO: 518 - DNA, 786 bp, S.epidermidis
agagtgaatgatagtatgtctctaacaattaaagaaatcaaagaaaaactatctcgaattgaaacgttggaagagttacataaacatgaagcaaataatgattcacgtaaaggtgttataaatgcgattaagtctagggaaaaaaatattcttaagcaacaagcattagaagagcactatttatccatgaatcaatacgaaaacaacattatgtcctctaacagggatgcattaatttgtggaattgatgaggtagggcgtgggcccttggctggaccagttgtggcttgtgcagttattttagagaagaatcatcattatattggtttagatgactctaaaaaagtgtctcccaaaaatagagcacgacttaatcaaaatttaaaagaaaatgtctatcaatatgcatatggcatagcgtcctcagttgaaatagatgaattgaacatttatcgggcaactcaattagctatgctacgtgctataaatcaattagatgttacaccgacgcatttattaatagacgcaatgacactagatattgatattccacaaacctcaattattaaaggtgatgctaaaagtgtgtctatcgcagcagcaagtatcatggctaaagaataccgtgatcaatatatgagacaactatctaaacagtttccagaatatggttttgataaaaatgcaggttatggaactaagcaacatttaaaggctattgatcaagtgggcataatcaatgaacatcgtcaatcatttgaaccaattaaatcaatgatgaaataa

SEQ ID NO: 519 - DNA, 153 bp, S.epidermidis
ttacttgatgacttgaggttgtcgaataaactttttgtaacatctctatgtcttaaattaagtaataaaatgaaactcgaagctagtaataggatagtaattattattacacctacaatagatatgagaggtataaatagtttaagtaaataa

SEQ ID NO: 520 - DNA, 636 bp, S.epidermidis
tttgattgtgaaagcgcttgctataggggtggtaacatgtttgttaaagaagaaaaaccagtgaataaaatagtcgaaattttaaggaaaacatcatctcatttattcaaatttcacggcgaggtagcgatgcatctatttctgaatgatgattttatattaccatcgaaaatagatatttgtgttgagcgcaaaaagttattggaaattatcagggtgattcctgaagaatttacgattcactattatgataatcagttatatgaaagattaagagaatctttatctttatcagatgttgaacatgttaaagtctttaaaaacgatacagaagtcatgacaatatttgtttatgatgttgtaaatgatgaatggctatttaggttagatcatcatatacgtttaccaaaaaataatatatattttcattctttaagttggaacgtagattatattaagccagaaatagttcttatgtatgatttaatgagtgaacaaaaatatcatcagtttagtaattataaagctgttattgattctcttagttattatcaattctatattttaaaattggtagtaggtgaacagcgtattaaaaaagctatagtaaatagttccactaaaaagatatcttaa

SEQ ID NO: 521 - DNA, 495 bp, S.epidermidis
aatcgaagtgaaaacatgacacaagaattaaaaagtaaattactttctttttttaaatttattttcgccactgctttatttatctttgtaatttttacactctatagagaattatcacatatcaattttaaagagacattcatacagttcggcaaaattaatagattatggctcgtactactatttgctggtgggggactgtcactcatcttattatcactgtacgatattattttagtaaaggctcttaaacttaaaatgccgttgattagagtctttagagtgagttatattatcaacgcccttaattctataattggttttggagggtttataggtgcaggcgtaagagcttttgtgtataaaaattatactaatgacacgaaaaaacttgtacaatatatttttattattttagtatctatgcttacgggattaagtttattatccattttagttgtcctgcgtatatttaatgcttcttcacatgattga

SEQ ID NO: 522 - DNA, 558 bp, S.epidermidis
aaaatgagtgacataatcaaagatacaaagtctagaatgcaaaaatcaattgataacttatctcgtgaacttgctaacattagtgctggtagagcaaactctaatttacttaatggtgttacagttgactactatggtgcacctacaccagtgcaacaattagcaagtatcaatgtgcctgaagcacgtctattagttatttcaccatatgataagtcatcagttgctgatattgaaaaagcaattatcgcggctaatcttggggttaatccaacgagtgatggtgaggttattcgtatctctgtaccagctttaactgaagaaagacgtaaagaattagttaaagaagttaaaaaaattggtgaagatgctaaagtctcaattagaaatattcgtcgtgatattaacgatcagcttaaaaaagacgaaaaaaatggtgacattactgaagacgacttaagaagtcaaactgatgatgtacaaaaagctacagataattcgattaaagaaatagatcaattggttgccgacaaagaaaaagatattatgtcagtatag

SEQ ID NO: 523 - DNA, 174 bp, S.epidermidis
aagaaacgtttgcagttaaagaaatttgatgtggaacttgttgatggatttacgaaagttattttaagtttcatcagaatgtcgattcgaaacataattaaagtcaaaagagaaattgcatttgtattaatgctaatgaatataaaaaaagtagttgctcaacaatttaaataa

SEQ ID NO: 524 - DNA, 2415 bp, S.epidermidis
ggaggaaacgaattgagtgagataattcaagatttgtcacttgaagatgttattggtgaccgatttggacgttatagtaaatatatcattcaagaacgtgcattacctgatgtacgtgatggtttaaaaccagtacaacgacgtatactattcgcaatgtattcaagtgggaatacgtatgataaaaatttccgtaaaagtgcgaaaactgtcggtgatgtaataggtcaatatcatcctcatggagactcttcagtatatgatgctatggtgcgcttaagtcaagattggaagttacgtcatgttctaattgaaatgcatggtaataatggtagtatcgataacgatcctccagctgctatgcgttacacagaagctaaacttagtcaattatcagaagaactattaagggatattaataaggaaacagtatcatttattccaaactatgatgacacaactttggaaccaatggtattaccagcgagattccctaatttattaattaatggatctacggggatttcttcaggatatgctactgatatcccgccgcataacctcgccgaagtaatacaaggcacattgaagtatatcgatcaacctgatattacaattaatcaactgatgaaatatatcaaagggcctgactttcctacaggtggtatcattcaaggaatagaaggtataaaaaaagcgtatgagaccggtaaaggaaaggttgtcgtgcgttcacgagtagatgaagagcctttaagaagtggacgtaaacaattaattgtgactgaaattccgtatgaagtgaataaaagtagtttagttaaaagaattgacgaattacgtgccgataaaaaggttgatggtattgtagaagttcgagatgagactgatagaactggattacgaattgcaatcgaattaaaaaaagatgctaatagcgaatcaatcaaaaactatttatataagaattcggatttacaaatttcatataattttaatatggttgctattagtgaaggtcgccctaagttgatgggattacgtgaaattatagaaagttatttaaatcatcaaattgaagtggttacaaatagaacgcgttatgacttagagcaagctgaaaaacgtatgcatattgtggaaggattaatgaaagctttatctatacttgatgaagttattgcattgatacgtaattctaaaaataaaaaagatgctaaagataatttagttgcagagtatgactttactgaagctcaagcagaagctattgtcatgttacagctgtatagattaacaaatactgacattgaagctttgaaaaaagaacatgaagagttagaagctttaataaaagaattaagaaatatcttagataatcatgaggcacttttagcagtaattaaagatgaactaaatgaaattaaaaagaaatttaaagtggatcgactatctacaatcgaagctgaaatttccgaaatcaaaattgataaagaagttatggtgcctagtgaagaagtgattttaagtttgacgcaacatggctatataaaacgtacatctacacgtagttttaacgcaagtggtgtgactgaaatcggtttgaaggacggcgaccgtttattaaaacatgaaagcgtgaatactcaagatactgttcttgtatttacaaataaaggtagatatttgtttatacctgttcataaattagccgatatccgttggaaagagcttggtcaacacatatcacaaattgtgccaatagatgaagatgaagaagtggtaaatgtatacaacgaaaaagattttaaaaatgaagccttttatattatggctacaaaaaacggcatgattaagaaaagtagtgcttcacaatttaaaactactcggtttaataaaccactcataaatatgaaggttaaagacaaagatgaacttattaatgtcgttcgattagagtctgatcagttaattactgttctaacccataaaggcatgtcattaacttattcaactaatgaattatcggatacaggcttaagagcagctggtgttaaatcaattaatcttaaagatgaagactatgttgttatgacagaagatgtgaacgactcagattccataataatggttacacaacgtggtgctatgaagcgtattgattttaatgttcttcaagaagctaaacgcgcacaacgtggaattactttactaaaagaattaaagaaaaaaccgcatcgaattgtggcaggtgcagtagttaaagaaaatcacacgaaatatattgtattctctcaacatcatgaagaatatggtaatatcgatgatgtacacttatctgaacaatatactaatggatcatttattattgatactgatgattttggagaagtagaaagtatgattctagagtaa

SEQ ID NO: 525 - DNA, 336 bp, S.epidermidis
aatggtatagaggtggataacatggttggacaaacaaatttattcgatgatgttataaagaaagaggaacgctttgttatagttgttcaagcacttgaagaaaaaaatggtaagctcttaaaacggactttgagagaatatccaagcttagagcacacgcaaatgaatgaccttttctctcatcttaaagaagtatttcttgaagaaccttttggggtcaatcaatcagcatatagcattactgtttatacaaacctagattatgccgcagatcaagtatatgcacatgttaaacgctataaaggaaaacatgactggacacatactgcgaaatag

SEQ ID NO: 526 - DNA, 2028 bp, S.epidermidis
ttaaaaatagatattaattgtagaagggaagacacaacgatgtttaatgaaaaagatcaattagctatagatacgatacgtgctttaagcattgatgcaatcgaaaaagcaaattcaggacaccctggattacctatgggagcagcacctatggcgtatactttatggacgcgccaccttaattttaaccctcaatctaaagatttttttaatagagatagatttattctatcagcaggtcatggttcggctttattgtatagcttattacatgtctctggtagtttagaacttgaagaacttaaacaatttacacaatggggttcgaagacgcctggacatccagaatatatacatactgatggcgtacaagttactactggtccattaggtcaaggttttgccatgtctgtacggatggcgttagcagaaagtcatttagcaggtaaatttaataaggaccaatttgatatagttaatcattacacttatgtattagcgtcagatggtgacttaatggaaggtatctcacatgaagctgcatcttttgcaggtcataatcagttagataaattaattgtcctttatgattcaaatgatatatctttagatggagatttatataaatcattttctgaagatacaaaacagcgtttcgaagcctatggttggaactatattctagttgaaaatggtaacgatttagatgagattgataatgcaatcactcaagctaaatcacaacaaggacctactattatcgaagttaaaactattatcggttttggttctcctaataaagctggttcaaatggagttcatggtgccccacttggtgaagaagaacgtgcacttacatttaaagaatatggattagatcctgaaaaacgttttaatgttcctgaagatgtatacgaaatatttaaatcaacaatgttaaaacgtgcaaatgaaaatgaagaggcttggaataatatgcttaaaaattatagtgaagcctatccggaattagctgaagaatttaaattagcaatgagtggtaagttaccaaataattacgctgatgccttaccagaatatgatttaaatcacagtggtgcttctagagctgattcaggagaaataattcaaaaattaagcgagtttgtaccttcattctttggtggatcagcagacttagcaggttcaaataaatctaacgttaaagaagctaaagattataataaagatactccagaaggtaaaaacgtatggtttggtgtacgtgaatttgcaatgggagcagcaataaacggcatggcagcacatggtggacttcatccatatgcagcaacattctttgtattcagtgattacctaaaaccagctttacgattatcatcaatcatgggactcaattcaacgttcatctttactcatgattcaattgctgtaggtgaagatggccctacacacgaacctattgaacaattagcaggtcttcgtgctattcctaacatgaatgttattcgtccagctgatggtaatgaaacacgtgtagcttgggaagttgcacttgaatcagaacacacaccaacatcattagtgttaactcgtcaaaatttaccaactttggatgttgataaacaaacagttgaaaatggtgtgagaaaaggcgcatatattgtttttgaaacagaacaacaacttgaatatttattattggcatctggatcagaagttaatttagctgtagaagccgcaaaagaattagagcaacaaggtaaaggtgtacgagttatttctatgccaaactggtacgcatttgaacaacaatcttctgaatataaagaatcaattttaccttctgatgttactaaacgtatagctatcgaaatggcatcaccacttggttggcataaatatgttggaattgaaggtaaagtcattggtataaatagttttggcgctagtgctcctggagatttagtagttgaaaagtatggattcactaaagaaaatattttaaaacaagtccgttcattataa

SEQ ID NO: 527 - DNA, 699 bp, S.epidermidis
tgtcagatagaggtatgcccaaaaggattccgaaatatgcatggattcggttctcataagtattctatgtataatgataaaggtgaacgtgtatgggtaaaatatcatttccgtacacaacaaggaattgaaaactatactgacgaggaagcagctaaaattgtaggtatggatagagattcttcacagagggatttatataatgctatcgaaaatggagattatccaaaatggaaaatgtacattcaagttatgacagaggaacaagctaaaaatcatccagacaatccttttgatttaacaaaggtatggtataaaaaagactatccactgattgaagtgggagaatttgaattgaatcgtaatcctgagaattattttcttgatgtagagcaggcagcgtttacgcctacaaatattgttcctgggttagattattcaccagataaaatgctacaaggacgtttattctcatatggagatgcccaacgttatcgtttaggagttaatcattggcagattcctgtcaatcaacctaagggagttggagttgagaacttatgtccatttagtcgtgatggacaaatgcgtttcttagataataaccaaggtggaggcccacattattatcctaataatcaaggtatatatgagtcacagcctgaacacaagaaacccaccattcccgacagatggtga

SEQ ID NO: 528 - DNA, 984 bp, S.epidermidis
ccaaaatcagagagggcttttaaagacaaaatcctcatcccacaaaacgatttaaatcacgcgcccaaaaagaataaggttttagatacatttgaacaacaaaaaattaatttcgtgaagcaacaatcacaaattggagaaacatctgcaccatatgtacatgatcacaaagataagaatcatgacgtagagtcgcataagaataatttagattcaacttcatcgacaaataatgaaagtacggaagtttctaatgaattacacaattacattgatgatagttacttacaaagtcaaaaagaagtattttttgatatggaacaaaacacatctaacgaatatgagatatcaaatcagcaatcaaacgatattaaaggaacagtgagtcagacacctcatcgtagggtgccttatatggaaattgtaggtcaagtacacggtacgtatatcattgcacaaaatgaaaatggaatgtttatgattgaccaacatgctgctcaggaaagaattaaatatgaatattttagagaaaaaattggcgaagtgaccaatgaagtgcaaaacttattaataccacttactttccatttctctaaagatgaacaaatgattattgatcagtacaaagatgaattagataaagtaggagtacatcttgaacattttggtgggcatgattatattgtaaatagctatccagtatggtttccgaaagaagaagcggaagaaattattaaagatatgattgaacttgtcttaaaacacaaaagtgttgatgtgaagaaaataagagaagatgcagcaatcatgatgtcttgtaagaaatcaattaaggctaatcactatttaaaaaataatgaaatggcagatttaattgatcaactaagagaagcagaagatccttttacttgtcctcatggtagaccgattattatcaatttttcaaattatgaattagaaaagttatttaaaagagtaatgtag

SEQ ID NO: 529 - DNA, 2073 bp, S.epidermidis
actttggcagataatttagtcattgttgaatcgcctgcaaaagctaaaaccattgaaaaatatttaggcaaaagatataaagttattgcttcaatgggacatgttcgtgacttaccaagaagtcaaatgggtgtcgacactgaagataactatgaaccaaaatatattacaattcgtggcaaaggtcctgtagttaaagatttaaaaaaacatgcgaaaaaagcaaaaaaaatatttttagctagtgaccctgaccgtgaaggtgaagcgattgcttggcatttatcaaaaattttagaattagaagatagcaaagaaaatagagtagtatttaatgaaattacaaaagatgctgttaaagatagttttaagcatcctcgtggtattgaaatggatttagttgacgcgcaacaagcacgtcgtattttagatagactcgttggttataatatttctccagtattatggaagaaagttaaaaaagggctgtctgctgggagagttcagtcagttgctttacgtttagtcattgatcgtgaaaatgaaattcgtaattttaaacctgaagagtattggtccattgaaggtgaatttagatacaagaaatctaaatttacagctaaatttctacactataaaaataaaccttataagctaaacaacaaagacgatgttcaaaggattactgaagcattaaatggtgatcaatttgaaatcacaaatgtgaatcgtaaagaaaaaacacgttatcctgctcatccatttactacatcaaccttacaacaagaagctgcacgtaaactaaattttaaagcacgcaagacaatgatgttagcacaacaattatacgaaggtattgacttaaagcgtcaaggtacagtaggtttaattacgtatatgcgtaccgattctactcgtatctcaacttctgcaaaatcagaagcgcagcaatatataaatgataaatatggtgaacagtacgtgtctcagcgtaaatcatcgggtaaacagggcgatcaagatgctcacgaagctattagacctactagtacaatgcgaactcctgatgacatgaaagcttttcttactagagatcaacaccgtctatacaaattaatttgggaaagatttgtagcaagtcagatggctccagctattttggatacagtagctttagatgtaactcaaaacgacattaaatttagagctaatggtcaaactattaaatttaaaggttttatgacactatatgtagaagcaaaagatgataaagagaatgataaagaaaataagcttcctcaactagataaaggagataaggtaactgcgacaaagattgaaccggcacaacactttacacaacctcctcctcgttatactgaggcgcgtttagttaaaacgcttgaggaacttaaaattggaagaccttcaacatatgctccaaccattgatacgattcaaaagcggaactacgtcaagttagaaagtaaacgcttcatcccaactgaattaggagaaattgtttatgagcaagttaaagaatacttcccagaaattattgatgtagaattcactgtaaacatggaaacattacttgataaaattgccgaaggtgacatgaattggcgtaaagtaataggagacttctacaacagttttaaacaagatgttgaacgcgcagaatctgaaatggaaaagattgagattaaagacgagccagctggtgaagattgtgaagtctgtggttctccaatggttattaaaatgggaagatatggtaagtttatggcatgttcgaactttccagactgtcgtaacaccaaagcaattgtcaaaacgattggtgtcacatgtccgaagtgtaatgaaggagatgtcgtagaacgtaaatcaaagaaaaatagaattttctatggttgttctagatatccagaatgtgattttatttcttgggataaacctgttggaagagattgtcctaagtgtcatcattaccttgtgaacaagaaaaaaggtaaaagtagtcaagttgtgtgctccaactgtgattatgaagaagaagttcaaaaatag

SEQ ID NO: 530 - DNA, 294 bp, S.epidermidis
agcatgcaagatacattaatgagtattcaaattattccaaaaacaccgaacaacaacgatgttattccatatgttgatgaggcaattaaaattattgatgattcaggtttgcattttagagtgggaccgttagaaacaacagttcaaggtgaaatgagtgaatgtcttattttaattcaaaaattaaatgatagaatggttgaattagaatgtccaagtattattagtcaagttaagttttatcacgtacctgaaggaatagaaattgagacgcttacaggaaaatacgactaa

SEQ ID NO: 531 - DNA, 900 bp, S.epidermidis
aaggagcaagataatatgacacacatgtttgaaggcgttggtgtagcattagcgactccctttaccaataatgaggttgatttcaacgcattagaaagacatgttcaatttcttttaaataacaatattcaagcaattatagtgaatggcactacagcagaaagtcctacattaagtgacgaagaaaaagagaaagtattggcgacagtagttaaactcgtgaatcatagcgttcctgttattgcgggtactggcactaataatacgtataaatcaattcaagcttcaatacgtgctaaagaaattggtgcagatgcagtcatgttgattacgccctactacaacaaaacgaatcaacgtggtttaattcaacattttgagacaatcgcaaatgaagtgaaattaccagtaattctttacaatgtgccatcacgaacaaatatgacgatagaaccagaaacagttggaattctcagtcataatccatatatcgttgctttaaaagatgcgacaaatgattttgattattttgatcaagtaaaacaacgtattaatacaaatgaatttgcattatatagtgggaatgacgacaatgttgtgaagttctatcaacgtggaggtaatggtgtcatctctgtaattgcgaatgtaattccacaagaatttcaatatttatatgaccaaagacaaaatgaaaccgatattactaattactttaaacctatcgagaaattgttagaagcgttgtcacttgacgttaacccaatacctattaaagttcttaccgcatatttgggttatggtcactacgaagtgagattaccattagtgcctttagaagaagcacaatgtaaacaagttgaacgagcatttgaacaatttaaagcaggtgaacaataa

SEQ ID NO: 532 - DNA, 387 bp, S.epidermidis
cgtatgaaagatgcaattcaagaagctgaaaaactagccaagatgaataaagaccaaaagaatcaatatgagttggaaaagctgttaaaagaaaatgaagaactaaaagcagaaaaagctttatctcaaatgaagaatgagactcgttcaatgcttaatgagtcaggtttagaaaacttcgatgatcaaattgttaatatattagtaaatactgatgctgaaaaaacaaggaaaaatgttgaatcatttactaacttacttaatcaaatggtaaaatcaaatgttgaaaaagcattaagacaagactcaccagtaagcactcaatcaaataaaatgacaaaagatgaagaatcagattatcttgtttcagggagaaaatgtctataa

SEQ ID NO: 533 - DNA, 792 bp, S.epidermidis
ctgaaaggagacaatcgtgtcttctttacttatatatttacatatttttacgatagagaggataagaaaatggcacaaacttctaaatataaacgtgtagtattaaaattgagtggcgaagctttagcaggtgataaaggattcggcataaatcctatcattatcaaaagcgttgcacagcaagttgctgaagttgccaaaatggattgtgaaattgctgtcattgtcggcggtggaaatatttggagaggcaaaactggtagcgacctaggtatggatcgtggtacggccgattacatggggatgcttgctactgttatgaatgctttggcattacaagacagtttagaacaattagattgtgatacacgtgttttaacttctattgaaatgaaacaagttgctgaaccatatattcgtcgacgtgcaattagacatttggagaaaaaacgtgttgttatatttgccgctggaattggtaatccttacttctcaactgacacaactgctgctttacgtgcggctgaagtagaagcagatgtaattttaatgggtaaaaataatgtagatggtgtttattcagctgatccaaaagttgatgcaaatgcaattaaatatgaacatttgacacatattcaaatgcttcaagaaggtttacaagtgatggattcaacagcttcatcgttctgcatggataataatattccgttaaatgttttctctattatggaagaaggtaatattaagcgtgctgtaatgggtgaaaaaatcggaacattaattacaaaataa

SEQ ID NO: 534 - DNA, 168 bp, S.epidermidis
acatcattggatatgttacaactgctcataaagtcactaaataaattcgtttcatattatactactgattgcacgtattttcatgaaaaacaaatagtaaataatacaataaagaagagcaggttagatttaaaattatgtttcatcatctttcctgctctttattaa

SEQ ID NO: 535 - DNA, 156 bp, S.epidermidis
aacagactggaaagtaagacacctatcatacttcctggaaaagcaaatgcgcttccagttccaaatgaaattcgtagtacagaagaaataaaagcttgcgctaaaccataccatggtccaacaaatacagcacataatacatttacaaaatgttga

SEQ ID NO: 536 - DNA, 126 bp, S.epidermidis
gtcgttttacttcaccttttatatttaacattcggttcatttaatactatttatatttctaatctaaacaagtatacaatagttgtagtgaaaactaaaatattatcctgcaaaacttttatataa

SEQ ID NO: 537 - DNA, 1722 bp, S.epidermidis
atagtgagtttatatatggacgggtcactatttataggaggtaacattttgagtttaataaagaaaaaaaataaagatattcgtattattccactcggtggagtaggcgaaatcgctaaaaatatgtacatcgttgaagtagacgatgaaatgtttatgttggatgcaggattaatgttcccagaagatgaaatgcttggggtagatatcgttattcctgacattcaatatgtcattgaaaacaaagaaagattaaaaggaatatttcttacacacggtcatgaacatgctataggcgcagtaagttatgtgttagaacaaatcgatgcaccagtttatggttctaaattgacaatcgcacttgttaaagaagcaatgaaggcccgaaatattaaaaagaaagtacgttactatactgtaaaccatgattcaattatgagatttaaaaatgttaacgtgagtttctttaatacgacacatagcattcctgatagcttaggcgtatgtattcatacttcgtatggttctatagtttatactggagagtttaagtttgatcaaagtttgcatggacattatgctccagacttgaaacgaatggcagaaattggtgatgagggtgtgttcgcattaatcagtgattcaacagaagctgaaaagcctggatataacacgcctgaaaatattattgaacatcacatgtatgatgcttttgccaaggttaaaggtagacttattgtatcatgctatgcttcaaacttcgttcgtattcaacaagtgcttaacattgcaagtcaacttaatcgtaaagtgtcatttttaggtcgttcacttgaaagttcgtttaacatagcacgtaaaatgggatactttgatataccaaaagatttattaatacctattaacgaagtggaaaattatcctaaaaatgaagtgattattattgctacaggtatgcaaggtgaaccagtagaagcattaagtcaaatggctcgcaaaaagcataaaattatgaacatagaagaaggagattcaatattcctagcaattactgcttcagctaatatggaggttattattgcagatacattaaatgagttagtgcgtgctggagcacatataattccaaacaacaagaaaattcatgcgtcaagtcatggttgtatggaagaattgaaaatgatgttaaatattatgaaacctgaatattttgtacctgttcaaggtgaatttaaaatgcagattgcacatgccaaattagcagcagaaaccggtgtagcacctgagaaaattttcttagttgaaaaaggcgacgtgattagttataacggtaaagatatgattttaaatgaaaaagttcaatcaggtaatatacttattgatgggattggcgttggtgacgtaggtaatatcgtattaagagacagacatctattagccgaagacggtatttttattgcggttgtgacattagatcctaaaaatcgacgtattgctgcaggacctgaaattcaatcaagaggcttcgtctatgttagagaaagtgaagaacttttgaaagaggctgaagaaaaagtacgtaaaattgtagaggaaggtcttcaagaaaaacgaatagaatggtcagaaatcaagcaaaatatgagagatcaaatcagtaagttactatttgagagtacaaaacgccgtccaatgattattccagtcatatcggagatctaa

SEQ ID NO: 538 - DNA, 780 bp, S.epidermidis
aagttgaaacttttaacaataaaaaatctaaacatcaatgataaagaagggcaagcaattattaaaaatgtcgacttaaatatatataatcaatctctaaatgtcattataggtgaaagtggtgctggaaaaagtttgactgttaaagcaatattaaatcatttacctactcagttacatatgagtttcgatgaatttaaaatgcaaggtcaaaatacttctggtatcaagcaacttttaggtaaacatatcggctatatctctcaaaattatgctcaaagttttaatgaatatactcgtttggataaacaacttatagctatatatcgttatcattttaatgtttctaaggataatgcattgaaaaagataaaaaaagctttaacttgggttaacttaaatgatgaatcaatcattaataaatatagtttccaactttcaggaggacaattagagcgagttaatattgctagcgttttaatgttagatccagaattaattattgcagatgaacctgttgcatctttagatgtagtgaacggtcatcaaataatgcaactccttcaacacattgttaaagatcatcataatactgtattacttatcactcataacatgaatcatgtcctcaaatatgctgattattttaatgtaatgagaaatggcatgatgattgaatctggagaaatagacaaattatttaatcaccatcatcttcatcggtatacagaacaattattaaactatagaagcaagctgcaaaaggaggacaacatctaa

SEQ ID NO: 539 - DNA, 855 bp, S.epidermidis
gggtctccctgttttttgggaggaatgtatatgaatgcttatttagcagaatttttaggtactgcaatccttattctttttggtggtggcgtttgtgcaaacgttaacttaaagagaagtgctggtaacggtgcagattggattgttattgcatttggttggggtttggcagtaacaatgggcgtttatgctgttggaacgttttctggtgcacatttaaatccagctgtaacagttgctttagccatggatggtggatttagctgggcgcaagtaccgggctatattgtttgtcaaatgcttggcggtattgttggtggagtttttgtatggttaatgtatttaccacactggaaagttacagaagatccagcagtcaaattaggtgtattttcaacagcaccagccattaaaaattattttgctaactttttaagtgagattatcgggactatggctttaacattaggaattttatttatcggggttaataaaattgctgatggtttaaatccaattattgttggtagtcttatcatagcaattggtttaagcttaggaggtactactggttacgctattaatccagcccgtgacctagcaccacgtattgcacatgctattttgccaattcatggtaaaggtaaatctaactggtcttacgcaattgtacccgttctgggacccatggcaggtggtatgttaggtgcgattgtttacgaagtgttttataaacaaacattcaattttagttgtttcattggtttaattgtacttatattcacacttatacttggcgtgatactaaataagatatctcaaaataaaaacaacgatattgaatcaatttattaa

SEQ ID NO: 540 - DNA, 135 bp, S.epidermidis
catgagaactgtaagaaatacatataccattataggttatttacattaggaggatgtttcaatgaaaaagtggcaattagtcggtactactgtattaggagcttcggttttacttggcgcttgtggcggaaatga

SEQ ID NO: 541 - DNA, 1113 bp, S.epidermidis
gaaaggagatgtacactaatggaatcaagaagttggggagtgagaataggggaattaagtactttaatatatttaatatttccgattttagctatatttgttgacaaacgtggtaatttcttaacttatttaattgtttgtactatttttataatcagctatgtgacgatgattatattttataaataccttagtgatagtattttatattcattactggttattcattatttaggaatcttttattttgtctatagtgtcaatcctatgaatagtttgtttttcttctatagtgctttcgccttaccttttatttttaatgttcgtgttgtatcaaaagaatttataacctttttaatagctatgataagttgtttaatactaacttatatatttaatccaacatttgtggttccattaagtgcattttatttggttatattaattgttgctgtaggtaattttaaaaatagagacgaacgaattatgaaagctaaacttgaagaaaagaataagtatattaatgtactaatagctcaacaagagcgtaatagaataagtcaagatcttcatgatacattaggacatgtatttgctagtcttactttgaagtctgaattagctgttaaactcatagatactaatcctaaagaagcaaaaaatgaaatgcaggcaataaatcaactttcaacagaagccttaaataaagtcagactcattattgatgatttgaagatacaatcttttgaagatgaaatttcatcattggaacacttattgcaaaatgctaatctacattttaaatttaacaataaaagtgcggctaaatcattaaatccagcgaaacaatcaatattatctatgatttttagagaagcaattaataatgttattaaacatgcgcatgcgactgaagtaataggtgaattgaaggtacatgagcatcaaatcattttaaaaattaaagataatggtgtgggaatagaaaatgaagatgcttcaaatttgaaaagtattaaagaacgtgtagattatttaaatggtaaattaattgtacaatcaaataatggaacacttattattgttgaaatacctagaggtgatttattatga

SEQ ID NO: 542 - DNA, 822 bp, S.epidermidis
agatttaagtgcatttattttataaatatatatagaaggagaaaaattatgagcttattatctaaaacaagagaattaaacactttattacaaaaacataaaggtattgcagtagattttaaagatgttgctcaaacaattagtaatgttacagttactaatgtatttattgtgtcgagaagaggtaaaatcttagggtcttgtttgaatgaattattaaaaagtgaacgcattaaagatatgttagaagatcgacatataccgcgtgaatatactgaagagttgatgaatgttaaacaaacagaatcgaatatcgatattgataatgaattaactgtatttccgccagagaatagagaggtatttttaaatagtagaacaactattttcccaattttaggtggtggcgaaagacttggtacgctagtcttaggtcgagttcaagacgacttcaatgaaaatgacttagtattaggagaatatgcagccactgtaattggaatggaaattttacgagaaaaacataatgaagtcgaaaaagaagctagagataaagctgctataacaatggcaatcaactcactttcatattcagaaaaagaagcaattgaacatatatttgaagaacttggtggtacagaaggtttacttatagcttcaaaagtagctgacagagtgggcattacacgatcagtcattgtgaatgctttacgtaaacttgaaagtgctggtgtcatagaatcacgttctcttggaatgaaagggacatttattaaagtaaaaaaagataaattccttgatgaacttgaaaaaaataagtaa

SEQ ID NO: 543 - DNA, 171 bp, S.epidermidis
ttctttattttagtttacataatatatattataggaagttgtatatataatcataaaagcccttcactcaatttacagttaaatctacatggcatttatatttattatctacagagttttctcttatttacttttttagttgagttcattatagcaatctatatttgttaa

SEQ ID NO: 544 - DNA, 522 bp, S.epidermidis
ataattattttagaggagttaagtacaatgaatattagaaagttgaccatcacagcattcttaatagctattaatgtcgtgttaagtagtttaattgtcattcctttaggtccaattaaagccgcacccgttcaacattttgtaaatgtattatgtgctgtatttgttggaccatggtatggtttagcgcaagcttttatttcttctgtactacgaatttcatttggaactggaagcgcatttgcttttccaggaagtatgataggtgtcttactttccagtctgttttatatgtataggaagcatatttttatggcttcagttggtgaagtattagggactggtgttattggtagtttaatgtgtatacctttagcatggtttttaggacttcaagatttctttattaaaccattaatgcttatgttcatagtatcaagttttattggggctttaattagttatatattgcttattattttgaaaagaagaggtttactagatagatttaacaaaaattaa

SEQ ID NO: 545 - DNA, 315 bp, S.epidermidis
ctcatggtccgtactgatttaactagtttccgttcaggagacactttacgtgtacacgtaagaatcgttgaaggttctcgcgaacgtatccaagttttcgaaggtgttgtaattaaacgccgtggtggaggaatttcagaaactttcacagttcgtaaaatttcttctggtgtaggtgtggaaagaactttcccattacacacgcctaaaatcgaaaaaattgaagttaaacgtcgtggtaaagtacgtcgtgctaaattatattacttacgtagtttacgtggtaaagctgctagaattcaagaaattcgctaa

SEQ ID NO: 546 - DNA, 153 bp, S.epidermidis
tattcataccgaataaagattaaactttatataaacaaagagcccgggacattgataaatatcccagactcttgtgtaaatgttaaaacaattattaattattttgtaatacaccaatttcttgtaagtattcctcataaggtacttctttag

SEQ ID NO: 547 - DNA, 138 bp, S.epidermidis
gccactgaccgtatttacggccagtggcttattaaatataatataaaaaaccgagcgtataaacgctcggatataatgatttattttaattgtaaatcaacttcatttatttcttttaaaatttcagctgtatcatag

SEQ ID NO: 548 - DNA, 138 bp, S.epidermidis
gtgcatacgcttataagttttagtcattcaatatgtatgaagaaaccgaatagtagtttgagatttaaaatgatgttcattattgataaccattctcaattaataacattttcttattgcacaaatattttaagataa

SEQ ID NO: 549 - DNA, 705 bp, S.epidermidis
atgaaagcgctagtcataggtggttctggaacaataggtcgtgccattgtaaaacgactgctatttgaaggttatgaagttttcttacattatcattcagctcaatattctgatttaagtaatcaatttaaaaatagcaaagttacatttattcaatgtgatttaaccaaagatatagagctcgaagattactttggacacattgacgagctagattgtctaatttataccagtgggacagcattatatggcatgttacaagatatgagtgattgtgacatcgataatagttatgcattaaatgtaagacaatttatacgtttgactcgctactttattgatattttaaggcagagtaacaatggacgtatcattgttatttcatcaatttggggagaaactggagctagtttagagacaatctattcagcgatgaaaagtgctcaaattggttttgttaaagcattaagtcaagaattagctttaacttcagtaactgtaaatgctattacaccaggtatggtaaaagggaaaatgagcgatgtatggtcgaaagatgagttatcgaatatagtatcagagttacctcagcaaagaatgattgatccttctgaagtggcacatgcttgtgcatacttgtgtagtactatgtcaaaaagtattacgggtacagtacataaagtgaatggcggatggtatatttaa

SEQ ID NO: 550 - DNA, 294 bp, S.epidermidis
acaagtaagcgaagaagaatcaatcatgaaagagaagtattaaaacaacaagcattaaacgaaggtaaaccagagaaaatcgttgaaaaaatggttgaaggtcgtttacgtaaatatttacaagaaatttgtgctgtagatcaaaacttcgttaaaaatccagacgaaactgttgaagctttcttaaaagctaaaggtggtaaacttactgatttcgttcgttatgaagttggagaaggtatggaaaaacgtgaagaaaactttgctgaagaagttaaaggacaaatgaaataa

SEQ ID NO: 551 - DNA, 1338 bp, S.epidermidis
agctgttctagatacaatttatgtactaacgaaaggagaccaacactgatgaaaacacatcaatatgaacttatagatgagaaagttttcgaacatgagtttgataatggattgaaattatttatcattcctaagcctggttttcaaaaaacgtatgtgacctacacaacacagtttggttcattggacaatcattttaagcccataggtagtcagcaatttgtaaaagttcctgacggtgtggcacattttttagaacataaattgtttgaaaaagaagatgaagatttatttactgcatttgccgaagagaatgcgcaagctaatgcttttacaagctttgatcgtacgagttatttatttagcgcaacaagtaatattgaaagtaacattaaacgtctcctcaatatggtagaaacaccttattttactgaagaaacagttaataaagaaaaagggattatagctgaggaaattaaaatgtaccaggaacaaccaggatataaattaatgtttaatactttaagggctatgtattccaagcacccgatacgggtggatatcgctggtagtgttgaaagcatttatgaaataacaaaagatgatttatatctatgctatgagacattttatcatccctctaatatggtgttgtttgtggtaggcgatgttagtcctcaatcgataattaaacttgtagaaaagcatgaaaatcaaagaaataaaacttatcaaccacgtattgaacgtgcgcaaattgatgagcctagagagataaatcaacggtttgtttctgagaaaatgaagttacagtcaccacgattgatgctaggttttaaaaatgaaccattagatgaaagtgcaactaaatttgttcaaagagatttggaaatgacatttttctacgaattggtttttggagaggaaacggagttttatcaacaacttttaaataaagatttaatagatgaaacattcggttatcaatttgtattggaaccgagctacagtttttcaattattactagtgcaacacaacagcctgatctatttaaacaattaataatggatgaattaagaaaatataaaggaaaccttaaagatcaagaagcatttgatttgttgaaaaagcaatttattggagaattcatatcaagtttaaattctccagaatatattgctaatcaatatgcaaaactctatttcgagggagtgagtgtatttgatatgcttgatatcgtagaaaatattacgttagagagtgtaaatgaaacttccgaattattcttgaactttgaccaacttgttgatagtcgtttggagatggaaaatagatga

SEQ ID NO: 552 - DNA, 165 bp, S.epidermidis
tatattcatagctcacttgttcaatttatgttaagttgttccacaaaacccaatttcactaaagacggtgttagttctcatctaccactaactttctggtgctacctcaactttagttacttcactttgcttcaaaaaaaccacaataacgctatcattctataa

SEQ ID NO: 553 - DNA, 123 bp, S.epidermidis
tgttccaggctatatttatggatgtttagagataaatgtttaaaatattcattatttatggcgtatgactctcatcactttaagcatactctcccacagagaataatgcttttgataaactaa

SEQ ID NO: 554 - DNA, 900 bp, S.epidermidis
cataaatcaagaggtgtgacgataatgattgaactacgacatatatctaaatctttcaaggaacataaagttttagaagatataagtattgatataaaaaataattgttgtacggcattaataggtaaaaatggagcaggtaagtcaacgttaattgatattatcgttggaaataatcactatgatagtggtcaaatcgctgataaatcaaatttgttaaatagacataagatgggtattctttttcaaaaaacagagtttcctaaatacataaaggtttgcgaattattacatttatatcaatccttttatcaaacgtttatttcttttcatcagtttaaagaaatcacacaatttagtgaccgacaaatgaatcagtttgcatgtaatttatcaggtggacagcagaggattttagattttgctttagcattggtaggtaaacctgaactgttaattttagatgagcctacgtcagctatggatgtagaaatgcgtcaacatttttggaatgttatagataaattaaaaatgaataacactacgatactatatacctctcattacattgaagaagttgaaagaatggcagatcaagtaatgatgttagataaaggtaaaatacaattagatgattcacctgaaaatataaaaaggaatcaaagttattctgtaattcgaattccttgcaaatatcaagaacttatcaatcaactgaaacataaatacgaaattgaattaataaaaaatagatatgaaataaaaacaactgatgtgagtgatgttttacaattattgaaacaatatcatgtcaatttcaataagattgaaattcttaaaaaatctttattagaagtcatgttttctaatgatttgtctaaaggagggaattaccagtga

SEQ ID NO: 555 - DNA, 1104 bp, S.epidermidis
tatcaagaaagtttatcctgtagagggagtttaataattatgaaaagatggcaaggattagttaaagaatttaaagaatatttaccagtcaatcaatctacaccagcactaacactcaatgaaggacatacaccacttatttattgtgaaaatctttctcaaaaattagatattgaattatatgttaaatatgaaggagcaaatccgactggctcatttaaagatcgtggtatggttatggctgtaacaaaggcaaaagaacaagggaaaaaagttgttatttgtgcttcaactggtaatacttcagcatcagcagctgcttatgctgcaagagctggtttaaaagcaattgtcgtaattcctgaaggtaaaatagcattaggtaaattatcacaagcagttatgtatggtgcagaaattgtttctatagaaggaaacttcgatgaagcactagaaattgtaaaagagattgctgaagaaaatgatgaaattgaattagttaattctgttaatccatttaggattgaaggacaaaagacgggtgcctttgaaattgttgaacagttagatggtcaagcccctgacattttagcaataccagtgggaaatgcaggtaatataactgcttattggcaaggatttgttgaatatcataataaaaagaatacacaattaccacaaatgtttggcttccaagcagaaggagcatctccaattgttcaaaataaaataatcaaaaatccagaaacaatagctacagctatccgaatagggaatcctgctagttggcaaaaagctgttaatgcactagatgaatcaaatggtttaattgatagtgtgatagatgaagaaattttagaagcttatcagttaatgacaacaaatgaaggtgtttttagtgaaccagcgagtaatgcttcaattgcaggtctaatcaaacttcatcgctctggtaagttacctaaaggtaaaaagatagttgcaatattaactgggaatggacttaaagatcctgacacagctatttctctcttagataatcctattcaacctttacctaataataaagaaagtataattagatacatcaaaggggcaatctag

SEQ ID NO: 556 - DNA, 123 bp, S.epidermidis
agaaaaagaagaatagtgtgtaattgctttattaacctgagacaaacaaaattgtctcaggtttttttaatgaaaatcattaatgtctcacaactaaaattttattatcatatctgcatatag

SEQ ID NO: 557 - DNA, 1275 bp, S.epidermidis
attttgaagagattcaatcaagataacacaaaagttcgagtcaatgttttgcctaccgataaatttaaaacaacgacaattacatttaaatttatggcaccattaaactataaaacaattacttcacgttcaattttaagtaaagtattagttcgtgcaacacaacaatggcccaccgataaaactttaaataaacagttatcagaattgtatggcgcctatgttaatagttttgtttctaagtttaaagataagcatgttattacaatctcattagaagtagttaatgaaaaattcttaaaagataaaacccctttatttgaaaagggattagatacgttaaaagaaataatttggaatccattaatcaaagatagatgctttgatcatacatatgtagctcaagaaaagtctttacttagcaaaaaacttgaagcaatggaagataataaagcacagtattcatttcttcagttaatgaattatatgtttaaacaagaaccctatcgatatatagcgacaggtcaattagaacaaattccacaagtgacttctgaaagtctatacgatacatatctatccatggtacaaaatgatgattgtgccatatatgttgtaggaaatattaacaaagaggaagtaacgcaactaattctagataagtttgcaattaagcctttctatttagaaaataaagaaagtactgaaatcacaccttcttttgatcaaccgcaatatataattgaaaaagacgatgttgaccaagctaaattgaatttgggatatcgctttccatcttattatgggaaaagtaattactatgcatttatagtattaaatatgatgtttggaggagatccttcctcagtactatttaatgaagtcagagaaaagcaaagtttggcatactctatacattcacaaattgatggtaaaaacggatttttatttgttttaagtggtgtttctgctgagaaatatgagcaagcaaaagatactgtcatcaaagagtttgataagataaaaaatggagattttgattctaataaaattgaattagctaaaaaaatcattatttcccatagacacgaagcatcagatagacctaaaagtataattgaaatactacataatcaattattattaaaccgacagcaaactgatcaagattttataaatgcagttaatcaagtgacgaaaaaagatgttattaaattggcaaatgaagctgttctagatacaatttatgtactaacgaaaggagaccaacactga

SEQ ID NO: 558 - DNA, 1167 bp, S.epidermidis
atatcagggagtatatcattgatgaatatttcaattgtagctgttggctctgaattattactaggtcaaatagctaatacaaatgggcaatatctttcaaaactttttaatagtattggtaaaagtgtagtagaacacacagttattggtgataaccctcaaaggttagaatatgtaataaagcaatgtctatctagatttgataccattgttttaacaggtggcttaggaccaacaaaagatgatttaactaaacatactgtagctaaagtattaggaaaaaatctagtgacggatgaagcatcgttaaactttatcaaaaactattttaaagaacaaggtcaagatatgacctctaataataagcaacaagcattagtaattgaagatgccatagttttaccaaataaaaatggtatggctcctggtatgcttgtagaattaggtaaacaaaaaataattctactaccaggtccaccgaaagagatgcaacctatggcgaagaatgaattattaccttatcttatggataaagatgaagttattttttctgaattacttagatttgctggtataggagagtcgaaattagaaacactattaattgatctaatagatgatcaaactaatccgacaatcgcacctcttgcaggtacgcatgaagtatattttagattaacagccaatgctgaaagtaaggaacgatgtcaactgcttattaagcctattcgagatgaaattttaaatagggttggtacttattattttggctcagacgaagttaatattgaagaatcggttataaatagtgcaaaacagaattttgctatttatgacggtgtaactaatggagctttgtttactcgattaaaaaatgctgacagtaaaaatctagttaaaggtatgctaccacattctaatcaatttattgatgtgacttctgagtttaatgccgtgttattcaatgcagcacaatatgtcagggatttgtaccaaacagatttgggtattgtacttttaaataaagataacattgtatatttaggaatttatgatggaaataatttcgatatcgaaacatttaagatgtctcaaagtcgtaatttattgagaagcagaagtcaaaattatgcaatgattagattattaaattggtttaataaatag

SEQ ID NO: 559 - DNA, 588 bp, S.epidermidis
aagtttattggaggtaactccatgatattaataatagataactatgattcttttacctacaatcttgtagatattgtagaaaaacaatgtgaaacgattgttaaatatcccgatgatacagatatatgtaatctgaaaggtattacagcagttattatttcaccaggacctggacatccattagacaatcaattattaattaaattaattgaaaatttcgaaaatttacctattttaggtgtttgcttaggtgcacaagcgctcacttgttattacggtggcgatgttatacaaggtagttgtgtcaaacatggaaaagtagatactttaactattgttaatcagtcaccactatacaaaggaattaagtcaagtttcaaagttatgcgttatcattcattaattagtgatccatgctcatttccagaaagtttattaatcactggccaaacatatgatagtatacaatctttccaacacaaaaacagaaaacattatggcatacagtttcatccagagtcattcgctacagaaaatgggaaacaaatcattattaattttataaatatagcaacgagaggaagttga

SEQ ID NO: 560 - DNA, 930 bp, S.epidermidis
ggaaaggatgggagcactaagatgagtgtatttattgataaaaatacgaaagtaatggtacaaggtatcacagggtctactgcccttttccatacaaaacaaatgcttgattatgggacacaaattgttgcaggggtaacacctggtaaaggtggacaagttgtagaaggtgttccagtatataacactgttgaagaagctaaaaatgaaacaggagctaatgtatctgttgtatacgtaccagcaccattcgctgctgattcaattattgaagcagctgatgccgatttagacatggttatttgtattactgaacatatacctgttgttgatatggttaaagtaaaaagatatttacaaggtcgtaaaacacgtttagtaggaccaaactgtcctggtgtgataactgccgacgagtgtaaaatcggtattatgccgggatatatccataaaaaaggccatgtcggtgtcgtgtctcgttctggtacattaacgtatgaggcagtgcatcaattaactgaagaaggtatcggtcaaacaactgctgtaggtatcggcggtgatccagtaaatgggactaactttattgatgttttaaaggcgttcaatgaagattctgaaactaaagccgttgtaatgattggagaaattggtggtaccgcagaagaagaagcggcacaatggattaaagaaaatatgaacaaacctgtagtaggttttatcggcggtcagacagcacctccaggtaaacgtatgggtcatgctggagctattatttcaggaggtaagggtacagcatctgaaaagattaaaacattaaacgattgtggtgttgaaactgcagatacaccttctgaaataggaacaacccttattgatgcagctaaaaaagcaggcatttatgaagagttattaactattaaaaaataa

SEQ ID NO: 561 - DNA, 1275 bp, S.epidermidis
aacaagttcggcattccgaacttgttcttttttatactgtgtatgtctcctctaattataggaggactgaaattgaatagaagtgttttaaaatttggcggttcttccgtcagtgattttaaaaaaataaaaaatatcgctgaaatgcttaaaacacgcattgaagatggtgaagaattaatcgttgttgtcagtgctatgggtaagacaactgatcaattgatgaataatgtatcaagtcttacttctacccctaaagatcaagaacttgcattgctattaacaacgggtgaacaacaaacggtttcttacctttctatggtactcaatgatataggtgtaaatgctaaagcgatgacaggttatcaagctggcattaagactgtaggacatcacttaaaaagtaaaatagcagaaattaatcctaatatttttaatgaggcttttaaaaatcatgacattttagttgtagctgggtttcaaggtataaatgaagatttcgaacttactacacttggacgaggtggttctgatacaacagctgtagctttagcagcaagtaatcagacaccttgtgaaatttacactgacgttgatggtgtgtatgcaacagatcctagaatacataatgaagcgaagcgtttagaatatgtctcttatgaggaaatgatggaaatgagcgcgcttggtgcaggtgtacttgaaacgagaagtgttgaattagctaagaattatgatattccactttacttaggaagaacgttatcaaatgtgaaaggaacatggattatgtctaaaagtgatttattagagaaaaaagcagtaactggtgtcgcattggatacacacatgatgcacgtcacgataagttatcccctaccggataatcagttactgacacaattgtttaccgcattggaagaagaatctgtaaatgttgatatgatttctcaaattgtaaatttagaaggtttacaattatctttttcaattaaagatagtgatgcacatcaaatttcttcaattctggaaaatttatcaacacacttttcagcacttgattataaaattaatgaagcatatgtcaaaatatctttaattggatcaggtatgagagatatgtcaggagtagcatcaaaagcttttacgacacttatcaattcagatattccattttatcaaacgacgacatcggaaattagcatttcttatgtaatagacgaagaaaatggtgaaaaagcagtagaagaattgtatcatgccttcgaaatttag

SEQ ID NO: 562 - DNA, 831 bp, S.epidermidis
ctcttgaaaggagttctatactatatgactcagtataaaatggtagttttagatatggatgatactttaatgaatagtgataataaattatccattgagacaaaatcttacttattagatattcaaaagcgtggttattatgtggtattggcctcaggtagaccaacagaaggtatgttacctactgcgagagaattagagttaaataaatataacagcttcattattagttataatggaggtaaaactataaatatggctaatgaaaatgtagaggtcgatcagcctgtttcaaaggaagatttcgataatattgtagattattgtagagataagaactttttagtacttacttatgataatggatatatcattcacgatagtagtcatgaatatatgaacatagaatcacaacttaccggattaccaatgaatcgtgttgctgatttgaaggaatatattaatcatagtgtacccaaagttatgggtgtggattatgtaggtcatattaccgaagcacgtattgaattggatggttacttcaataatgatattgatgtgacaacgagtaagccttttttcctagagtttatggcaaagaatgtttcgaaggggaacgcaataaaagcactttgtaaaagattacaaatttctctagaagaagttatagtattcggggacagtttgaatgataagtcaatgtttgaagttgctggatattctgtagcaatgggaaatgctagtgatgaactcaagaaaattgctgacgaggtaactttagataataattctaacggtattccttatgctttaaaagaacttttggtttaa

SEQ ID NO: 563 - DNA, 1812 bp, S.epidermidis
atgagtgaaggtttacctttgagagaagaagttccggtaaaagaaacttgggatttgaaagatttatttacaagtgatcaagcattctatcaaacattggaacaagtagtacaaatgtctttagattttaatcatacatattatcagaaacttaataacatagaaacaatagaaaaggcattagatgaatatgaaaggatacttatagaaatagatcgtttatataattatccagaacttagattaagcgttgatacgtctaatgaagaagcacaaaaagttaacgcaaaacttaatacgacttctggaaaacttgctggtttattatcttttgttgattccgagattttggagttacccgatgagataataagcgaattgaggtctcaaacaaaataccctcattttattaaacaacttcaagatcgtaagccttatcaattatctgctgatgttgaaaaagtattagctacattaacaccaacattgagaagtccgtttgaattgtatggtactacaaagagtttggatattaattttgaatcgtttgattatgagggtgttacctatccattggattatgcaacatttgaaaatgaatatgaagatcatccatctcctgaatttagacgtaaaagttttagagcttttagtgatgcattacgacaatatcaacatacgacggccgcaacatataatatgcaagtccaacaagaaaagattgaagcggatttacgaggatatgattctgttattgattatctactacaagatcaagaagtaacaaaagatatgttcgatagacaaattgatgtcattatgagtgatttagccccagttatgcaaaagtatgcaaaaattattcaacgtgtacataacctggataaaatgcgatttgaggatttaaaaatttcaatagaccctaactttgaaccagaaatatcaattgaagaatcgaaaaaatacatttatggagcgctcaaagtacttggtgatgattatgtcaaaatgttagagtctgcctatgattaccgttggattgattttgctcagaataaaggaaaagatactggagcatattgtgcaagtccatacattacacattcatatgtatttatttcatggactgggaaaatggctgaaacattcgttcttgcgcatgaattaggacatgcaggtcattttacattagcgcagaatcatcaaaatttgttggaatctgaagcgtctatgtattttgtagaagcaccttccacaatgaatgaaatgttgatggcaaattacttatttaatagtagtaataatcctcgatttaaacgttgggttattggttcgattttatctcgaacttattatcataatatggttacccaccttttagaagcagcttatcaacgtgaagtgtatagccgagtcgacaatggagagtcattaactgccccactgctaaatgaaataatgttgaacacttataaagcatttttcggtgacactgttgaaatgacagatggggttgaattaacatggatgagacaaccacattattatatgggattgtactcatatacgtactctgctggattgacaattggtacagttgtatcacaatgtatcaagaaagaaggtcaacctgctgttgatcgctggttaaaaacgctacaagctggtggtagtcaatctccaattgaattggcgcaaatagctggcgttgatattacgactgacgcccctttaaaagagacaattaactatatttcaaatttagtagatgaattagaagtattaacatatcaaataaaagaaaattcataa

SEQ ID NO: 564 - DNA, 1425 bp, S.epidermidis
caatatggaggaatgttaaatatggatacaaatggaattaaattaaccccaaaagacatcgtatctaaattgaatgagtatattgtaggacaaaatgacgcaaaacgtaaggtggctattgcactaagaaatcgttatcgtagaagtcttttaaaagaagaagagaaacaagagattgcgcctaaaaatattttaatgataggtccaacgggagttggtaaaactgaaatagctcgacgcatggcaaaaattgttggagcaccatttattaaagttgaggcaactaaatttacagaagtcggttacgtcggaagagacgttgaaagcatggttagagatttagttgatgttgctgtacgtttagtaaaagacgggaaaaagtcattagttaaagatgaggcaactaagaaagcaaacgacaaattagttaaattacttgttccgagtttaaaaaagaaggcagcacaaggtaacaaccctttggaaaatttattcggtggagcaattccaaacttcggtcaaaatcaagatgaagaggaagaaccgccaactgaagaaattaaaaccaaacgttctgaaataaaaaaacaacttgaacagggcaaacttgaaaatgaaaaagtaagaattaaagtagaacaagatcctgcatcaatgggtatgttagggactaatcaaaatcaacaaattcaagatatgatgaatcaattgatgcccaagaaaaaagtcgaaagagaagtttcggttgaaacagctagaaaaatcttagctgatgattttgcagatgaattaattgaccaagaaactgcgaatcaacaagccttagagcttgcagaacaaatgggtatcatatttattgatgaaatagacaaggttgctactaacaatcaaaatagcggtcaagatgtgtcaagacaaggcgtacaacgagatattcttcctatacttgaaggtagcatgattcagacaaaatatggtactgtaaatactgaacatatgctatttataggtgctggtgcattccacgtatcaaaaccaagtgatttaattcctgaattacaaggtcgatttccaattagagttgaattagaaagtctttcagtagaagatttcgtgagaattctgacagaaccaaaattatcgcttgtcaaacaatatgaagcattgcttcaaactgaagaagttacagtaaatttctcagaagatgccattcaacgattagctgaaattgcatatcaagttaatcaagatactgataatattggtgctcgtagattacacactattctagaaaaaatgcttgaagatttatcatttgaagcaccaagcatgccgaatgctgttgtggatattactccacaatatgtagatgacaaattaaaatcaatctcaacaaataaagatttaagtgcatttattttataa

SEQ ID NO: 565 - DNA, 1185 bp, S.epidermidis
gaaacaggaggatggaagatgaatatccacgagtatcaagggaaagaaatatttcgttcaatgggcgttgcagttccagagggacgagtagcatttactgctgaagaagcagtggaaaaagcgaaagaattaaattcagacgtatatgtggttaaagcgcaaattcacgctgggggtagaggtaaagcaggcggcgtgaaaattgctaaatcattatctgaagtcgaaacgtacgcaaatgaactgctaggtaaacaattggtcacacatcaaactgggccagagggcaaagaggtcaaacgtttatatatcgaagaaggatgcgatatccaaaaagaatattatgttggttttgttattgatcgtgctactgataaagtgactttgatggcatcagaagaaggtggaactgaaattgaagaggttgcagctcaaacacctgaaaagattttcaaagaaacaattgatccagtagtaggattatcaccttaccaagcgcgacgtatcgcttttaatattaacattccaaaagaatcagttggaaaagcaactaaatttttattagcactatataatgtctttatcgaaaaagattgttctattgttgaaattaacccacttgttacaactggagacggtcaggtattggctttagatgctaaattaaactttgatgataatgcattatttaaacataaagatattttagaattacgagatttagaagaagaagatcctaaggaaatagaagcttctaaatatgatttatcatacatcgctttagatggagatattggttgtatggttaatggcgcaggtttagccatggcaacaatggatacaattaatcattttggtggaaatccagccaacttcttagatgtaggtggcggtgctacaaaagaaaaggtaactgaagcatttaaaattattttaggtgatgacaatgttaaaggtatctttgtaaatatttttggtggaattatgaaatgtgatgttattgccgaaggtattgtagcagcggttaaagaagttgaactaacattaccattagttgttcgtttagaaggaactaatgtcgaacgtggtaaagcaatattaaacgaatcaggtttagctattgagccagcagcaactatggctgaaggtgctcaaaaaattgtgaaacttgttaaagaagcataa

SEQ ID NO: 566 - DNA, 135 bp, S.epidermidis
acaccatttatttataataaatcagttgataaaagtcttttatatcatattttcagtgtgataatgtatggcgtctatagcataccaatattttcatacaaaattttaagagccttaaacactatggcatgttag

SEQ ID NO: 567 - DNA, 360 bp, S.epidermidis
atattacttataggagcacgtgcaatgacaatatttgatatgccaaactatttgtggattaccattcttggtatgattttattaactgtattttacacacttgtattaaataaatggttccagtctgcaatcattacttttgtagttttagcagtacttgccttttttataccaaattttcaaaacatttcatatcaaccactgcttggatatgcaggattcttaggcataatgagcttaatcataagctttcttatttggtatttttctagaaactggagaaaaaatcgtagaaaaataaaattggaaaaagagattcgcaaatatgatgatgaagagtcacttcgtcgtcataaataa

SEQ ID NO: 568 - DNA, 999 bp, S.epidermidis
ctatttattatgacaagattagcagtagccggagcaaccggattagttggaacaaaaatgttagagacactagatcgaaaacaaataccttttgatgaattagtattattttcttctgctcgctcagcaggaaaaaaagttgaatttcaaggacaattgtatactgttcaagaattaactgatgaagcagcaagtgaacattttgattatgttttaatgagtgcaggaggtagcacaagtgagcactttgctccactatttgaagcggctggagccattgttattgataattctagccaatggagaatggctgaagatgtcgatttaattgttccagaagtgaatgagcctcaatttacacgtggtattattgctaatccaaattgctctacaattcaatcagttgtacctcttaaaattttacaagatgcatatggtttaaaacgtgtcgcttatacgacttatcaagccgtatcaggttctggtgttaaaggtaaaagagatttagctgaaggtgctaatggaaaagaacctgaagcatatccgtatccaatttacaataatgtattaccacatatagatgtttttcttgaaaatgggtatacaaaagaagaacaaaaaatgattgatgaaacgaaaaaaattctcaacgaccaagacttaaaagtgactgccacatgtgtacgtgtaccagtacaagatagtcacagtattgaaatcgatgtgactttaaatcaagacactacagttaaagagatacaagaattatttgcacaagatcaacgtgttgttcttgtagataatccaagtaaaaatgaatatccattagccattcattctactggcaaagatgaagtatttgtaggacgtatccgccgagatgactctcttgaaaatacgttccatgtatggtgtacctctgataatttgctcaagggcgcagcattaaatgcagttcaagtgttagaacaaattttaactttgaaaggagcaagataa

SEQ ID NO: 569 - DNA, 1269 bp, S.epidermidis
atgggagttatgaagatgaagtttacgaatttgacagctaaagaatttagtgactttactgatcgtatgacatatagtcattttacacaaatggaaggtaattacgaattaaaggttgctgaaggtaccgagtcacatttagttggaattaaaaataatgataacgaagtgattgcagcttgtttattaacagctgttcctgtaatgaaaatatttaaatatttttattccaatcgcggtccagtaatagattataataataaagagcttgtacattttttctttaatgaattgagtaaatatgtaaaaaaatataattgtttatatttaagagttgacccataccttccatatcaatatttaaatcatgagggagaaataactggaaatgcaggtcatgattggatttttgatgaattagagagtttaggatataaacacgaaggattccacaaaggatttgatcctgtattacaaatccgatatcattctgttctaaatttagcaaacaaaagtgctaatgatgttttaaaaaacatggatggtttaagaaagcgtaatactaaaaaagttaagaaaaatggagttaaagtccgctttttatctgaagaagagttacctatatttaggtcatttatggaggatacctctgaaactaaagattttgcagatagagaagatagtttttattacaacagattcaaacattataaagaccgtgttttagtaccactagcctatattaactttgatgagtatatagaggaactaaataatgaaagaaatgtgcttaataaagattataataaagctttaaaagacattgagaaacgtccagagaataaaaaagcacataacaaaaaggaaaatttagaacaacaactcgatgcaaatcagcaaaaaattaatgaagctaaaaacttaaaacaagaacatggcaatgaattacccatctctgctggcttctttataattaatccgtttgaagtagtttactacgctggtggaacttcaaatcgttatcgccattttgcagggagctatgcggttcaatggaagatgattaactatgcaattgaacatggtattaatcggtataatttctatggtattagtggtgactttagtgaagatgctgaagatgctggcgtagttaagtttaaaaagggctatgatgccgatgttatagaatacgttggtgactttattaaacctattaataaaccaatgtataacatttatagaacacttaaaaaactaaagaaatag

SEQ ID NO: 570 - DNA, 792 bp, S.epidermidis
gtaatgactattttaaatgaaattattgagtataaaaaaactttgcttgagcgtaaatactatgataaaaaacttgaaattttacaagataacggaaatgttaagaggagaaagctgattgattcacttaactatgatagaacattatcagttattgctgaaataaaatcgaaaagcccatctgtacctcaattaccgcaacgtgatcttgttcaacaagttaaagattatcaaaaatatggtgctaatgctatttcaatattaactgatgaaaaatactttggcggtagttttgaacgattaaatcagttatcaaagataacatcgttaccagttttatgtaaagattttattattgataaaattcaaatagatgttgcaaaacgagctggtgcatctattattttattaatagtaaatattttaagtgatgaccaattaaaagaattgtattcatatgcaacaaaccataatttagaagctctagtagaagttcatacaattagagaacttgaacgtgcacaccaaattaaccctaaaattattggtgttaataatcgtgatttaaaacgatttgaaaccgatgttctacatacaaataaattacttaagtttaaaaagtctaattgctgctacatttcagagagtggcattcatacaaaagaagatgttgagaaaatagtagattcaagtattgacggtttacttgtaggggaggcattaatgaaaacaaatgacttaagtcagtttttgcctagtttaaagttaaagaagaatctctatgatagttaa

SEQ ID NO: 571 - DNA, 405 bp, S.epidermidis
aatatttatatgttgtataatcagaaatatattttaaaagaagggttatgctttatgttaaaagaatttaaagagtttgcactcaaaggcaatgttttagacttagctattgctgtagttatgggagcagcgtttaataaaatagttacatccctagtccaatacatcatcatgccattaattggtaaattatttggttcagttaattttgctgaagattggtctttttgggggattaagtatggacttttcatacaatcaataattgacttcatcataattgcttttgctttatttatctttgttaagatagctaatacagttatgaaaaaagaagagaaagaagaagaagtagaagaaaatactgttttattaacagaaattagagacttgcttaaaaaataa

SEQ ID NO: 572 - DNA, 1497 bp, S.epidermidis
atatattatattctgctaataaaggtggtaccgcgcgtcagcgtccttataacgaaggaggctgatttttttcggaaaaggaggaaatcaatggatattgtatacaaaaaggtgaatgctcaaattacgccagaagctttagcaaaattaaaacaaaaaaagatcatttttgaaagtacaaatcaacagaaacttaaaggtaggtactcgatagtagtattcgatcattatggcaaaattacattagataattctcaacttttaattaagttagacaatcattgtgaaatagttaagaatcaaccgtatcaacgacttaaggaatttgtagataaatattattttgaaatcaaagataaatatttaaaagatttaccttttatttcgggctttatagggacatgtagctttgatttagtacgacatgaatttaaaaaattacaagatattaaattagaagatcatcaaactcatgatgtccaattttatctagtggaagatgtatttgtttttgatcattataaagatgaattatatattatcgcaagtaacttattttctgatagaacaaaagagagattaaaggaatctattgaacgtaaaattgaagatttaaaaaacatacatttttcggttgaggatataaattataaatccatccctcgacatataaccaccaatatatcagagcaacaatttgttcaaactattagaattttaaaaaagaaaattactgaaggagatatgtttcaagtagttccttcaagaatttatagttataaacaccattttcaacacaatttacatcaattaacttttcagttatatcaaaatttaaagcgacaaaatcctagtccatatatgtattatattaataaagatgtaccgattgtaataggaagttctcctgaaagttttgtaaaggtaaaagatggaaaagtttatacgaatcctatagctggaacaattaaaagaggtcaaaataaaaaagaagatgaaaataatgaaaagacattaatgaaagatgaaaaggaattgagtgaacatcgtatgctcgtagatttaggaagaaatgatattcatcgaataagtaaaacaggcacttcacaaattaccaaactaatgacaatagaacgttatgaacatgtcatgcatatcgttagtgaagttattggagaattaaaaccccatctatctcctatgagcgtcatcgcaagtttgctaccaacgggtactgtctcaggtgcacctaaacttagagctatacagagaatatacgaatcttatccttataaaagaggtatctatagcggtggtgttgggtatatcaactgtaatcatcatttagattttgcattggctatacgtaccatgattatcgatgaggaaaaagtcagtgtcgaggcaggatgtggagtagtatatgattctattccagagaaagaacttgaagaaacaaaacttaaagctaaaagtttattggaggtaactccatga

SEQ ID NO: 573 - DNA, 4089 bp, S.epidermidis
caattgatttttcaattaaagataccaacaatcaagatgagtttcgctttaaaatatttcggacattgtattgatcaaacacgattgtcgccaaaagtgaaaggtcaattgaaacaaaaaaaactcattatgagtggaaatgtgttaaaagtcttagtttcaaatgacattgagagaaatcattttgatagggcatgtaatggtagcttggttaaagcatttagacagtgtggctttgaaattgataaagtcgtttttgaaacagattcaacaaatcacgatgatgaccttggctcgttagaagcacatattccacaagaagatgaacaaagtgcaagagaagcaactgaaaaattagaaaaaatgaaagcagaaaaagcgaaacaacaagataataatgaaagtacagtggaaaaatgtcagattggaaaaccaattcagattgaaaatataaaaccaattgaatcaattattgaagaagaattcaaagtagctattgaaggtgttatatttgatattaacctaaaagaacttaaaagtggacgtcatatagttgagcttaaagttactgattacacagattcacttgtattaaaaatgtttacaagaaaaaataaagatgacttggaccactttaaggcacttagtgttggtaaatgggttagagctcaaggtcgtattgaagaagatacttttgttagggatcttgtcatgatgatgtcagatattgaagaaattaaaaagacacctaaacaagataaagcagaagataagcgtgtagagtttcatttacatacgtctatgagtcaaatggatggtattcctaatattagtgcatatgttgaacaagctgctaaatgggggcaccaagctttagcagtaacagatcacaacgtagtacaagcttttcctgatgcacataatgctgccgaaaaacatggtattaagatgatttatggtatggaaggtatgctagtagacgatggtgttcctatagcttataaaccaacagaccgtaatttaaaagatgcaacatatgtggtgtttgacgtagagacaacaggtctttctaatcaatatgataaaattattgaattagctgcagtaaaagtgcataacggtgaaattatagataagtttgaacgttttagtaatccacacgaaagattatctgaaaccattatcaatcttacacatatcactgatgatatgttaactgatgctcccgaaattgaagaagtgttaactgaatttaaagagtgggttggagatgctatatttgtagctcataatgcttcatttgatatgggatttattgacacaggatatgaaaggttaggctttggaccttctacaaacggtgtaattgatacacttgagctttcacgtacaattaataccgaatatgggaaacatggtttgaatttccttgccaaaaaatatggtgtcgaattaacgcaacatcatagagcgatttatgatacagaagcaacagcttatatttttataaaaatggttcaacaaatgaaagaactaggtgtgaacaaccatctagaaattaataaaaaattaactaatgaagatgcatataaaagagctcgtccatctcacgttacactcattgttcaaaatcaagaaggtcttaaaaatttatttaaaatagttagtgcttcattagttaagtattattaccgtacgccaagaattccacgttctcttttaaatgaatatcgagaagggatcttgattggtacagcttgtgatgagggtgaattattcacagcagtaatgcagaaggatcagtcggaagtagaaaaaatagcaaagttctatgattttatagaagttcaaccgcctgcgctttatcaagatttaatggatagagaattaatacgagataatgaaacgttaacacaaatttacaagcgattaatagatgctggtaaaagcgctaatatcccagtgattgctactggtaacgcgcattatctatatgaacatgatgctatagccagaaaaattttaattgcatcccaaccagggaatccattaaatcgttcaacattaccagaagctcactttagaaccactgatgaaatgttagatgattttcacttcttaggtgaagaaaaagcatatgaaatcgttgtaacaaatacaaatgagctcgctaataaaattgaaaaagtggttcctataaaagataaactatttacgccaagaatggatggggctaatgaagaaattcgtgagttgagttattctaatgcgaaaaaactatatggtgaagatttaccacaaattgttatagatcgccttgaaaaggaattagatagtattattggtaatggcttttctgttatttacctcatatctcaacgtttggtgaagaaatcgctagatgatggttatttagttggatcgcgtggttcagttggttctagtttcgtagcaacaatgactgaaattacagaagttaatccgcttccaccacactacatttgttcacattgtaagacaagtgagttctttgatgatggttcggttggatctggattcgatttaccagataaaaaatgtcctacttgtggtaatgaattaattaaagaaggacaagatatcccttttgagacattccttggatttaaaggagataaagttccagatattgatttgaactttagtggtgaatatcaacctaacgctcataattacacaaaagtattgtttggtgaagataaagtatttcgtgctggaacaataggtactgttgctgaaaaaacagcttttggtttcgtaaaaggttacttaaatgatcaaggtattcacaaacgtggtgctgaaattgatcggttggttaaaggttgtacaggggtcaaacgtacaactggtcaacatcctggaggaatcattgttgtaccggattacatggatatttatgattttacaccgattcaattcccagcagacgaccaaagtgcagcgtggatgacaacccatttcgacttccattcaatacacgataatgtcttaaaattagatatattaggacatgatgacccaacgatgattcgtatgttacaagacttatcaggaattgaccccaaaactataccagtagatgataaagaaacaatgcaaatatttagtggtcctgagagtttaggtgttacagaagacgaaatattatgtaagacaggtacatttggtgtaccagaatttggtactggatttgtacgtcaaatgcttgaagatactaagccaacgacattctcagaattagttcaaatttcaggtttatctcatggtacggacgtttggttaggtaatgcacaagagttaattcgtcaagggatatgtgacttatctagtgtgataggctgtcgtgatgatatcatggtatatctgatgtatgctggacttgaaccgtcaatggcttttaaaacgatggaatttgtacgtaaaggtcgtggcttaacagatgaaatggttgaagcgatgaaggaaaataacgtgccagattggtatttagattcttgtcgtaaaattaaatatatgttccctaaagctcatgccgctgcttatgtactgatggctgtaagaattgcatactttaaagtacatcatccactatattattatgcagcatactttaccataagagcttccgattttgaccttataacaatgattaaagataaaacgagtattcgtaatacagttaaagatatgtattcacgatatatggatttagggaaaaaagagaaagatgtattaactgtattagaaataatgaatgaaatggcgcatcgaggttttcgattgcaaccgattagtttagaaaaaagccaagcttttgacttcatcattgaaggggatacattgattcctccattcatttcagtgccaggacttggagaaaacgttgcacaaagaattgttgaagcgagagaagagggaccatttttatccaaagaagatttaaataaaaaagccggcttatctcaaaaggttattgactatttagatgaattaggctcattgccagatttacctgacaaggcacaattgtcgatatttgatatgtaa

SEQ ID NO: 574 - DNA, 162 bp, S.epidermidis
ttaacatatatgttcactttaatgattaagttaaaatttgaaagcccatttcatctattatcatgtgctaatttacatctaccattagctttctgcttgctacaaaatataatgattactctatcaatcaaattatctgatttttctaattatttagtataa

SEQ ID NO: 575 - DNA, 1515 bp, S.epidermidis
aggagtcatatacctatggaaaaatatattttatcaattgatcaaggaactacgagttcacgtgcgatactttttaataaagaaggagaaattaaaggtgtttctcaaagagaatttaaacaacactttccacatccaggctgggtagaacatgatgctaatgaaatatggacatctgttctatcagttatggctgagttacttaatgaaaacaatattaatgcaaatcaaattgaaggtattggtattacaaaccaacgtgaaacgacagttgtatgggataaaaatacaggtcgtccaatctatcacgctatcgtttggcaatcacgtcagacacaagatatttgtacaaatttaaaggaacagggttatgaagaaacatttagagaaaaaacaggtttacttttagacccgtactttgcgggaactaaagtaaaatggattcttgatcatgttgaaggtgctagagaaaaagctgaaaatggtgatttactcttcggaacaatcgattcatggttagtatggaaattgtcaggacgtactgctcatattacagattacactaatgcaagtcgtacattaatgtttaatatttatgacctaaaatgggatgatgagttgttagaacttttaaatattcctaaacaaatgttacctgaagttaaagaatcaagtgaaatttacgggaaaactatcgactatcacttctttggtcaagaagtacctattgctggtattgccggtgaccaacaagcagcattatttggtcaagcatgttttgaccgtggtgatgtaaaaaatacatacggcacaggtggatttatgctaatgaatactggtgaagaagcagttaagtcagaaagtggcttgttaacaaccattgcatacggtttagatggaaaagttaattatgcacttgaaggttcaattttcgtatctggttctgctatccaatggctacgagatggtttgagaatgattaattctgcgccacaaaccgaaaactatgcttcaagagtagagtcaactgagggtgtttatatggttccagcatttgttggtttaggtacaccttattgggattcagaagcaagaggtgctattttcggattatctcgtggtacggaaaaagaacatttcattcgtgctacattagaatctttgtgctatcaaacaagagatgttatggaagctatgtctaaggactcaggtattgaagttcaaaatttacgcgttgatggtggtgctgtaaaaaataacttcattatgcagttccaagcagatatcgtaaattcatctgttgaaagacctgaaatccaagaaacaacagcacttggtgctgcatatttagctggattagctgttggattctgggatgataaagaggatatccgtgaacgttggaaacttcaaactgagttcaaaccagaaatggatgcagatcaacgtcataaactttatagtggttggaaaaaagctgttaaggcgactcaagtatttaaattagaagattaa

SEQ ID NO: 576 - DNA, 1176 bp, S.epidermidis
aaaaagcatatagaattaaaacgaacaaacgttcttatcaggaggataattatgaaaattgtacataccgctgattggcatctgggtaaaattttaaatggaaaacaattgcttgaagatcaaaaatatattttaactcagtttaaacaacatatggagaaagaacagccagatttaatagtaattgcaggtgatttgtatgatacctcatatccaagtaaagaagcgataggtttacttgaagagactattgaatacctaaatatagaacttaaaattccaataatcatgataagcggtaaccatgatggtagggaaagattgaattatggctctaaatggtttgagaataatcaactttacataagaactcaactagaaaatattgatgatccaatagaattgagtggtgttcaatttttcactttacctttcgcaactgtgagtgaagtacaaaattattttaaagataagcaaatagaaacatatcaacaagcattaaacgaatgcttagagcaaatgtctagttccatagataataataaggtgaatatattaattggtcatttaactattgagggcggtaaaacttcagattcagaaagaccattaactattggaacagtagaatcagttgatatgcattcttttcggttgtttgattatgtaatgctcgggcacctacatcatccatttagtataaataactcttttatcaaatatagcggttcgattttgcaatactctttctctgaagtaaatcaatctaaaggatatagagttcttgatattgaaaacaaccaactattaaatgaaaccttcgttcctttaaaacctctaagagaactagaagttattgaaggtgattatgaggatattattcaagaaagaattaaagtaaaaaataaaaataattattttcattttaagttaacgaatgtttctcatattactgatccaatgatgaaactgaaacaaatttatcccaatatattagcactatcgaatgtagtatttgatcatagtgagaattttagccatgttgaaatcaaaaaacaagatgatcagacaattatagaaaatttttataaaaatatgacagatcaacatctgagtcaagttcaatcagacaaaataaagcacttgttaagttttatattggatagggaggggtaa

SEQ ID NO: 577 - DNA, 591 bp, S.epidermidis
ggatttaatatgaatataccgaatcaaataacggtatttagagttattttaataccattttttattttatttgctttagttgattttggttttggacaaatttcaattttaggtggaaatcatattagaattgaaatattaattagtgctatcatatttgtggttgcatcattaagtgattttgctgatggttatcttgcccgtaaatggcaattagttactaatatggggaaattcttagatccacttgcagacaaattattggtcgcgagtgcattaattgttatggtacaacttggttttactaattctgtcgttgctatcataattattgctcgagaatttgccgtcacaggattacgattactacaaattgaacaggggtttgtaagtgctgcaggacaactagggaaaataaaaacagcagtgacaatggttgcaattatatggattttattgggcgatcctttcttacactatctacatttcccaattggagtgtggttattatacattggagtattctttactattctttcaggtattgaatatttttataaaggaagagatgtatttaaacattctaaataa

SEQ ID NO: 578 - DNA, 375 bp, S.epidermidis
cacaataatatgtatagtgaaaaagaaatcatacgaaaagtcgaaagtttagcagagaaaattggaaaactagaagttgttcaagattatcataatgtagaaaaacaaattcataataatcaagcaataaaacaaaagatgaatcgtttgaaagcgcaacaaaaacaatcggttaattttcaaaattatggaaaacaaaatgcactcgagcaatctgaagttaaaattcagaatctaaaagatgaaattaatgaattacctattgttgaagaatttcgttcagcacaatatgaagcgaatgatttactacaaatgatggtcaaaacaatggaagatagactcaatgaatataataaaaaagaacacaatgaataa

SEQ ID NO: 579 - DNA, 135 bp, S.epidermidis
gctttaatcataaaagtagtttctttgactggcgtaaaaataacgatgcaaagtaaaactgtaatcaataaaagaaatcttttaattgtattcacctactactttttactaatctctatcaccattaaagattga

SEQ ID NO: 580 - DNA, 315 bp, S.epidermidis
cacagaatcataggttggagtgataaattaatgagaaagaaaaaaattccaatgagaaaatgtattatatctaatgaaatgcgtccaaaaaaagatatgattcgagtggttattaacaaagaaggcgaaatctttgcagatgcgacaggaaaaaaacaagggcgcggtgcatatgtgtctaaagatgtagctttagttgaaaaggctcaacaaagagaagttttagaaaaatattttaacgctactaaagatacacttgatcctgtttataaagaaataataagactgatttatagagaagagatcccaaaataa

SEQ ID NO: 581 - DNA, 132 bp, S.epidermidis
ttaagaaccatagccataatcaaaataataattattatagataagataatcgttaaagacattactactcacccaaatcttttaatattaaattctatttgcaagataaattataaacttcttaaattttga

SEQ ID NO: 582 - DNA, 2613 bp, S.epidermidis
ggattcgccatgattaaaaatatatggaataaacctattaaacgttttacactaatcgttttagttagttgtatattgtcatttattctatatggcccttttctctatcaatttataactaaaggtatagtatttagtggtagtggagatggcttcagacaaatgatgccttttcaaatgtacctttatgaacacttcacatcattaaaaggattttatgatgcttcatttggattgggaggcgactatgttaaatcactggcatattattattcactatctccattgatgtggatcaacttctccatgatatggatattagaacaaactatcaatgtgaatcctcatgacatcagcttttggccaataaaccaattaatcatggcatatgtgcgcactgtaatcacatttattttttcattttatttatttagttatttgcgacttaaacccgcaccaatgtttatcgcaactattttatatggtatgtctactgttgttacatattataattttacttggtctttttacggtaatcttttaattatgttacctatgtcactttgggctatagaaagattctttaaagaacgtaaaataggttggtttattttcgcgattgcttatacattattctcaaacttttattttagttactatgaagcaattgtcataggtttctattttatttatcgattcgctattcctcatgagaaagatattgtgaatcgttggcagaaattatacatactcgtatgtgccactttgttaagtgtattagtaagtatttatggactatatactggtatatcttcctttttagataatgaccgagcgcaaaatcctaatttcaaaattacttttttcacaaatttatttgaaaccaattataatatttttgctgatggtttttacattacaatttcttttattgctatcattgcattattttgttttaaattatatcaacactattattataaattgttcgcaattgcaacttggattttacttatcggttccttttctcaatggtttgacagtgcatttaatggtttttcattaccccaaagacgttgggtttactttttagcattatcaacaagtgtattaattgcattgttcatacaacatttaagtgaaatatcaattaaagaatacacctttgttgctataccagtattcatatacggtttcatatttatcgcactgtcggaaagatcagtaaagtggatgtttgttgcattgattttaatcatagtgttatttatatttattaaatataaatcgttgttaacacgtacctcaatgatggtattactcgttgtcttatttttagctcaacaagtcttaatgactaatgattccagaaaaattactatcgaaccttatcaaacgactatcaaaacaattaatgattcgagctatagaagccctgtcctaaataaaaaaattaagtatatgcatcaaagctctacagatccattgaaaagattagattatttttcatactatgcattaaactcacctttgatatatcactacaacggcacatcattgtattccagtattttcgatggagatatattgaaatactatgaccagacgttacaaattaatatgcctgtagataaaaatagtacttatcgatatttaaataatcgtgcaaacttaatgtctctttgggatgttcaagatcgattacgacatcctgatgatttaaatatgccttatggttttaaaaagaaagaacttataactgataaaaaagatcaatggattcactctgttaatacaataaattatcctagtgcacacattactaataaaatttatgatgcaagaaaactaaaatctccccttgatagagagcaagctatgcttaaaggtgtcgtattgaatcataaatcccaagccaatactgattttaaacctaatcctaatttactttctaatgcaaaacaaaacttaaatcatgcgaattggattgatagtaaacatttaaaagttaaacagcacaatggtggcgtcaccctcaatttacttcgcaatatagttaaaaattataaagatatgtatattgaaatggatgttgaattactgtctcttgacaaagagcataaagtaggggttaatgaatattcgcaagaaagaaaccgtttgtcatacaaataccgtcgttttgtttcgccagtgacgatgcgtgctaaagcttcaaatcaacttaacattaagatgtcaaaaggagtttatcgttttaaagtaaaaggaatttatggtgaaaactatcaaacattaaaaaaagcttctcaacagctccaaccagttaaagtaaaaaaagaaagaaatggtttcacaattattaaaaagaaaaaagaacatggttatcttgtcttgccaatggtatatgctaaaggaatgcatgcaatggcaaatggaaagcctctaaaggttcaacaaggaaacggtattatgactactattcctgtaaaagagggacaaacaaagataaaattaagttatacccctccttatttttatttattaatcactgtcagttgcattgggatcattttaagcattcttttcactcattacgtaaaaagaaaataa

SEQ ID NO: 583 - DNA, 123 bp, S.epidermidis
gaatcatacatactaattgtacgtttatcgacagatatgtgtcaagatatgaaattgcactacactcattttaaattgctttttttaaagaacaaatcaaaaactacaaaaaaggatggctaa

SEQ ID NO: 584 - DNA, 156 bp, S.epidermidis
ctggtggtcttatcgatgaacaatcggaaattagagaagcaatttccaatggcgctaagtacgtcactacaagttacgagaaactttggtaatttgtatactgttaataagaatgtatttaagtttgttaatcaaggtattatcattttttcatag

SEQ ID NO: 585 - DNA, 147 bp, S.epidermidis
gtcttgaacataggtttcagttcgacaccgacaattgatgttaaaaacaaagcactaaaatgtttagatctttgttttaactttgtaaataaaatcgaaaaaattgatagttttctatcaattaaaaatcatcataatgaactatga

SEQ ID NO: 586 - DNA, 1290 bp, S.epidermidis
aacatgagcattttaattacgattatttcatttatcatcgtatttggtgtactcgtaactgttcacgaatatggacacatgttttttgctaagcgagcaggaattatgtgtcctgaatttgcgattggtatgggtcctaaaatttttagttttcgtaaagatgaaacattatatacaattcgtctattaccggtgggtggttatgtcaggatggctggtgatggtcttgaagaaccaccagttcaaccaggtatgaacgtaaaaataaagttaaataaccaagacgaaatcacacatataattctagatgaccaacataaattccaacaaattgaagccatagaagttaagaaatgtgattttaaagatgacctatatattgaaggtatcacttcttatgatgatgaaaggcatcacttcactatagcgaaaaaggcattttttgtcgaaaatggaagccttgttcaaattgctccaagagatagacagtttacacataagaaaccattgccaaagtttttaacattatttgcaggtccgttatttaattttattttagctttagttctatttattggattagcatactaccaaggtacgccaaccaatgtcataggagaagttgtgaagaaatctccagctgatgaagctggattgcacaaaggtgataaaatagttcaggtaggtaatcataaaattaaaaattttgatgatatcaaacatgttcttgaccaaaataaaacggcgaaaacaactgtaaaaattaaaagggatggccaaaacaagtctgtagatctccaacctaaaaaagtagagagaaagataactaaaactaaaactcaaacaacttatcaaattggttttgcccctactacagaacacagcgtttttaaaccaataagctacggtatttataactttttcgataaaggtaagcttatttttacagctgttgttggtatgttagctagtatatttacaggagaattttcatttgatatgttaaatggccctgttggtatttatcacagtgttgattctgttgttaaatctggaattattaatttagtaggatacaccgctttattaagtgttaacttaggaataatgaatttgctacctattccagcgcttgatggtggtcgcatattatttgtactatatgaggctatttttagaaaaccagtgaataaaaaagcggaaacaggaattattgctgtaggcgcactttttgtggttattattatgattttagtcacttggaatgatatacaacggtatttcttataa

SEQ ID NO: 587 - DNA, 165 bp, S.epidermidis
ttgattttaatagttttgaataagtttacaaatagtcatcgtagattttttatgaatagaaaaatgatttttatactaaatgatgcacgtgttaaacttaaagtggttgggttagctattataaagtataattatgaagttatagataaaagtttaagaaaataa

SEQ ID NO: 588 - DNA, 174 bp, S.epidermidis
catattataatatttaatattatctatcgatttaattacttagatgattttttaattaaacataaattcattagaggtgtagaacatgagcattttaattacgattatttcatttatcatcgtatttggtgtactcgtaactgttcacgaatatggacacatgttttttgctaa

SEQ ID NO: 589 - DNA, 126 bp, S.epidermidis
acaatagtaatagagctcattattgataagttgaaaataaaacttttatcggtatctaaatttgtgaaatttgaaggggaaaacttgattttattaatattgtctgtaatctttatgaccacgtaa

SEQ ID NO: 590 - DNA, 1026 bp, S.epidermidis
gtgaatacaattaaaagatttcttttattgattacagttttactttgcatcgttatttttacgccagtcaaagaaactacttttatgattaaagctcaaaatgatatacgtcatcaaattaatcgatggattgattctgattcaaatgacgataatactcaattagcgattcctaaaaagcaagaatttgcaatcaacaatatacagatgaatatgactaaaaaagatgttgaagcacaattgggacaacataagcgtatgacttcgagtgtgtatggcacaaattggtacacatattattcaaatgattataatcaatttttgatggtgagttatattaacaatcatgttaatgcactgtatacaaatcaaaatcttatttcatcaaaatctcaaattaagtatgatactcctaaagatgttgttagggaaagatatgggcccccgattcaagttataaaaaaagggaaagttggttttgatgtaaaaagtaatgaatatgatgttttccataaagaccatatttataccacagtattttatgataagcacagagataatggtgtgaagtcattattacaagttagtgagaaaatggaaaatcgattaagatatcaatatgggaaaccatctaaattacttgcaaagagttttgagttgcaaaattttgacattgtcaatgctgaaagaaaacagcatggcttaaaaacattagattattctaaggatgtttctcatactgcgcgtaagcatagtgttgacatggttaagcataattattttgaccatgtaaatcaaaagaaactttctccttttgatagattaaaaaaagatggaatagaatttaatgctgctggagaaaacttagcatatggacaattgaatagtatctatgcacatgaaggtttgatgaattcattggggcatagaaagaatattttaaacacccattttgattatttgggcgtaggtgtatatttcaatgatcgaagacaacccttttggaccgaaaattatacaagttaa

SEQ ID NO: 591 - DNA, 1212 bp, S.epidermidis
ttaatgaaaattcaaacagaagtagatgaattgggctttttcggtgaatatggtggccaatatgtacctgaaacattgatgccagctattattgaacttaaaaaagcatatgaggacgcgaaatcagatactcacttcaagaaagaatttaattattatttaagtgaatatgttggtagagaaacgcctttaacatttgctgaatcatacacaaaattgttaggtggtgccaaaatatatcttaaaagagaagacttaaatcacactggtgctcataaaattaataacgcgataggacaggcactattagctaaaaggatggggaaaactaaattagtagccgaaacaggtgctggtcaacatggtgtagcaagtgccaccatcgctgctttattcgatatggatcttattgttttcatgggaagtgaagatatcaaacgtcaacaacttaacgtatttagaatggaattgctaggagctaaagtagtgtctgtgtcagatgggcaaggaacactatcagatgctgtaaataaagctttgcaatattgggtgaatcatgtcgaggatacacattatttattaggctcagcgttgggacctgatccgtttccaactatggtcagagattttcagagtgtgattggtaatgaaattaaaagccaaattttaagtaaagaaggacgatttccagatgcgttagtcgcgtgtgttggtggaagatccaattcaataggtacgttctatccatttatacaagatgatgttaaattatatggggtagaagctgcgggaaaaggaagtcatacgcataatcatgctttagctatagggaaaggtaaaccaggtgtattacatggttccaaaatgtaccttattcaaaatgatgatggacaaattgaattggcacactctatatcagcgggactagattatccaggtattggacctgaacattcgtattataatgatattggtcgtgtatcatatgtaagtgctacagataatgaagctatggaagcacttataacattctcaaaagttgaaggtatcattccagcaattgaaagtgcacatgcattgagttatgttgaaaaattagcgccaaatatggatgaaaaagaaattattgttgtgactatttcaggtcgtggagataaagatatggaaacaattaaacaatacaaagaaaacggtggtgaacaaaatgagtaa

SEQ ID NO: 592 - DNA, 1152 bp, S.epidermidis
atacttgaaatgactcatatacaatattgttattctgaaaattctgaaacaaggaggcgctctatgcgaaatattttatttgtagggttaggccttattggcggtagcttggcgagtaatttaaaatatcattacagtaatttcaatattcttgcatacgattcggactacacacaacttgatgaagccctttctataggtattattgatcaaaaagttaatgattatgctactgctgttgagatagcggatataatcatctttgcaactcctgttgagcaaacaattaaatatctatctgaacttacaaattacaatacaaaaactcatttgattgtaacagacacaggtagtaccaaacttactatacaatcattcgaaaaagaattattaaaacatgatattcatttaattagtggtcatcctatggcaggaagtcataaatctggtgttttaaacgcgaaaaaacatttatttgaaaatgcttattacattcttgtatttaatgaaatcgaaaataatgaagccgcgacatatttaaagaaattacttaaacctacgttagcaaaatttatcgttactcatgcaaatgaacatgatttcgtaaccggtatagtgagtcatgttccacatatcatcgcttcaattttagttcatctaagtgctaatcatgtcaaagaccattctttaatcgaaaaattagcagccggtggctttagagatataactcgtatagcaagtagtaatgctcagatgtggaaggatatcactttaaataatcaaaatcatattttatctttacttaacgagattaaagaacaaattactggtattgaaaatttgatacgagaacaaaatagtaatagtatttacgatttcttcgttaaagctaaagattatcgtgatcaacttcctgttaaacaacacggtgcaatatctactgcgtatgatctttatgttgatatccctgataagccgggtatgataagtcaaattacaaacatcataagttcacataatatttctattataaacttaaagattttagaagtacgggaagatatttatggagctttacaaatcagttttaaaagtcccgaagatcgagagaatgctataaaagccctcgcaaattttgatacttattattaa

SEQ ID NO: 593 - DNA, 582 bp, S.epidermidis
atgactgaaatgacaaagccttttttaatcgttattgtaggtccaactgcttcaggtaaaactgagttaagtattgaagttgctaaaaaatttaatggagaaattattagcggagattcaatgcaggtctatcaaggaatggatattggtacagcaaaagttacaactgaagaaatggaaggtataccacattatatgatagatattttgcctccagatgcttccttttctgcatatgaatttaaaaaaagggcagaaaaatatattaaagatattactagaagaggcaaggtgcctattatagcaggaggaacaggactatatatacaatctctcttatacaactatgcttttgaagatgaatccatatctgaagataaaatgaaacaagttaaattaaagttaaaagaacttgagcatctaaataataataagctccacgaatatttagcttcattcgacaaagaatcagccaaggatatacatcctaataacagaaaaagagtgttgcgagcaatagaatattatttgaaaacaaaaaaacttttaagtttctcgcaagaaagtgcaccaatttactga

SEQ ID NO: 594 - DNA, 123 bp, S.epidermidis
atgaaccgaatgttaaatataaaaggtgaagtaaaacgacctatttttctaaaaataaaaagaaatagatataaagatataaatgggagttatgaagatgaagtttacgaatttgacagctaa

SEQ ID NO: 595 - DNA, 204 bp, S.epidermidis
caaaggagaatgttgattatgccaatcattaatgtgaaattattagaaggccgttctgatgaacaacttaaggatttagttacagaagtcactcatgctgtagaaaaaactacaggtgcaaataaagaagcgattcacgtggtcattgaagaaatgagaaaagatcattatgctgtcggtggcgtaagaaaatctgatcagtaa

SEQ ID NO: 596 - DNA, 615 bp, S.epidermidis
gtttttatgatgatcatcgtcatgttaatcttgagttatctgattggtgcattcccaagcgggttaattattggtaaattattttttaaaaaagatataagacaatacggtagtggaaatactggagcaactaacagttttcgtgttcttggaagaccagctggatttatagttacgtttttagatattttcaagggatttattacagtcttttttccactatggttcccagttcatgcggatggtgttataagcaccttctttacaaatggtttaatagtaggattgtttgcaatactcggtcacgtgtatccaatatatctgaaatttaatggcggaaaagcagtagctaccagtgcaggagttgtattaggtgtcaatcctattttacttcttatcttggcaattatcttttttagtgtattaaaaatctttaaatatgtttctttatcaagtatcattgcagcaattagttgtgtgattggttcaatcatcattcatgattatattttacttgctgttagcggaattgtttcaatcatattaataattcgacacaaatctaatatagttagaatttttaaaggagaagaacctaaaattaaatggatgtaa

SEQ ID NO: 597 - DNA, 372 bp, S.epidermidis
tttattatgatatcgcttgttataactgaggatcaattgatgttaagaaaagctatggtacaactgatagaaatgcatgaagaaatgaatgtaataaaagattttgaaaatggtgtagaggcactcgaatttattgaaaataatgaacccaatgtagccattttagatattgaaattccgggtttaacaggcttggaaatcttatcttatgtaagaaaaaaacaactcaatacaagaataatcatagtgactacatttaaacgtccaggttattttgaaaaagccgtagcaaatgatgttgatgcttatgtactaaaagagcgttcaattgatgatttaattaaaactatttataaagtgacaaagggttga

SEQ ID NO: 598 - DNA, 240 bp, S.epidermidis
tattggatgattttaaaatacaaatataaatttttaacatatatgacaatagtcatagtatgttgtattattttttcaaatttctttttaagcgttaaccaaggtgttcaatcagaacaaacgtacgaaatgactgaccacaagattcatcaacataatcaacaaggaactactcaaaactataaagacaaacaaaatagcgaacagaatgatcagtctgtgttcgcattagttaattaa

SEQ ID NO: 599 - DNA, 393 bp, S.epidermidis
gtgaaaacgattggtgaagtgttgaaaagtagacgtgaaagattgggtatgacactaagtgaattagaacaaagaactcagttaaagcgtcaaacgttaatacatatagaaaataatgattttaatgaactagccaagagtgattatactgaaggttttattagaaaatacgctaaagttgtaaatatcgaaccaaatcaacttattgaagcacatcaagatgagattcctgaaacacaatatcaaattgatgatgtgatacaaacattttctaatgggtatgaacccccttaccgacgtcaatctaaggaagcgtttcaattgttgatgtggatgggtttcattattttaatatctttaatcgtttggatactcgcagtattaattatataa

SEQ ID NO: 600 - DNA, 801 bp, S.epidermidis
acagagacgatcaggctcggaggaaagaccatgtttaaaaagctgaaaaataaaaataaaactgagacaaaccataataatgacttagacatacataatatacctgaacatgtggctattatcatggatggaaatgggcgttgggcaaaaaaacgtaaaatgcctagaattaaaggccattatgaaggtatgcaaacaatcaaaaaaattactcgcgaagcgagtgatataggtattaagtatttaacattatacgcattttcaacagagaattggtctagacctgaaagtgaagttaattacattatgaatcttccagtgaatttccttaaaacatttctaccagaattaattgaaaagaatgttaaaattgaaacaatagggttttatgaaggtttaccacaatctacaattgatgctattgattttgctaaagctaagactcagcacaatactgggttaactcttgtgtttgctataaattatggtggacgagctgagattattcagagtatgaaagcaatatataacgaattacaattaaacggacaaggatctgaagtgattgatgaggcgttaataaagcgtcatttaatgactcatagttatccagatccagacttattaatacgcacttcaggagaacaaagaataagcaatttcttaatatggcaagcttcatatagtgaatttatttttaatgaaaagctatggccagattttgatgaaaaagagttaagagagtgtttgaaaatatatcaatcacgccaaagacgttttggaggattaagtgaggagtaa

SEQ ID NO: 601 - DNA, 867 bp, S.epidermidis
ctcatggcgatacaatggtatccaggtcatatggctaaagccaaaagacaagttagtgaacaactgaaaaaggtagatgtagtttttgaactcgtcgatgcacgtattccatacagttcgagaaaccctatgattgatgatgtcattaaacaaaaacctcgagtagtaattttaaataaaaaagatatgacgaatttaaaagaattagaaaaatgggaaatttattttaaaaatgaaggtttctatccggtagctgtagatgcaaaacatggcaagaatcttaaaaatgttgaagttgaagctataaaagcaactcaagaaaaatttgatcgtgaaaaagccaaaggtttaaaacctagagcgataagagctatgattgtaggcattcctaatgtaggaaaatcaacacttatcaataagttagcaaaacgtagtatcgccgaaactggaaataaaccaggagtaacaaaacagcaacaatggattaaagttggaaagtctcttcaattactagatacaccaggtattttatggcctaaattcgaagatgaagaggtcggtaaaaaattaagtttaactggtgcaattaaggatagtatcgttcatttagatgaggtagctatttatggtttgaattttatgattaaacatgatgtttcagctttaaagagacattataatattgatacacatgaagacgctgagatactcgattggtttgatgcaattggaagaagaaagggattgttacaaaaaggaaatgaagtagattatgaatctgtcattgagttgatcatcaatgatatgagaaatgcaaaaattggaacttattgttttgatattttaaaagaaatgaagagtgaatga

SEQ ID NO: 602 - DNA, 1359 bp, S.epidermidis
aattggaggatttataccatgccaaaacgtagttttacaaaagatgatattcgtaaatttgctgaagaagaaaacgtaagatatttaagattacaattcactgatattttagggactattaaaaatgttgaagttccagtaagtcaattagaaaaagtattagataatgaaatgatgtttgatggttcatctattgaaggtttcgttcgtatcgaagaatcagatatgtatttacatcctgatttagatacttgggttatcttcccttggactgctggacaaggaaaagttgcacgactaatctgtgatgtatttaaaacagatggtacaccatttgaaggtgatccacgagctaacttgaagcgtgtattaagaagaatggaagatatgggctttactgattttaatctagggcctgaaccagaatttttcttatttaaattagacgaaaaaggcgaacctacattagaattaaacgatgatggtggttatttcgatttagctcctacagatttaggtgaaaattgtcgccgtgacatcgttttagaattagaagatatgggctttgacattgaagcaagccaccatgaagtagcgccaggtcaacatgaaattgactttaaatatgcagatgccgttacagcatgtgataatatccaaacatttaaactagttgttaaaacaattgcacgtaagcataatttacatgcaacatttatgccaaaaccattatttggtgtaaacggtagtggtatgcacttcaacgtatcactatttaaaggaaaagagaatgcgttctttgatcctgaaggtgatttacaattgactgatactgcatatcaatttacagctggtgtccttaaaaacgctagaggattcactgcagtatgtaatccaattgtcaactcatataaacgtcttgtaccaggttacgaagcaccatgttatattgcatggagtggtaaaaaccgttcacctttagtacgtgttccaacatctagaggtctatcaactcgtattgaagtacgctcagttgaccctgcagctaacccgtacatggcattagcagcaatcttagaagcagggttagatggaattgagaataaacttgaggttccagaacctgtaaaccaaaatatctacgaaatgaatcgtgaagaacgagaagcggttggtatccaagacttaccttcaactttatacactgcgttaaaagcaatgcgtgaaaataaatcaattaaaaacgcattaggtaatcatatttacaatcaatttattaactcaaaatcgattgaatgggattactatagaactcaagtatccgaatgggaaagagaacagtatattaagcaatactaa

SEQ ID NO: 603 - DNA, 153 bp, S.epidermidis
tcgatatacttcaatgtgccttgtattacttcggcgaggttatgcggcgggatatcagtagcatatcctgaagaaatccccgtagatccattaattaataaattagggaatctcgctggtaataccattggttccaaagttgtgtcatcatag

SEQ ID NO: 604 - DNA, 1470 bp, S.epidermidis
gagggattcgttttgcaagattttgataacttaattcctggctggtttaaaacatttgttcaagtcgggaatgacttaatttggtctcaatatcttattggattattattaacagcaggttttttctttacaattagttctaaatttattcaactcagaatgttaccagagatgtttagagcattaactgaaaagccagaaactttaagtagtggtgagaagggtatttcaccatttcaagcttttgcgattagtgctgggtcaagagtaggaactggaaatattgccggtgttgcaactgctattgttcttggtggccccggtgcagtcttctggatgtggattattgcttttattggtgcagctagtgcatttatggaagcaacgcttgctcaagtttataaggtacatgacaaagaaggtggattccgtggcggaccagcctattacataacaaaagggctaaaccaaaaatggcttggaattgtatttgctgttttaattacagttacatttgcttttgtatttaatactgttcaagcgaatacaattgctgaatcattaaatacacaatacaatattagcccggtaattactggaatagtacttgcagttattacaggtattatcatctttggtggtgttcgtagcatagctacactatcttcacttattgtgcctattatggctattgtttatataggtatggttttaatcattttattactcaatatagatcaaattgtacctatgattggcactattattaaaagtgcattcggagttcagcaggttactggtggtgctgtaggagctgctattcttcaaggtattaaacgtggtttattctcaaacgaagctggtatgggatctgcacctaatgctgctgctacatctgctgtgccccatcccgttaaacaaggtttaattcaatcattaggtgtattctttgacactatgcttgtttgtacagctacagcaattatgattttattatattctggtttgcaatttggtgatagcgcgcctcaaggtgtagcagttacgcaatcagcgttgaacgaacatttaggttcagcaggaggtattttcttaactgtagcagttaccttatttgcattttcatctgttgtaggtaactattactatggacaatccaatattgaatttttatctaacaataagatgatattatttatttttagatgttttgtagtacttttagtatttgtaggtgctgttgctaaaacagaaacagtttggagtactgccgatttatttatgggtcttatggcaatagtaaatatcatatcaattataggtttgtcgaatattgcgtttgcagtgatgaaagattatcaaagacagcgtaaagaaggtaagagacctgtgtttaaacccgaaaacttagaaataaatttatttggcattgagacttggggacaacatgcaaaaatgccaaaaaaatag

SEQ ID NO: 605 - DNA, 2031 bp, S.epidermidis
cgaacgtacgtttgtaggagggcgaaatcattggcaatgaataaacaaaataattattcagatgattcaattcaggtacttgaaggactagaagcagttaggaagagacctggtatgtacattggatcaactgataaacgaggattacatcatcttgtatatgaagttgtcgataactccgtcgatgaagtattaaatggttatggtgatgcgattacagtaacaattaatcaggatggtagtatttctatagaagataatggtcgaggtatgccaacaggtatacatgcgtctggcaaacctactgcagaagttatatttactgttttacatgctggaggtaaatttggacaaggaggttataaaacatctggaggtctccatggggtgggtgcttctgtagtaaatgcccttagtgaatggcttgaagttgaaattcatagagatggtaatatctacacacaaaatttcaaaaatggtggtattccagcgacaggtttagtaaaaactggaaaaacaaaaaaaactggtactaaagttacatttaaaccagactcagaaatatttaagtcaacgacgacttttaattttgatattttaagtgagcgtttacaagaatctgcatttttacttaaagatttaaaaattacacttactgatttacgtagtggaaaagaacgagaagaaatttaccattacgaagaaggaattaaagaatttgttagttatgtcaatgaaggtaaagaagtattacatgatgttactacatttgcagggcattccaatggaatagaggtagacgtagcattccaatataatgatcagtactctgagagcatattaagttttgtaaataatgttcgtacaaaggacggaggtactcatgaagttggtttcaaaacggcgatgactcgtgtttttaatgaatatgcacgtcgtataaacgaactgaaagataaagataaaaatttagacggtaatgatatacgcgaaggtttaacagcgataatttcagtacgtataccagaagaacttcttcaatttgaagggcaaacgaaatcaaaacttggcacttcagaagcaaggagtgctgtagactctgttgtttcagaaaaattaccatattacttagaagaaaagggccaattatctaaatcattagttaaaaaagcaattaaagctcaacaagcacgcgaggctgctcgtaaagctagagaagatgcacgctccggaaagaaaaataaacgtaaagatacattgttatcaggtaagttaactcctgcgcaaagtaaaaatactgataaaaacgagttatatctagttgagggtgattcagcgggaggttctgcaaaattgggacgcgaccgtaaattccaagctattttacctcttcgtggaaaggttattaatacagaaaaggcacgtttagaggatatttttaaaaatgaagaaattaatacgattattcatactattggtgctggtgttggtactgactttaaaattgaggatagtaattacaacagaattattatcatgacagatgctgatacggatggtgcacatattcaagtattattgcttacatttttctttaaatatatgaaaccacttgttcaagctgggcgtgtctttattgcgttaccgcctttatacaaattagaaaaaggcaaaggtaagaataaaaaagttgagtacgcttggactgatgaagaattagaaaatttacaaaagcaattaggaaaaggtttcatattacagcgttataaaggtcttggtgaaatgaatccagaacaattatgggaaactaccatgaatccagaaactcggacattaattagagttcaagttgaagatgaagttcgttcatcaaaacgtgtcactactttgatgggggataaggttgccccacgaagagagtggattgaaaaacacgttgaatttggtatgcaagaagatcaaagcattttggataataaagaagtccaaatactagagaatgaaaaatatattgaggaggaaacgaattga

SEQ ID NO: 606 - DNA, 1035 bp, S.epidermidis
ttcatatttttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgatagaatagggatcgcttttgctgcatcagtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcatacgaaactttacaccattatttattctagctatcatctatattgctcataaattaatcaaacggacacattttgtcaaactggaagaaatagatttaactccgcataattacaagaattaa

SEQ ID NO: 607 - DNA, 1485 bp, S.epidermidis
gagtatttagtaatgaattttggatttttgggtactattttaactatattgttagtagttgggtttataactaacgtagtattggcatttgtcatcattttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattacatgcatttgaagatttagttcaagaccaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatctagagtactatacctttgaacttgatggattaggtaaaagaatcttagatgcacttgaaactaaacttaaagaaggtttagaagttaaacttttgtatgacgatgttggttctaaaaaggttagattatcaaaatttaaacatttcagagcattaggtggagaagttgaagcatttttcccttcgaaagtacctttaatcaatttcagaatgaataatcgaaatcatagaaagattatcattatagatggacaaattggttacgttggcggttttaatgtcggcgatgattatttaggattaggtaagttaggttactggagagatacacatacacgtgttcaaggtgaatgcatcgatgcactacaattaagatttattttagactggaattcacagtcgcatcgtccacaatttaaatttgatcaaaaatatttccctaaaaaaaatggggacaaaggaaacgcggctattcaaatcgcttctagtggacctgcatttgatttacatcaaatagaatatggttatacaaaaatgataatgagcgctaaaaagtctatctatctacaaagcccttactttattccagaccaatcatacattaatgcattaaaaatggctgctaatagcggcgttgaagtaaaccttatgataccgtgtaaacctgatcatccattcgtttattgggctacattttcaaatgcagctgatttattggatagcggagttaatatttacacttatcaaaatggatttattcattctaaaatattaatgattgatgatgaaatttcttcaattggtagtgcaaacatggactttagaagctttgaactgaatttcgaagtgaatgcatttatatatgatgaagatatagctaaacagttacgtcaagcatttgaaaaagatattgagcaatctaaattacttacaaaagaagtatacgacaagcgtccattatcaattaaatttaaagaaggactagcaaaattaatatctccaattttataa

SEQ ID NO: 608 - DNA, 438 bp, S.epidermidis
attgaactagttaaacttagagatgatgttggtgaactaccagcagctaaagaaacgatcattgtttcacctattgctcttgatatacctaatacaattgaagcaacaacgccagaagtcgcagctggtaatacaacttttgtagcgacttcaaatttagttgcgcctaatccaaatgcaccttcacgaattttatcaggtacagatgacattgcatcttcactcatacttgtaatcatagggacaatcattatacccacaacaataccgggactgattgaattaaactctcccaagttaggaattagatttctcaatataggtgtaacaaatgtcaaagcaaagaagccaaatacaattgtaggaatcccagccaaaatttctaatattggtttaatgattctacgtgaacgatcagatgcatattcattaaggtag

SEQ ID NO: 609 - DNA, 348 bp, S.epidermidis
tgtttaatagttttaaatttagtattaattaaggtggttattattttggcaatgacaaatcgagaaaagtttaaagtgcttgccgatcaaataaaaatatcaaatcaactagaacaagatattcttgaacaaggtgaactcactcgtatagatgtttcaaataaaaacagaacatggactttccaaatatcactcccacattttttatctcatgaagattatcttctttttacacatgcaattgaagaagaatttaaagaaatagctacagtagcaattgatttttcaattaaagataccaacaatcaagatgagtttcgctttaaaatatttcggacattgtattga

SEQ ID NO: 610 - DNA, 1074 bp, S.epidermidis
ctttctgtagtaggaggtctcgttttggataatgaacgtcaaaaagctttagatacagtaattaaaaacatggaaaaatcttttggtaaaggtgccgttatgaagttaggcgataataaaggtcgcagagtatcaagcacttcaagtggttctgtcacagttgataatgcattaggggttggaggttatcctaaaggaagaattatcgaaatatatggacctgaaagttcaggtaagacgacagtagctttacatgctatcgctgaagtacaaaaaaacggtggtgtagcagcatttatcgatgccgaacatgctctcgatccagtatatgcacaagcattaggtgtagatattgataatttatatttatctcaacctgatcatggtgaacaaggtcttgaaatcgccgaagcttttgttcgtagtggtgctgtggacattgttgttgtcgattcagtagcagcattaacacctaaagctgaaattgaaggtgaaatgggagatactcatgttggtttacaagcaagattaatgtctcaagcattaagaaagttatcaggggctatttctaaatctaatactacagctatatttattaaccaaattcgtgaaaaggtcggtgtgatgttcgggaatcctgaaacaacgcccggtggtagagccctaaaattctatagttctgtacgtttagaggtaagaagagcagagcagttaaaacaaggtcaagatattgtaggtaacagaaccaaaataaaagttgtaaaaaataaagttgcacctccatttagagttgcagaagtagatattatgtatggtcaaggtatctctaaggaaggagagctcattgatttaggtgtagagaatgatatcgttgataaatcaggtgcttggtattcttataatggagatagaatgggccaaggtaaagaaaacgtcaaaaattatcttaaggaaaatccacaaatcaaagaagaaattgaccgtaagttacgtgaaaagttaggtattttcgatggtgatgtggatgaaaatgagaatgaagacgattcaccaaaaactttatttgatgaatag

SEQ ID NO: 611 - DNA, 147 bp, S.epidermidis
aaaaatggcttttttttccatttatttctttttcatttttcattaaattcaccacgccttaaaaatacatctatttactttttaatttattgtaaaaataagcttaaaaacacaatatttatcttaccacaaataacaatactctaa

SEQ ID NO: 612 - DNA, 1608 bp, S.epidermidis
atgttacaagtaactgatgtaagtttacgttttggtgatcgtaaactatttgaagatgtaaatataaaatttacagagggtaattgttatggattaattggtgcaaatggtgctgggaaatctacattcttgaagattttatcaggcgaaattgattcacagactggtcatgtatctctaggtaaagatgagcgtttggctgtgttaaaacaagatcattttgcttatgaagatgaacgtgttttagatgttgtgattaaaggacatgaacgtttgtatcaagtgatgaaagagaaagatgaaatttatatgaaacctgatttcagcgatgaggacggtattcgcgctgcagaacttgaaggagaatttgcagaaatgaacggttggaatgctgaagctgatgctgctaacttattatcaggattaggcatagaacctgacttacatgataaaaatatgtctgaacttgaaaataatcaaaaagttaaggtattgttagctcaaagtttatttggtgatcctgacgttcttttactagatgagcctaccaatggtttagatataccagcaataagttggttagaagactttttaattaattttgaaaatactgtcattgtcgtttcgcatgaccgtcacttcttaaataatgtttgtactcatattgctgatttagactttggcaaaattaaactttatgttggtaactatgatttttggtatcaatcaagtcaattagcacaaaaaatggcacaagaacaaaataagaaaaaagaagaaaaaatgaaagagttacaggatttcatcgcacgcttctcagcaaatgcttctaaatctaaacaggcaacaagtcgtaagaaacaattagaaaaaattgaattagatgatatccagccatcatctcgtagatacccttacgtgaaatttactcctgaacgtgaaattggaaatgatttacttacagtagaaaatctttctaaaacaattgacggcgaaaaagtactagacaatgtttcattcactatgaatcctaatgataaagctattttagttggtgatagcgaaattgctaaaacaacattgttaaaaattttagctggagaaatggaaccagatgaaggtacatttaaatggggtgtaacgacatctttaagttacttccctaaagataactctgagttctttgatggtgtcgatatgaatttagttgaatggttacgtcaatacgctccagaagatgaacaaactgaaacatttttacgtggtttcttaggtcgcatgttatttagtggtgaggaagttaagaaaaaagcaagcgtgctttcaggtggagaaaaagtacgttgcatgttaagtaaaatgatgttatcaagtgctaacgtacttttacttgatgagccaacaaaccatttagatttggaaagtatcactgctgtaaatgacggattaaaatcatttaaaggttctatcatcttcacttcttatgattttgaatttattaatacaatcgcaaatcgagtgattgacttgaatcaagctggtgccctttctaaagaagtaccttatgaggaatacttacaagaaattggtgtattacaaaataattaa

SEQ ID NO: 613 - DNA, 786 bp, S.epidermidis
aaaatgaaagtaagaacattaaccgcgattatagccttattaatattcttgcccatcttgctcaaaggtggcttaatattaatgcttttcgcattcttattagctttgatagccttaaaagaactacttaatatgaatatgatcaaatttttatctatacctggtctgattagtgctttagccctaattattatcatgttacctcaagatgcaggtgaatgggttcaagttatccaacttaaaggtttaattgctatgagtttcatagttttaagttatacagtgctatctaaaaacagatttagttttatggatgctgcattttgtttgatgtctgtagcatacgtaggaattggcttcatgtatttttatgagacacgttctgagggcttgagatatattttatttgcatttttaatagtttggctaacagatacgggtgcttatatttttggtcgccttatgggtaaacataagttatggccagtcattagccctaataaaacaattgaaggtttctttggtggtattttatgtagcattttagtaccattagtgatgcaaatgtttgtagatttacatatgaatatttggcttttactattagtcacaattgttttaagtatgtttggtcaattaggtgatttagtagaatctgggtttaaacgtcattttggtgttaaagattcaggacgtatactaccaggacatggtggtatattagatagatttgatagcttcatgtttgtattaccgctattaaatattttactgatacaaacttaa

SEQ ID NO: 614 - DNA, 744 bp, S.epidermidis
atcaaaggagttattcaacttatggtacaacatttatcagctcaagaaatcattcaatatattagtgatgctaagaaatcaacaccactcaaagtttatgtaaatggtcattttgaaaatgtcacattcccagaatcttttaaagtttttggctctgaacattcaaaagtaattttctgtgaagcagatgaatggaaacaattttatcaacaaaatcattcattaatcactgaattagaaattgagatggatcgtcgtaattcagctataccgcttaaagatttaacaaacacaaatgctcgtattgagccaggtgcgtttattcgtgagcaagcaatcattgaagatggtgctgtggttatgatgggtgctacgattaatattggagctattgtaggagaaggaacaatgatagacatgaacgcaacacttggtggacgagctacaacaggaaaaaatgttcatgttggtgcaggtgctgttttagctggtgtcattgaacctccaagtgcttccccagttgtcattgaagacaatgttttaattggagcaaatgctgttattcttgaaggtgtacgcgttggtgcaggtgctattgtagcagctggagctattgtaactcaagatgtgccagctggagctgtagttgctggtacgcctgctaaagtaattaaacaaacttcagaagttcaagactcaaaacgtgagattgtgtctgcactgcgtaaattaaataatgaataa

SEQ ID NO: 615 - DNA, 258 bp, S.epidermidis
ataaaaggagttctaaccatgattgcaaacgaaaacatccaagaccaagcactagagaactttaaatcggaaaaaactgaagtcacaattttctttttaaatggctttcaaatgaaaggtgtcgttgaaaattatgacaaatatgttgtaagtttaaattctcagggtaagcaacatctgatttacaaacatgcgatcagcactttcactgtagataatgaatcgtctgaagcaactgaagtgaatagtgaagaataa

SEQ ID NO: 616 - DNA, 552 bp, S.epidermidis
tgtaggggagttttaattatgaaagagaatattttgccagctattagaaatatgagagatttagaaaagttaattaaaacagactacaaagcatgtgttgtgttagatatgcatataggtcatttgaaaagcattatggagttacttaaaagtcattcgattgaatgttatgtacatatcgatttaatcaaaggactcagtcatgatgaatttgcttgtgagtacattattcaacaatataaacctaaaggtattgtttctacaaaagctaaggtcatcaaaaaagctaaaatgttaaatactttgacgatatttagagtgtttatcatagatagtcaagcattaacaagaagtattgaactcattaaaaaagtagagcctgactatgttgaagttttacctggtgttgcaagtaaagcagtgagtaaaattcaacaagaaacatcagcgtcagtaatagctggtggtcttatcgatgaacaatcggaaattagagaagcaatttccaatggcgctaagtacgtcactacaagttacgagaaactttggtaa

SEQ ID NO: 617 - DNA, 2187 bp, S.epidermidis
atgaatatggtaaggagtgattatatgagtaaaaaaagaatttacgaatatgcgaaagaattaaatctaaagagtaaagagattatagatgagttaaaaagtatgaatgttgaagtgtcaaatcatatgcaagctttagaagaagaacaaatcaaagcattagataaaaaatttaaagcctctcaagcgaaagacactaataaacaaaatactcaaaataatcaccaaaaatctaataataaacaaaattctaacgataaagaaaaacaacaaagtaagaataatagtaaaccaacgaagaaaaaagaacaaaacaacaaaggaaaacagcaaaataaaaacaataaaactaataagaatcaaaaaaacaataaaaataaaaagaataataaaaataataaacctcaaaatgaggtagcagaaacaaaagaaatgccctctaaaatcacttatcaagaaggcataactgtcggtgagttagctgaaaagctaaatgtagaatcagctggtattattaaaaaattgttcttactaggtattatggctaatatcaatcaatcattggatgaagaaacattagaattaattgcagatgactatggcgttgaaatagagaaagaagtagtcgttgatgaagaagatttatcaatttattttgatgatgagactgatgattctgatgcaattgaacgtccagcagttgttacaatcatgggccacgtagaccatggtaaaacgactttattagattctattcgtaacactaaagttacagaaggagaagctggcggaatcactcaacatattggtgcttatcaaattgaaaattcaggtaaaaaaattacgttcttagatactcctggacatgctgcatttacgactatgcgtgcacgtggtgctcaagttactgatattacaattttagtcgtggccgctgatgatggtgtgatgcctcaaacaattgaagctataaatcacgctaaagaagcagaagtacctacgattgttgcagtaaacaaaattgataaaccaactgctaaccctgatcgtgttatgcaagaactcactgagtatggattaattccagaagactggggcggtgacacaatctttgtaccactatctgcattgagtggagacggtattgatgatttattagaaatgatcggtttagtagcggaggtacaagaacttaaagctaatcctaataaacaagctgtaggtactgtgattgaggctgaattagataaatcacgaggtccagctgcatctttacttgttcaaaatggtactttaaacgttggagatgcaattgttgtaggtaatacttatggacgtatacgtgcaatggttaatgatttaggaaaaagaattaaatctgccggtccttcaacacctgtagaaattactggtattaacgatgttccacttgcaggtgatcgttttgttgtatttggtgatgaaaaacaagcacgtcgaattggtgaagcacgtcatgaggcaagtgtcatacagcaacgtcaagaaagtaaaaatgtttcattagacaatttatttgagcaaatgaaacaaggtgaaatgaaagatttaaatgtcatcattaaaggtgatgtacaaggttcagttgaagcattggccgcatctctaatgaaaatagatgttgaaggtgtgaatgtacgaattattcatacagctgttggtgctatcaatgaatcagatgttacattagcaaatgcatcaaatggtattattattggttttaatgtacgcccagatgcaggtgcgaaacgtgcggctgaagctgaaaatgtagatatgcgattacacagagttatctataatgttattgaagagatagaatcagctatgaaaggtttacttgacccagaatttgaagagcaagtcattggacaagctgaagtgcgtcaaacatttaaagtttctaaagttggtacaattgctggtagttatgtgactgaaggtaaaatcactcgtaacgctggtgtacgcgtaattagagatggtatcgtgttatttgaaggtgaacttgacacattaaaacgtttcaaagatgatgctaaagaagtagctcaaggctatgaatgtggtattacaattgaaaaatataatgatctcaaagaaggagacattattgaagcgtttgaaatggtagaaattcaaagataa

SEQ ID NO: 618 - DNA, 801 bp, S.epidermidis
ctatttcaggtcgtggagataaagatatggaaacaattaaacaatacaaagaaaacggtggtgaacaaaatgagtaaattattcattccgtatattatgggtgatttaaattttattcatcatttaaaaacattaactgagaatggagcagacattgttgaaattggtgtgccattttctgatcctgttgcagatggacctataatcatgaaagcagggcgcaacgctattgacgagggttcaaacattaaattcatttttgatgaattaataaaaaataaaaatactatttcatctaagtatgtattaatgacttattataatattctaagtgcttatggagaagaattatttttggataagtgtgatgaagctggtgtttatggtttaattattccagatttaccttacgaacttacaaaaaagtttaaaaaagatttttatcatcattctgttaaaataatatcgttaattgccatgaccgcaagtgatgctaggattatgcaaattgcaaagaactcagaaggatttatttacacggtaacaatgaatgccacaacaggtaacagtggggagttccatccagatttaaagagaaaaattgaatatataaaaaaagtttcaaaaattcctgtggttgctggatttggtatcaaaaatcctgaacatgttaaagatatagcgtccgttgcagatggtattgtaattggtagtgaaattgtaaaacgtattgaaatagattcaagaaaagaatttatcacttatatcaaatcaataagaaccacgttgaattctttataa

SEQ ID NO: 619 - DNA, 681 bp, S.epidermidis
tttgaagaggtgtatatattcatgagtaaaaaagttttatttgttttaacaagtacaagtcaatttacagacggtacagaaactggattatggttagaagaagctggagcaccatataatatattgactgaagaaggtatcaatgttgatgttatttctattaaaggtggaaaagtaaatcttgatcctaattctgtttctaatgaatcactgaatcagtatgctaaattcgtgtcacacttaaacgatacacctagtatcgaaaatgtaaatgcagatgagtatgacgctatttatctaccaggtggacatggtactgtatacgattttgccaataatgagaaattagctgatattttacttcaatttaaaaatagtaataaaataatctcttcagtatgtcatggacctagtgcgtttgtaggtgtaaaagatgcaaataatcactatctagtagatggtgtcaaaataacttcatttactgatagtgaagaaaaagcaatgggatttgaaaataaagtaccatttttaactcaatctaaattagaagagcaaggtgcaaattttgtagtgaaagatgactttacatctcacgtagaaaaagacggtcaatttatcactggacaaaatccccaatcaagtgaagacattggtaaagcacttgcaaatgaattaaaataa

SEQ ID NO: 620 - DNA, 381 bp, S.epidermidis
ataaacctatttttctcaattttaactcttttagaattacgcattgatgtttacttggcaaatttattaattattttagtcccatctattacatcagctatcttaattattttcacttcaaaaatgaaattatatttatggttaaatgtaatttcaaacctaattttttacattatttatagtaaatatatcatgcatctagatggttatctatcctatatcgagagggcgcaaatcaataatagtgatatagaaattaaaatatctccaaatatgcttgaattatctcagattatctttttattttttgtttatttaatacctcaaatgattgtagtttttattaaacataaaagaggtgaaatcaatgctagaatttag

SEQ ID NO: 621 - DNA, 156 bp, S.epidermidis
attacagtatttatagcattctatattttgggaaacttgtctgacacaaaaaaacttaatataagcgtacttttaattaatttaatcataagattacctatacgtcatacacacttgagatatcaactgataactcaagtgtttttttatgtttaa

SEQ ID NO: 622 - DNA, 246 bp, S.epidermidis
ttattggtattcctctatacgctgtacttaaggtattggtttcacacatatttatgttatttaaacgaagatacaatcgctactatggaaatgatgctggtgagtacattatcactgaagaagaaaaaggaattaaacaataatatatataattttagactggaacaacaaaacaacaatgttccagtcttttttatttttaaatcacatacatttgcaatcatgatatgcttagtaatcatatga

SEQ ID NO: 623 - DNA, 1677 bp, S.epidermidis
ataatgtcattatctacattgaaaagggatcatattaaaaagaatttaagagacactgaatacgatgttgttatcgtaggtggcggtattacaggtgcaggtattgctttagatgcaagtaatcgtgggatgaaggtagctttagtagagatgcaagactttgcacaaggtacaagttcacgctcaactaaacttgtacacggtggtttaagatatttaaaacaactgcaagtaggggtagttgcagaaacaggtaaagaacgtgctattgtttatgaaaatggtccacatgtgacaacaccagaatggatgcttttacctatgcataaaggtggtacatttggtaaattctcaacttctattggactagctatgtacgatcgtctagctggtgtcaaaaagtccgaacgtaaaaaaatgttatctaagcaagaaacgttaaataaagaacctttagttaaacgtgatggattaaaaggcggtggctactatgtggaataccgcactgatgatgcgcgtttaactattgaagttatgaaaaaagctgctgaaaatggagcagaaatcattaattatacaaaatcagaacacttcacttatgattccaataagaaagtaaatggtattgaagtattggatatgattgatggcgaaacgtatgcgattaaagctaaaaaagttattaatgcttctggtccttgggttgatgaagtgagaagtggcgattatgcacgtaacaataagcaattaagattaactaaaggtgtacacgttgttatagatcaatctaaattcccattaggtcaagcagtttactttgatactgaaaaagacggacgcatgatttttgcgattccacgtgaaggaaaagcttatgtaggaacaactgacacgttttatgataatgaaaaagcaacacctttaacaacacaagaagatagagactacttaattaatgcaattaactatatgttcccaacagttaatgttaaagatgaagatattgaatcaacatgggctggtattcgtccgctaattcttgaaaaaggtaaagatccttctgaaatctcacgtaaagatgaagtttgggaaggtgaatctggattattaactatagcaggcggtaaattaactggttatcgtcatatggcactagaaattgttgatttattagctaaacgtttaaaacaagaatacggattgaaatttgaatcatgtgccacaaaaaatctaaaaatttccggtggtgacgttggcggaagcaaaaactttgaacactttgttgaacaaaaagttgatgcagctaaaggatttggaattgatgaagatgtggcacgtcgcttagcaagtaaatatggttcaaatgttgatcaactatttaatattgctcaaacggcaccatatcatgatagtaaattaccattagaaatttatgttgaattagtttatagtattcaacaagaaatggtttacaaaccaactgacttcttagtacgtcgttctggcaaattatactttaatattcaagatgtgttagattataaaaatgctgtgatagatgttatggcggatatgcttaattatagtgaaactcaaaaagaagcttatactgaagaagtagaagttgcgattgatgaggcacgtacaggtaatgatcaacctgcaactaaagcttaa

SEQ ID NO: 624 - DNA, 867 bp, S.epidermidis
ttggctacatttaaagattttagaaataatgtgaagccaaactggtgccctggttgcggtgacttttcagttcaagctgctatacaaaaagcgacagcgaatattggtttagaaccagaagatgtagcaatcattacagggattggttgttctggtagactatcaggttatattaattcttatggcgtacactctattcatggacgtgcattgcctctagcacaaggcgttaaaatggcaaacaaagatttaacagttatcgcttctggtggtgatggagacggctatgcaataggaatgggacatactattcatgctcttagacgtaatatgaatatgacgtatattgtcatggacaatcaaatatatggattaactaaaggacaaacatcaccttcctcagctaaaggatttgtaactaaatcaacacctaaaggaaatatagaaaagaatgtagctccattggaattggcactgtcctctggtgcaacttttgtagcacaaggattctcaagtgatataaaggcattaactaaaatgattgaagatgcgattcatcatgatggtttttcttttgttaatgttttctcaccttgtgttacttacaataaagtgaatacttatgactggtttaaagaacatttaacaagtatcgatgatattgagggctatgacatcacagataaacaacttgctatgaaaactgtgctggatcatgagtcactggttaaaggtatcgtttatcaagatacaacaacaccttcttatgaatcgcaaatttcagaactagaacatgaggcgttagctaaaagagatattcatattacagaagaaactttcaacgatttaactgcacaatttttataa

SEQ ID NO: 625 - DNA, 129 bp, S.epidermidis
caaaatacatttatctcactgaatagtcatattaaaataaaaaaactgctcgcaaagcatttagctttgtcggcagctttttacagaacaaatacattaagttcatatatgatacattttaatttttag

SEQ ID NO: 626 - DNA, 123 bp, S.epidermidis
ctgttcacattatttatgtatttaataataactctgagtaaaatttcatttgttaaatactttatctatatttttaaaataatttggaataaattatgtcattcttatattatttacttttag

SEQ ID NO: 627 - DNA, 639 bp, S.epidermidis
gatgatttttcggaggttaatatggacaaatttaaatctatgacagaattaaaagaattgactaaagaaggaaaagattgggaaatagagtgtgaaaatcgttctagcatagtcactatattagcattacatggcggtggaattgaacctgccacaactgaattagcctatacaattgcacattgtggcgactataactatttttcctttaaaggtatgagaagtaaggggaataatgagttacatgtgacttccacacattatgatgaccaaattgcattagatttagtgagaggtagccaaagaactgtagccatccatggttgtgaaggtaatgaaagtgtggcttatataggaggtagtgatgacagactaattgagttaatcaccgaatctcttgaagatataggaattagcgtgcgagaagcaccacatcatatttctggaactcaagaaaataatattgttaatatgactcaaacccaaggaggagtgcaattagaactgacagctcagttaagaaaggagctatttaaaaatagaaaaagttcacgcaaaaaccgtgaaaataaagataattgggatgatttaatgtacgactttgctgatgcaatgaaaaaagctatagaacgtgcataa

SEQ ID NO: 628 - DNA, 2049 bp, S.epidermidis
ttgatgaaattttcgtgggtacgttggattttatatattgttgcattatttttaccaatttttattttttataccgtcgcacgacctgtagatagaaataatcgtaatatgggtgtgtattgtacagttgtatcatgtgttgagtggatggcagcagctactgtattatattttgctgcattgattgtcgatatacatatctcatttatgacttttgtacgtatatttgttattgcagctttatctggtttagttagttttattccaggtggttttggcgcgtttgatttagtcgtgttactaggactgaaatcacttggtatttctgaagaaaagatacttctagcattagttttatatcgatttgcttattattttgtgccagtgatgattgcacttatactatcttcatttgaatttggaaatactgctaaaaaatatctcgacaattcgaagtactttatacctgtaaaagacttcacttcatttttgaggtcttatcagaaagatattttagctaaagtgccttcattttcgttagcgattttaatatttttaactagtattattttctttattaataatttaactattgtctatgatggattgtatgatggaaatcattttgcctattatattgctttagctgtacaaacgagtgcttgtttgttacttattttaaatgtaagaggtatttataaaggcagtcgtcgtgcaataatttatgcctttatttctattattttaattgctagtgcgactatatatacttatgcgtcatttttattattgtcatggctcattatcatatttgtgttactgattttagcttatcaacgtgctcaagtacttaaacgaccattacgctttaaaaagttggcggttatgctacttcttagtatctttattctttatttaaatcatattttaatatcaggaactttatatgcattagatgtttatcatattgagattgatacgtctttattacgatattacttttggatgaccattgttattattatgctactcgttggcgttattgcttggctttttgactataagtataaatgccctcatcatagcattgatttaacactttgcgatgcaattattcaaaaatacggtggtaattatttaagtcaccttgtttatagtggtgacaaagattgtttctttaatgaaaataaagattcatttattatgtatcgatataagtccaatgcccttgtcgttttgggtgatccaattggcaatactaaatcattcgagtcattattagaagcattttatcagtttgcagagtatcaaggttatgagattattttttatcaaataagtgatcaatatatgcctttatatcataattttgggaatcaattcttcaaattaggtgaagaagctattattgatttaacaacgtttacaacatctggtaaaaagcgacgtggtttcagagcgacgctcaataaatttgatgatttaaatatcaattttgaaattattgaaccaccatttactcaagatttctttgatgaacttaaatttgtgagtgataaatggttggatggaagaagtgaaatgcatttttctgtaggtcaatttactcaaacttatttatcgaaagcacctattggagtaatgagagatcactctggcaagatgattgcattttgtagtttgatgcctacttattctaataatgcaatatctgttgatttaattagatggttgcctgaattggatttacctttaatggatggattatatcttcatatgttgttatggagtaaagaaaaggggtataaagcatttaatatgggaatggcgacactctcgaatgtaggtcaattgcattattcttatttaagagagagaatggcaggacgtgtatttgaacatttcaatggtttataccgttttcaaggattaagacgttataaagaaaaatatagccccaattgggaacctagatttttagtttatcaaaagcattattctctgtgggagagtatgcttaaagtgatgagagtcatacgccataaataa

SEQ ID NO: 629 - DNA, 204 bp, S.epidermidis
tcatatatttcactttgtcgcttagtgagttctctcataaataggcactccttattgttgtttgagattattatatcattaattacattttctaacacacatttgttcgtaatgttgttgacacagaatttatgttctgataaattacttatacaaacaaatgttctaggagtgatattggatgattttaaaatacaaatataa

SEQ ID NO: 630 - DNA, 627 bp, S.epidermidis
  unsure (502): Identity of nucleotide sequences at the above locations are unknown.
atggcaatttcagcaaaacttgttaaagaattacgtgaaaaaactggcgcaggaatgatggattgtaaaaaagcgctaactgaaactgatggtgacatcgataaagcgattgactacttacgtgaaaaaggtattgcaaaagcagctaaaaaagctgaccgtatcgcagcagaaggacttgtacacgttgaagtaaaagataatgaagctgcaatcgttgagattaattcagaaacagacttcgtagcacgtaacgaaggtttccaagaattagttaaagaaattgctaaccatattttacatagcaaggtagaaacagtagacgctttgatggaatctaaattatctagcggtaaaactgttgatgaaagaatgaaagaagctatctcaacaattggtgaaaaattaagtatccgtcgtttctctatcagaacaaaaactgataatgatgcatttggtgcatatttacacatgggtggacgtattggtgtgttaactgtantggaaggtactactgatgaagaagctgctaaagacgtagcaatgcacattgcggcaatcaaccctaaatatgtttcttctgaacaagtaagcgaagaagaatcaatcatgaaagagaagtattaa

SEQ ID NO: 631 - DNA, 873 bp, S.epidermidis
acaaagatttcatgtgcttcgttgttaacaaggggtgatcaagaaatgacttttgcaaaaaggaaagagtggtacttagaatatgagataactgtaaatcgtgctggcttactcggtgatatttcaagtttgcttggaatgctcggcattagtattgttacaattaatggtgttgatcagggaaaaaggggattgttaattaaaacagatcaactagaaaaggtcgaaaggttcgaacaaattgtaaaagaaattaatgaaatagaaattacaaagttaagagttcctgaattacgagatagactcgctgtacgacacggtagatatattgaacaagatgctgatgataaaaagacttttaaatttgaacgagaagatttaggattacttgttgattttttagctgagttatttaaagaagaaggacataaattaatcggaatacgtggaatgcctagagttggtaaaactgaatctattgtagctggaagtgtttgtgcacataaaagatggttattcataagctcaactttaattaaacaaacagtaaggcgttcactatttaaaggtgaatatgattctaatcacgtatatatcattgatggtgcggtaacagcacgtgaattgaaccctgagcaccaagaattggtgagagaggttatgacgttaccctcaataaaagtagttgaacatccagatttatttgtagagtcgtgcaattataatatggaagattttgactatattattgaattgagagaaaatgaagatcaagagattcgatatgaagaaatgaagaaacatacggttcaaagcaagaataatttagattttggagatccatttggtggagggtttggtttctttgaataa

SEQ ID NO: 632 - DNA, 471 bp, S.epidermidis
gaggatgtttcaatgaaaaagtggcaattagtcggtactactgtattaggagcttcggttttacttggcgcttgtggcggaaatgatggaggttcaggagacggcaaagatcttaaaggttctgctaaaggtgaaggttcgtccacagtagctcctatcgttgaaaaattaaacgaaaaatgggctaaagatcataaagacgccaaaatttcttcaggtcaagccggtacaggtgctggtttccaaaaattcattgctggcgaaactgatttctcagacgcttcaagacctattaaagacgaagaaaagaaaaaattagaagataaagggattaaatatcacgaattcaaaatcgcacaagatggtgtaacaattgcggttaataaagataacgactttgttaaagaattaactaaatcacaattaaaagatatttactctggtaaagctaaaacatggaaagaccgttaa

SEQ ID NO: 633 - DNA, 135 bp, S.epidermidis
ttactcccttcattcgaatatttaatttttcaaggcagtaaaatcaaaaaattaaattttattttaaaatttttaactttaccaatacactttaatagattaacaaaggtcttcaacattatcaaatttacataa

SEQ ID NO: 634 - DNA, 747 bp, S.epidermidis
aggagggaattaccagtgatatcaacttattttaaaatagaattaaagattatatttagaaagaaattgtatttagttatgtccatattcctacctgtcgtgttttatttattatttacttctatattagacatgccagaagaagcaaaacttaagttttataaagagtatatgtacagtatgacagtatttagtttaatgaacttttgtctattgtcatttccattagatttgattgaagagcgaaatcaaggttggtataagcggttaatggtgaccccattatcatcatttcaatattatttagttaaaattagtaagacaatgtgtcagtttttaatagcaattacaattattttttcagtagctcatttttacaaagatgttcacatgactgtttttcaatggatattctctgcattaactttatggattggggttagtttatttttgactttaggattgattatcgctcaactcaacgatattcaaaaagcaagtagttttgccaatttacttaatattacactagctatattaggaggtctatggtttccagtatacacgtttcctgattggcttcagtcgatttctaaacacatgccaacatataatttaaagctacttgctatagatttagcgcaaaataaaggggtgaatatagaagcgtttggctatctcgtggtctattgtataatctttgtgagtattgctttattcatgaataagaaaggagatgtacactaa

SEQ ID NO: 635 - DNA, 132 bp, S.epidermidis
ctcaatcgttcattatacgtaattttgatttatactttaattttatatattagcacacaattaataaggggtttcaacaattctgcaatgcattgtagaattatcttgagtggtattacttattatgcttaa

SEQ ID NO: 636 - DNA, 165 bp, S.epidermidis
ttaaaaagttctttcaatttctcgataatcgatttcattttaaataaaaatatttcatcagtttatttaagtgctggatggagaggcttgaatttagaaattatgatggaattcattttttatttaaccaccattagtccatttgattttctactaaaaagctga

SEQ ID NO: 637 - DNA, 165 bp, S.epidermidis
tatttaatctctaaaaagtctgaaaaaagcaaaagttttctatttgatacatttatgcacaacataatcacgcagttgcataaactactgttactttttcatttgaaatgtaatagcattatcgctatacttttaaatcgtaataattacgtttttcagaaataa

SEQ ID NO: 638 - DNA, 810 bp, S.epidermidis
tttttattatctgttgaatgcattgatctatttggttgttctggtgcacctgattgtgctggcgtacctggttccactggtttacctggttccactggtttacctgattccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttagtgactttttctgttgatttaccttcgccaactttttctcctgtaataggattaactaatattggtgttgtaattgtttttgttcctggttcacctttttgtttaacgcgctcttcacctggttttaaatcaggattaaatacacgtttcttatcaaatggaatctcttccgttgatgtgattggattaccaactttcggaccatattttgtcacatcatccactggtggggtaacaacttcacctgtatcaggatttttaactcctggtttacctggaacttcagttttactatctacaggtgcatttggatcaaattcatctttatga

SEQ ID NO: 639 - DNA, 378 bp, S.epidermidis
gtcatgacatctatagtagtagtaagtcatagtcataaaatcgcagaaggtgttaaacaattaatcaatcaaatgactgacggtggtgttgaccttattgccgttggtggcttaagtgacgatgaaatcggtacatcatttgatcaaatcgtctctgtaattaatggacttgaaaatgatgcgctttgtttctatgacattggttcagcaggcatgaatttagacacagctttagaaatgtacgaaggtgaccacaaaattgttaaaatggaagcgccaatcgttgaaggaagctttattgcaagtgtaggaattaaatcaaatatgagtatggatagtgttatctctgaagtaagagctaaatatcctgaagaataa

SEQ ID NO: 640 - DNA, 1617 bp, S.epidermidis
aaacttggatcatattccactaatcccacaatcacgtgtatccaatattccacatcatcaatttttggagatgattcaatgaagacctataagccgtaccgacatcaattaaggcgttcgctatttgcctcaacgattttcccagtatttatggtgatgattattggtttaataagcttttatgctatttatatatgggtcgaacatcgcaccattcatcagcatacctatcaaactcaaaccgaattacaacgtatcgacaaacattttcatacgtttgttacgcagcaacaaaaacaatggcgtcatgttgatttatcacatccagctgatatcacaaagatgaaacgccaactattaaaacaagtccatcaacaacctgcgatattgtattacgatttaaaaggttcttcacaatctttcacaaacaattatgaacaattagacacaacaaagatgtatttaatatcaaaatatcgaattgattttaaagacgatacttatatccttaaaatatatatgtcaagcacaccactacttaaaaacattaagaaaaatagtggacaatctgcactcattgttgattcatatgatactgttttatatacaaatgacgaccgattctctatcggtcaaaaatatcaaccaccacagtttgggtttataaacgagtctttaaaactcaattctcatcatgcgcatcttattatatataaagatattcatgaaaccattgaagatggaattgcattactagttgtcatgggtgttgttcttattctgcttgttatttttggatatataagcgctgatagaatggcaaagcgccaatctgaagatattgaagcgattgtccgaaaaattgatgatgctaaaaatcgacatcttggtagttacgaaccgttaaaaaaacatagtgagttagaggaaataaataattatatctatgacttgtttgaatcaaatgagcaattaatacaatctattgaacagaccgaacgtcgtttacgtgatatacaattaaaagaaattgagcgacaatttcaaccccatttcttattcaatacgatgcaaacgatacaatatttaattcctctttcacccaaagtagcacaaacagtcatacaacaactatcacaaatgctacgttattctctacgcacagcatcgcacacagtcaaattagcagaagaattaagctacattgagcagtatgttgccatacaaaatatccgcttcgatgatatgatacagctttacatcgatgctactgagggtgtacaacatcaaacaattggtaagatgatgcttcaaccactcgtagaaaatgccatcaagcatggtcgtgatagtgaacctttaaagataacaattcgtatcagacttacgaagcgcaaattacatattctggttcatgataatggcatcggtatgtctccatcacatttagaacacgtgcgccaatcccttcatcacgatgtttttgatacgacacacctaggtttaaatcatttacataatagagccatgattcaatatggaacatatgcacgtctgcacattttctcaagaagccagcaagggacattaatgtgttaccaaataccacttgtctag

SEQ ID NO: 641 - DNA, 7215 bp, S.epidermidis
tgtaagttgtttatgagttattatgggaatgaatatgaaagaaggactctaatgaatattgaagcactatattttcaaaaatatttttattttaaacatttaaatcaatcaagttcagaacacagggtgacatactgggtaaagttaagtcgcgacattgagttacgtagattaatgtatgcattattagatgtcgttcaaagtcaacctgtgttgcgtacacagtttgtgacagatgattttaatcaactcaagataaatttaagagatttttttccatttattgaaattaaagaagttaatgaaatgtcgcaaagcatagatttagaagcattctttacacgtaatttaaattcctaccatttcaatcaattacctctgtttaattttaagatttatcaatttcttgatgaagcctacctacttttagattttcacgctactatttttaatgaaagtcaattaactccatttttacaacaattaaatatcgcttatacccactctttaaaaagtgaatatagtatctcggatttttataattggattaaagaaatgaatcaaaagatggatcaaaatcaagttgtgtgtccatcaaagcacttcaacgtattgaatgcagacggtgataattacgcttacatacctgttaagaatacatgtgaaaagaaaaaaatgtgttctttgcatgcagaactaccatctttagacattgatgtgtggattgtaagtatttacttagcgcatcattttataagtcagtcttctgatgtgacgttaggcatccatttttcgatagataataaaaatactgagaatatgatggttttaaacacagacattgccccacttaatttaagtattagtcaaagtgacgtcgtaaaagatatggtagatgagtgttccgctctacttgaagagcttcaaatgtgtggtgcgtcttttgttgttcaacctaaagcagtacaaatagatgtagaaacgatgattcatattgaaaaagtacaagaacaatttgagcttaatcatatatgtcatcatatacatcgtctatacaatgaagcatcatcattcgcggatttagagttttatcctcatgtgcaggatggttttgatatagtttataatgacaacgtttatgatgatttaactgtacatacgttagtcaaattaattaatgggatttatatgcaaattacacaaaatccatcattattaattaaagatataaaactcagtgatcgctcagatttagctaaatataatgacatcaatcttcaaaacaatgacattaattatagtgaggtcacttataaaaccgtggttgaaagattcgaacgtcaagtgcaccaacatcccgatagtattgcgttgcaatatgaacaacgatcgatgacatatcatcaattaaatcaatgtgcgaatcttttagcatatagattgcgtttaaatcatcagattgaacctaatgatatggtggcattaatagcagaacgcagcttagaaatgattattggaatgttagggatcttgaaagctggtgcaggctacataccaattgatccggattatcctgaagaaagaatgaattatattattgaggacgcaaaacctaaagcggttgtaacatatcgtacatcatttcaatcaggtttacctcaaatggatatagaattgatagttgattcaagagaacatgatattgataacccgagaggcattaattgttcagaagatatcgcttatgtcatctatacatcaggaacgactggtaaacctaaagggacactggtgccacatagaggaattgatcgcttagtacacaatccaaattatgtcgaattgaacgaaaatacaaccgtcttattatcaggaacagtagcttttgatgcagcaacctttgaaatatatggtccattattgaatggtggacggttagtcattacatctaaagatacgttgttaaatcctcaattgttagatcaagctattactgaaaataaagtcaacacgatgtggttaacgtcatctttatttaatcaaattgctagcgaacgtatcgaagcactagaatctttaacttatttgcttattggtggggaagtgttaaatgctaaatgggttcacttattaaattcgcgtgagtgtcatcctcaaataatcaatggttatggaccgacagagaatacaacatttactacaacttttgcgattccacaagagatgccttcacgtatacctattggtttacctattagtggaacgacagtttatgtcatgcaaggtgatcgtatttgtggcgtaggtgttccaggtgaattgtgcattggtggtgcaggtttagcaaaaggttatttaaatcaacctaaacttactgctgaacgttttattcagtcaccttttaataatgaaatgctttatcgaagcggtgatttagttcgccttcaagaagatggctatattgattatattagtcgtatcgataagcaagttaaaatacgtggttttagaatagaattatcagaaattgaaaaagcattagaagctatacgtgatattaataaagctgtagtcatcgttcgagagcaagaccaagataaacaaatagtggcatattatgaagcatcgcaattaaaatcaacaggtcaattaaaagatattttaagtgaaacattacctgaatatatgatacctgtacattttatgaaggtagatcgtatacctatcacgatgaatgggaaattagatgtgcgtgcattacctgaaattaatctaaagaataatagaaattatgtagaaccacgtaacgatattgaacgcactgtttgccgtattttcgaagagattttacatgttgatcaagtaggtgttaaagataatttctttgaactaggtggacactctcttagagcaacattagttgtaaaccgtattgaagaaaggttaaaaaaacgtcttaaagtaggtgatttaatgaaatcgcctactgtagagcaacttggacaacaaattgaagaactgcaaaatgatgtctatgaagtgattcccaaagcaaatgaatcgtatcaatatgatttaagtgcgtctcaaaaaagtatgtatcttttatggaaggtcaatcctaaagacacagtgtataacattccattcttatggagattatcttctgaacttaatgttatgcaattgcaacgtgcattatctaagttgattgaacgtcatgaaatattacgaacacaatatgtaattgatgacaatgaagttaaacaacgtattgcgacacatgtttcgcctgattttgaagaggtaacgacatctctaacgaacgagcaagatattattcaatcatttatggaaccgtttgatttagaacaaccaagtcagatgcgagttaaatatatacatggaccacaacaagattatttatttatggatactcatcatagtattaatgatggtatgagtaacacgattttactatctgatttgaacgctttataccaagataaatcattacctgaacttaagcttcagtataaagattatagtgagtggatggtgcacagagacttatctaaacaacgtcacttttggttacagcaatttgaaaatcaggttccaatattaaatatgcctacggattatcctagaccaagtattaaaacaaccaacggtaatatgttgacgtttcattacaatcgtcaaatcaaacagcaattgaaatcttatgtagaacaacatcaagtgacagactttatgttctttgctagtgcaatcatggtattattgcacaaatatacacgtcaggacgatatcgctattggtagtgtaatcagtgcgcgtactcatcgcgatactgaaaatatgttaggtatgtttgctaatacacttgtatatcgtggtcgaccacatgatcaaaagacatgggatcaattgatggctgagatgaaagagatgtgtctaggggcatatgaacatcaagaatatccttttgaaagcttagtcaatgatcttgttgatgaaagagatgcttcacataatccgttatttgatgtgatgctcgtacttcaaaataatgaaacaaatcatgcgaattttggacatagtcaattgacacatattccacctcagtcaacaacagctaaatttgatttgtcatttattattgaagaagatcaagatgactatgtcgtcaatattgaatataatacagatttatataaacaagagaccattcatcatattgctgaacaacttcaaatgattattaaacatgtaatatctaccgaaaacctaaaaattcaagatattgatgaaaatgatgacttattaatttggttggacaagcatgtgaatgattgttctttagacttgccaaaaaataagtcaatacagcaacttttacatgatgtcatgaaagcgaaagcagatgatgtagcacttaaaatgaatggacaatcgatgacgtatcaagaacttgatgattattctaatagtatggctcaaacattgatacaaaatggcattcaaaaaggggaacgtgtagcccttttaactgaacgaagttttgaaatggttgctagtatgattgctgtattaaaagttggaggttcttatgtacctattgacgtcacttatcccgataaacgcattgaatttattattgaagacgctgaagtcgcagcagtgctcacatatggaaaagcaatatcctcacatataccagtaattaaaattgaagatattgataacactgaaaataataaaaggttaaatatagaatatgcagggaatttggaagatgatatgtatcatatttatacatctggaacaacaggaaagcctaaagcagtatcagtgaaacaacgtaatatattaaatttagtatgtgcttggacaaaaagactcaatttatccgatgatgaagtctatctgcagtacgctaattatgtgttcgatgcttcggcaactgatttctactgtagtttattaaatggatatccgcttgtcattgcaacatcagttgagcggaccaatacagatttattagaaaagttaatttcacaagaaaatatcaccatcgcatctattccactacaggtatataatgtgatgcatcatttctatattcctaaagtgattacaggaggtgcgccaagtactccagcatttgttcaacatatttctaagcattgtgatatgtacgttaatgcctatgggccttctgaaaatacagttatcacatcttgttggatatacgaaaaaggtgacgccataccatcgactattccgattgggaaaccgttagctaatgttgatatttttattatgtcaggcggtaaactatgtggcgttggtattccaggtgaattatgtattgcaggagaaagtttaacttcaggatatttaaacagacccgaactttctgctgaaaaatttataaataatccttttgggccaggacaactttatcgaagtggtgatttagcacgattgatgccagatgggcaaattgaatttcttggtagaatagacaagcaagttaaagtacatggctatcgcattgaactaggtgaaattgaaaatatcattaattcagtagatactgttacagatagcgttgttattttagctaaacagggtgagcgtgaagtgctgcatgcttattatgttggaagtcaagaagatgaaaatcatatttcacaacatttaaatcaatatttgcctaaatacatgattcctaagacattaacagctattagcgaaattccattaacaggaaatgataaggtggatgagtcaagattacctgtacctaatgtacacaaaaataaatttgttgcaccacgtaataatatcgaacgagaaatagcacaaatcgttagcggagtgttggacgtatcgtctatgagtatagatgatgacttctttgaaatgggtggtacatcactagatgctatggtggtagtatcaaaactaaaatcaaatggcatacacattacaatgcaagatgtatatcaatttaaaactgttcgttatatagctaatcacacagaaaaacgccaagcactaccagaagtagtattaccagatcatctaccacaattacaatctttggttgaaagacgataccaactaaaatcacaacacctaacgcaatcatctctaggtcatgtattgctaactggtgcaacagggttcctaggcgcatatttaattgatgaaatgcaagatgatgctgatcaaattacatgtattgtcagaggtcatgatatcaatcaagctaaaactaacttggaaaataatttaaattgttattttgatacggctcatgtggataaattaatgaagcacattgatattattttagcggatttatcagaacttgaccatcttattatcgattcagccattgatacaattattcatgctggagctcgtacagatcactttggcgatgatgaaacatttttcgatgtcaatgtaagaagtacacaagcattaattgatttagctaagaataaaaaagcgaaattaatctatatatcaacgataagtgtgggtacggtatttgaagtacatcaagacgatattacattttctgaaaaagatttatataaaggccagttatttacatcaccatacactaaaagtaagttttatagcgagattaaagtgttagaagcggttaatgaaggtttagcagctcagattataagattaggaaatctgacaagtgcttctactggaccattaaatatgaaaaatttaacaactaatcgttttagtattgtcatgcatgatttattaaaaatgccgtttataggagaaagtatatcgaaagctaaagttgaattttcatttatcgatgtcacagcgcgccatattattaaattggcaagatccaatgcaatacctattatttatcatgtatacgcaccatgttcgataactatgaaacaagtaattgacaatgccaaagggtcagaaatgactgtagtaagtgatagtgagtttgaacagaaattacatgaattaggtatgcatgaattgattggtcttaatagtaatggagataatcaaatttcaggtgtgacagattcaaatatgactcaaacagtaatgaaagaattacaaggtgagtggccacatctttcttaccaatggttgcagcagtggtaccatttattgtttgaaaaatttgatgccaactag

SEQ ID NO: 642 - DNA, 144 bp, S.epidermidis
ggttacactcccacacatgtaaaaaatcgatttatttactttgttaaaacgaaagaaatgaaattgtatcaaacttttattgcaattgaatattcacgctttttgattacaatagaagaaacttttacattcatatctttttaa

SEQ ID NO: 643 - DNA, 939 bp, S.epidermidis
gcataccatcccttgaaaaatggtgtagaaaataaatttttaataattagtatgtactttaatttaaaaataaaaaggatgaataaaatgaaatttaaaaaatcactcataacagctttagcaaccataactttggtaccatcattgatgattttagatacacagcatgaggcaaaagcagtaggaaattattattacaatggcatggaagatcataatgcgagtgctgcatatcataaagcgaagaaagttgataatagtcaaatagtcataaaacgttataactatgcgcataaaaataaatataaagcagtaggaagagtatcgaacatggatggttggaaaggtccaggcaaagatagtatgggaacaggatttatggtaggcaatcatacgtttgtaaccaatgcacatgttgtagataagaaaaatggtcaaagaacgagtccgagtaaaataaaatttcaattaaacagagacggtaaaaagataccctatcaatttcatgctaaaaagatatataaaatcccttcatacgatatggttgtcgttgaaactaaagaaaatatggctcaaaaagctaacgtgcaaccacttaaacttgcaaccaatcaaaaaattaagagtttaaaatttaacaagaaattatattctttaggatatccagtgatgaacgggaacaatacatatgcatactggaataagttacgttttttacaagaagcatcgaataaatcagaactcatgacaaaagataaatttagagctggtgattcaggatctcctatggtagatagccagtacgttgtttatggggttcgtacgtatggatataatttaagaggtagttctaatcatccttatgcccaacaagaagttgcaggtgcagaatcattatatggtaatccaagagattttattcttaagcataataagtaa

SEQ ID NO: 644 - DNA, 216 bp, S.epidermidis
attaaagtaccgccattcatattaaacaacaacatcccatccttacgtatcattgaaaacagaatacctggtgcaagctgtgtaggtacatctagtagccataataaaggtatgaatgcatttgatataaaagtcaaaataggcgtaagagacaatagacttacaataaggcaaattcctataaaaataggtaaggcttgtacaataaacatttga

SEQ ID NO: 645 - DNA, 624 bp, S.epidermidis
ttgaaaaagtttttaaaaggatttattttattttttctcattgtgatgctaggatttgcagggggattgggatacagtcattataaagattcaaaagcaaacactgatgtatcttcaaaagagactcagacttcaaataaaaatactcatgaagatacaatttcacaagatgaaatgcaaaatcaagttgatagccaaacaaacgaagtatcaaatgagacatcaactaaaacacttagcgaaaaagcaaagcggttaagagaagcttttaacgttaatgatgaggaagctcaaatattagcagatgaaatcgatagagcagatgtaaataaagatggcacgattactatggatgaaatgacgcctactttagatcgttttgcaaaagaagggaaattccaaccatctgcaggtggcacaactaacgaagcacatcatcctaaatatacagcagaagatgctagaaatatgtcagatgatgaatttctagacgcgtatacagaaggcatgtcagatgatgaagctgcgacaattcacgaaagtgctcaagaatctaacgagtatatgaaatttttaagaggacaagttgaagcacgtgcaaaaggacagggcggtaattattaa

SEQ ID NO: 646 - DNA, 963 bp, S.epidermidis
atgaaaaagttaattcaagataaaaacacaattttaaaagatatgcttgatggaattacagtttcaaacaacgatgttgaagttgtatctgacactattgttgttagaaagcataaaaaacaatcaggtgttgcactcgtttctgggggcggcagtggacatgaacctgcacacgcaggatttgtagcagaaggcatgctcgatgcagctgtatgtggagaaatcttcacttcacctacacctgataaaatattagatgccattaaagctgtggacaatggtgacggcgttctacttgttattaaaaactatgcaggagacgttatgaactttgaaatggctcaagaaatggctcaaatggaagatattaaagttgaaagtgttattgtcagagatgatattgctatttctgacccggaaaaacgccgtggtgtagcgggtacagtatttgtgcataaatatgctggatacctagctgaaaaaggtgttgcacttgatgaaatcaaatctaaagttgaggcacttttaccagatattaaaagtattggtatggcattaacgcctccaatggtgcccacaactggtaaaaacggtttcgatattgaagacaatcaaatggaaattggtatcggtattcacggtgaaaaaggtttacatcgtgaagacgtacaacctattaacgtgattgttgaacgtttactcgatcaattatacaaagaaattgagaaaaaacctttaatcgtaatggttaatggtatgggtggtacgccactatcagaattaaatatagttactaaatatctagatgaacaattcaatcagaatgatattgatgttaaacaatggttcgtaggtgactatatgacagcattagacatgcaaggcttctctataactgtactccccttcagtgaagaattgagtgaagctttagctgcacctacagcaagtaaatatttttaa

SEQ ID NO: 647 - DNA, 843 bp, S.epidermidis
tgggaaaagttatttcaacggcgcaccgtggctcttcttcttccctggtgtattgttaggaggtttcgccttattatgtcaaattatcaacaaaaaaataacgcagtaaatacggtagtcaacgtcaatcaattatcgattttagatcaagagaaagtattgttaaaggatgttgatttgacagtaactaaaggtgcatttcattgcattataggtgaaagtggcagtgggaaatcactgttaacaagaacaatacttggaatgaaacaatcacaattatgttatcaaggagatattgacatcgatttaactcaaacagatgcagtgtttcaagatgttcaaagtaatatgtttcaaaatataacattagctaagcatttccaatacatttatgaagccaatcgcacacatctcactaaacagcgtattaaggaagatgtcttacagatgatgcaattacttggtttaagacaaggggaacaattgcttgagcgttatcccttcgaacttagtggaggtatggcacaacgtgtcgcctttataatgtcattaattagacgtccgaactacttatttttagatgaaccaacgagtgcacttgatcaagaaaatattaaaaagtttatgcattaccttcttagggcacaggagcgctaccaaatgaccattgtttttatcacacatgatattaacttagtgaaagattgtgccacacatattagtattatgcagcaaggtaaattgatagaaaatggtgaggccgcgtcgatcttaactaagccgacacataattacacgaaaaaattaattacgattgcacatcggagacaaccttatgcttaa

SEQ ID NO: 648 - DNA, 231 bp, S.epidermidis
gctcccattacaattccaattacagtattcgtcgcccccaagtcatgtcctcttagaggtatgaaaacattgagtatggcattcgcactaaaaaacatcaatgttaaaatatataatcttaaaaaaggccaagacatggcacctttcatattgtcactccttagattgatagttgtttatcaatcagttctcttgtataaccattttgttgcctatgcaattcacttatag

SEQ ID NO: 649 - DNA, 984 bp, S.epidermidis
aagaaggagttaaagattatgacattaaacctagctcaacgtgtgttaaaccgagaaccattaactaaagaagaagcattaacaatttttgaaagttccgaactagatacatttgatttattaaatgaagcctacacagtgagaaaacattactatggtaaaaaagttaagcttaatatgatattaaatgctaaaagtggtatctgtgcagaagattgtgggtactgtgggcaatctgtaaaaatgaaagaaaagcaacgttatgcacttgttgaacaggaccaaattaaagaaggcgctcaagtggcaactgaaaatcaaatcggtacatactgtattgttatgagtggtagaggtcctagtaacagagaagtcgatcatatttgcgaaacagtagaagatattaaaaagatacacccacaactaaagatttgtgcgtgcttaggattaacgaaagaagaacaggctaaaaaattaaaggctgctggtgtcgatcgttataatcataatttaaatacgagtgagcgttatcacgatgaagtagtaactacacatacatatgaggatagagtgaatacggttgaaatgatgaaagataataatatttctccttgttcaggtgtgatatgtggtatgggagagtcgaatgaggacattattgatatggcatttgctttaagagccatcgatgctgatagcattcctattaattttttacatcctattaaaggaactaaatttggtggattagatttattgtcaccaatgaaatgtttaagaattatagcgatgtttaggttaatcaatccaacaaaagaaattcgaattgcaggtggacgggaggtaaatctacgttcattacaaccactcgcattgaaagcggctaattcaatttttgtaggagattacttaattacaggcggtcaaccgaatgaggaagattatcgcatgattgaagatttagggtttgaaatcgacagttaa

SEQ ID NO: 650 - DNA, 429 bp, S.epidermidis
atggaaataacaagtgttaatcatatttgtttttcagtgagtgatttaaatacctctatacaattttataaagatattttacatggtgacttattagtatcaggtagaacgacagcatatttaactattggtcatacttggattgcactgaatcaagaaaaaaatataccaaggaatgaaataagtcattcctatacgcacattgctttctccatagatgaagaagattttcaacagtggattcaatggcttaaagagaatcaagtaaatattttaaaagggcgaccaagagacattaaagacaaaaaatcgatatattttacagatccggatgggcataaaattgaattacatactggaacattaaaagatagaatggaatattataaatgtgagaacacgcatatgcaattttacgatgagttttga

SEQ ID NO: 651 - DNA, 138 bp, S.epidermidis
aagaaggtaacattacatactagatacataaaatatatgtatcttacatttaaaattaaatacatgggaggtataatatgggcaaacgtagacaaggtcctattaataaaaaagtggattttttacctaacaaattaa

SEQ ID NO: 652 - DNA, 822 bp, S.epidermidis
aagcacgtgacactgcttaaagtagcacatttaggaattaaggacacatggtcagatgagacgctcgttgataacgtgaatttcacagttcaatgtggagaaacattaggtattattggagaaagtggaagcggaaaatcgattacttgtaaggcattaataggtttaaacgctcaacgtttatctgtaagcggagatatcttttttgaacatcaaaatttaaatacaataactgaaaagcaactacgcaaaattcgtggtaaagatattgcgatgattatgcaacaaggaacacgggcatttgatccttcaactaaagtgggaaagcaaatgattgaaactttgcgtgcacatacgacattatcaaagcaacaaataaaacaagaacttattcattatatgacgtatatgaagttgaaagatcctcagtcattattaaaagcatatccctacatgttgtcaggtgggatgcttcaacgtatgatgattgcactagcattagcattgaaacctaaattgatcattgctgatgagccgaccacagcattagataccatcacacaatatgaagttatcaatgcttttaaagatataaaacatcattttgattgcgccatgatttttatatctcatgacctcacagtgattaataaaattgcagaccgtgttgtagttatgagagaaggtcgtgtgatagaagaaggtcgaacaaatatggtattacaacaacctcgtcatcactatacagcttatttattatcaactaaaaagacaatttatgattattttcagtttgtgctgaggggtgatttcaatgcttaa

SEQ ID NO: 653 - DNA, 930 bp, S.epidermidis
tttcattatttaaaggagagaaacgaaatgaaaagacactttttagcaatcggagcaattacaataacaacattacttgcgggatgcgattttggagatttggtaggacagcatcagtctgataagcaatcagaaaatagtaacactcaaaccgagcaagcttcaaataataaaaattcaaattctgataatgatcattcaaataataacgatgagtctagagatagagtggaagatttaactcaatcgcagaaggtagcattagctatcaatgatccctcagtttctcaatatgtcgttaatgcaagtgaattaaggaatcattcattttatgcaaattataacggcggaggccaacgtaaaagtattcatacgtataagttggaatcattacccaaaaaagtagaaggtgcacctaatgatatgacattctatactgcaaaaccatcaaaagggtcatttgttactcttatcggtattggtaatgaaaaggtattaattgcaggcacacaaagttcaggtacatatcaacaatatgctcattcggaagcagcaagagaattagatttacatgaattattagataaatacggtaaaagttcaaattataaaaatctagcaaatcaaattacgtttacacaaggtcaattatcaaatgcaagtgaatatacatcagatgaagggacgtctaataatgatgcatctaatgatgacaaagttactcgtgataatgtaatagataaagttgaagcgtatgaaggtcatcagctagataccgatacgtatacatttaaagaacccgaacagaacgaagacggagattggggattttctattttagataaggaaggcaatcttgaaggttcttatattgtgacatctgatggtgaagttacaaaatacgatgaaaacggggaagaaatagagtaa

SEQ ID NO: 654 - DNA, 198 bp, S.epidermidis
ttattatatttcaagattattatagtttttaaatacatcattttagtaataagtatattaattgttagtgagataaaatttaatagtactactacacaaaaaagagagggcgaattcgttctctcttttcttggatttttaaaagtgaataaaaaagtattaagcaacggaatggagctacttaatattttttcataa

SEQ ID NO: 655 - DNA, 984 bp, S.epidermidis
gtgttatatttagaaatgacttactgctcattatctataaagatttatacattgaaaatattgattgttttaacaataggaggtcatgttgttattatgagtcagtttaaggacacattatataaactatttgagccaatgatgaaaatagagttctatcaaaatctattggttaatcttttaattatacttgcttatatcttgatgggtatgattgtaattgcgatatcaagaaagttagttactaaatttttcaacgttaatgaaaagaaaaagaaccgtcataaaattaaaagaagtgaaacactatccacattgattcaaaatttaataagttatgtcgtatggtttattgtccttacgtcaatactttcacgtttcggtattagtgtatcagcaattttagcaggagctggagttgttggtgttgccgttggtttcggagcacaaacaattgtaaaagacattattactggtttctttatcatatttgaaggacagtttgatgtaagtgattatgttcaaattaatgcatctggggtaacaattgctgaaggtacggttaaaacaattggtttaagatcaacacgtatacaatcagatactggagaaatttatacattacctaatggtatgattagtgaaatagtcaattattctgctacagatgtttcacctattgtgatgataccgatttctccaaatgagaattataaagtgatagaagagaaattattaacatttttacctacattaaagaataaatatgacatatttgtatctgcaccagatttacttggtttagacagtgttgatggcaatgaaatggtgattaaacttttagcacatgttaagcccggaatgcattttccaggacaacgtttgcttcgtaaagaggtcatacaatacttcagtgaagaaggcattcatattccaaaaccaacacttgtaaaacttgataaagaattgaataaaaaagaatag

SEQ ID NO: 656 - DNA, 153 bp, S.epidermidis
ttggattcagcagcatgtactgagcctccgccaataaataacatcgatgcaacaatgattgaagacgcacctacacttaactttcgaatgctatatgaattctttttatttttcatgtttaaagcacctctatcttttttatatcatttataa

SEQ ID NO: 657 - DNA, 627 bp, S.epidermidis
atcatgtatttgtatgtgactaagatgacagaaactttagaggaagtagaattgcttttaaatagaagttctcgtcagttgaaaaagccagaacgaatacactatagatttttaaaggatcgacttatgcaccaattaggtgatgcattgattcagtatgctattgaacaatgtgctggattaactcctaaagaatgggagtatcacatcacaactatgggtaaagtagagatacgaagttcttgtcatatatacgtgagtatttcgtatagttatccttatatcatttgtataatagataatcagcctattggtattgatatcgaagaaatgaaagacttggattataaacatttggcgaagaattttacaaaaaatgaatttaaccaagtgactacacttaaagatttttatgaaatttggactaagaaagaaagttatacaaaactcatcggtgagggattgatgaatggtttagactgctatgatgtgacgcaaaatttgagatttttaaaaaaacatgtccaatttacctcagtagattattttaaaagactcattcaaatatgtcatatgagtaaacatagtttgaactttgaagtggtgccgctcacacaattattataa

SEQ ID NO: 658 - DNA, 879 bp, S.epidermidis
caatttaatttgaaaatttacattaaaaaggagtgttttatgcaacgtcaagtggtcgaattttcaaaatataatccatctgggaatatgacaattcttgttcattcaaagcatcaaccgagcgaatatgctgcgattgcacatcagttgatggcgacaacacacatgtgttgtgaacaagtagggtttattgaatcagtaaactatgaaaatggggataactatcacttggtaatgagtggaaatgaattttgtggtaatgcgactatgtcttacattcactatttaaaagaacgtttattgatacagcatcaacaatttcaattaagagtttcggggtgttctcatcctgtagagtgtaaagttcattcgcaacattatgaagtgactatgccaaaagtacatcaagttaaggaaagatttgtgaaattaggggaacagcagtttaaagcatttgaaattagctatgatacatacattcactatgtgatgatgtgtgatgatgtagatttggcaataaaacagtgcgtggaagattttgtcagtgcgcaaacatggcatcgacaatttaaaacaattggtgtcatgctttttcaacaagataaacaattcatatatccactgatacatatacctgcaatagatagcttaatctgggaaaatagctgtggttcaggagcggcttctatcggtgtgttggttaattatctaacagatcatgatattcaagattacctagttaaccaacccggaggcagtattattgtctcatccagaaagtctggacaaaatgaatatcaaacaacgattaagggtcaagtttcaactgtcgcaacaggacaagcatatatagaacaggagacaatgacgcaaatatga

SEQ ID NO: 659 - DNA, 1512 bp, S.epidermidis
tatataaatttagaaaggaacatgcacatgagtgaagcaaatcataaaaacatcgttgttgtaggtgcaggaattattggtacgtcagtagctacaatgctttcaaaagtaagtcctaactggcatatcgatatgtttgaaagactagaaggcgctggtattgaaagttcaaatgaaaataataatgctgggacaggccatgcggcattatgtgaattaaactatacagttgaacaagatgatggttcaattgatgcatctaaagcgcaagaaattaatgaacaattcgaattatctagacaattctggggtaatttagttaaaaatggtgatatttctaatcctgaagaatttatccaaccattacctcatatcagtttcgttatgggaccaacaaacgttaactttttaagaaaacgttatgaaacactaagaactcttccaatgttcgatacaatcgaatatacagaagacatggaaacaatgagaaaatggatgccattaatgatggaaaatcgtgaaccaggtcatcaaatggcagcaagtaaaattgatgaaggtacagatgtgaactatggtgcgttaacacgtaagttagcacattacttagaacaaaaatctaatgtttcattaaaatacaatcatgatgttgtagatttaacacaaagagaagatggcaaatgggaagttgtcgttgaaaatagagaaactaaagaaaaagtaactaaaatagcagataaagtgtttattggtgctggcggtcactctattccgttattacaaaaatctggcgttaaacaaagagaacacctaggtggtttcccaatcagtggtcaattcttaagatgtacaaacccagatattattaaacaacatgcggctaaagtttacagtaaagagcctcaaggtaagccaccaatgactgtaccacaccttgatacacgttatatcaatggtaaacaaacattattatttggtccatatgcgaatatcggccctaaattcttgaaattcggttcaaatctagacttattcgaatcaatcaaaccatataacattactacaatgttggcttcagcagttaaaaatgtacctttaattaaatattcaattgatcaaatgatcaaaactaaagaaggttgtatgaactatttaagaacatttattcctgatgctaaagatgaagattgggaactttacactgctggtaaacgcgttcaagttattaaagatagtgaacaacacggtaaaggtttcgtagtatttggtactgaagttgtcaattcagacgacaattctatgattgcattattaggtgaatctccaggggcttcaacatcattatcagttgtattagaagttttagagaaaaacttcgctgatgacaaagaagcatgggaacctgttgttaaagaaatggtaccaacatacggtcgttcattaattaatgacgaaaaattaatgagagaaacacgccgtgaaacttctaaaaacttacatttaaatagataa

SEQ ID NO: 660 - DNA, 126 bp, S.epidermidis
ctcacttattatgatgtgcactccagaagttggcctaaaatctatctttatggggtgttttttatgattgaatatgataaattttattttaaaattaaagtttttcaagaatatataaatggttaa

SEQ ID NO: 661 - DNA, 1248 bp, S.epidermidis
aataaatgttatattcagtttgaaagagttgcaaaaaactttagtaaaggagtactttttatgaagaaaaaattaagttatatgattaccattatgcttgcttttacgctaagtttagcacttggcctatttttcaatagtgctcacgccgactcgttaccacaaaagaatggtgcaaaccaaaaaacaactaaagtcactgtcagtaataaagacgttccagatgcagttcgcaaacttgctgaagaacaatatttatctcgtgtagctttattagataaagcttccaaccacaaagcaacatcgtatacacttggtgaaccttttaaaatttataaatttaataaggaaagcgacggcaattattattatccagtgctcaataaaaaaggagatgtcatttatgtagtaacaatttctcctaatccttcaaattctaaagcttcaaaacagcaaaacaattattccattaatgtttctccatttctttctaaaatattaaatcaatataaaaatcaaaagataacaattttgactaatacaaaaggatattttgcacttactgaagatggtaaagtgacacttgtgcttaaaacgccacgtaataatgaaaaaacatatgaaaatgccactgaatccactaaacctaaagatttaaatgattttaaacaaactgcatcagtaacaaaaccaactttagaatatcaaagtacacgaaatgaaatgtacgcagaatatgtaaatcaattaaagaatttcagaatacgagaaacacaagggtataatagttggtgtgccggctataccatgtcagcactactcaatgccacatataatacaaatcgatataatgcagaatcagtaatgagatatttacatcctaatttaagaggtcacgacttccaatttacaggactaacatctaacgagatgcttcgttttggtagatcacaaggcagaaatactcaatatcttaatagaatgacttcatataatgaagtagaccaattaacaactaataatcaaggtatagctgtattaggtaagcgtgttgaatcaagcgatggtattcacgctggacatgccatggctgtggctggtaatgctaaagttaacaacggacaaaaagtcattttaatttggaacccatgggacaatggtctcatgactcaagatgcacatagtaatatcattccagtatcaaatggcgatcactatgaatggtatgcatcaatttatggttattaa

SEQ ID NO: 662 - DNA, 897 bp, S.epidermidis
gagaaaagatatagaattggatattttaaaaaagtacaaggcattggaaaggaagtggtaccaacagtagtcatagatttagtggatcaattaaaagtaaaatattcaatcaaattgatactagaagtattaaacatacctaaatcaacatattaccgatggaaaaacaaaacctataaaaatgataccgtaacacaaaaagtcattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagacgacaagaataggtaaaccgtattataaaacggacaatttattacaaagacaatttaaagcgagttgtcccatagaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgaaggttgtatattacatagtgatcaaggcagcgtttatacatcttatgcttattatcaattgtgcgaagaaaaaggcattatcagaagtatgtcccgaaagggaacacctgccgataacgccccgatagaaagtttccatccctcgctaaagtctgaaactttttacatcaataatgagcttaatcgctctaatcatattgtaatagatattgtcgaaaagtacattaaaaactataataataatcgaattcaacaaaaactaggctacttatccccagtaaaatacagagaattaatagcctag

SEQ ID NO: 663 - DNA, 240 bp, S.epidermidis
aatactttgtattgtacgagcaaaagaatatatataacaaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataa

SEQ ID NO: 664 - DNA, 786 bp, S.epidermidis
gaaaagaggtacgatgtgatgaaaaaatatcaaacgtacatcgcaataggttcactattgagtttgatggttgtattaattacgtatggtttaatgcaagacacgcaacatttgaacccacttgagtcacctaatggacaacattggttgggtaccgatcaattaggcagagacttcttagtaagactgattgtcggtagtcttgtcacattgagtttaacaggcatagtgattctattaagcgtttgtatgggacttatctttggcttaattgcaggcatagaaagacgatggttagatcaaatcatcatgtttgttgccgatatgttgctggctattccgtcatttattatcgcattagtcatcttaagtttagtaagtaactccatgataggtttgatacttgctttaacgattggatggataggacgttatttacgttacttcagaaatttaacgcgagatattcaaaaacgtccatttgttcaatatgcacgattgagtgggaactcaacattcaaaacgacagtaacacatgtgattccacatttattaagtagtatattcgctttggtaacggctgactttggcaaaatgatgctcagcatatctggacttgcttttctaggactaggtattaaaccgccgacgcctgagttaggaacaattctttttgatgggaaaagttatttcaacggcgcaccgtggctcttcttcttccctggtgtattgttaggaggtttcgccttattatgtcaaattatcaacaaaaaaataacgcagtaa

SEQ ID NO: 665 - DNA, 1482 bp, S.epidermidis
atgatggatttttggtcttcaaaacgaggcaagatgttagaaatcactgtcctcgtgtttattacaatttttggtgtaggctctcaatttttttcaaatttagcctatagtttaaatcaaggtatccttcaaacatcctttggtattggctctcaatatctgattatcccctctgtattagctaatttcacttttgctttaggtataccgttggggcatacactcacacataaatatggattcaagcgtaattacttatgctttgtgtttatatttctcattggttcaatcttaggacttctatcttttaacttaatcattctgtctattgctaaaatgattcaaagtttcagttcaggtgtattattctttaccttgttacctaaacttttcttgaactttccaaaacaatatagaaatgtatttttattgatggttattgtaggtttatttggttcaaatgcgcttggaggattatctggtagtttatcattagaattagatcgttggcattggatttttgtagtaaatatcatctccgcgatattatgcttaattctaggcaacgtcatattaagaaaaaatgaatatcatcaaacatcagatattcatattagtcgatcaatgatgattactttagtattaagtaccatttctttaatgattcctatgtcacttcttactcaaaaaggctaccattcattatgggtgtggccgatactcttaattgcaatattttttattgtaaattttatcattacaaatcggcaagctacacatcccattgttcactttcatacactattcagtaaaaagcctttcgtcggtgcaacaatggcaatttcatcacatttaactttattaacaggcattgctggtatcaatgtctatatcgtaagaatattaaagttgccttttgatatttcattacatttctatttctttttctttgttggagtcattataacgggtatcttaaaaatgttcttttatagctctgtcggtgcaggttttttaggtacattgggatcgtcagccttactatatgtaagcatccattggattattctgggaaatacgattaacattccattactttatattcaaggtcttctgctcggcttcggtgcaagcatgaccttagttagtggctcgatggctacattattggacggagatttaaaagaagcagcacaacgttctcaaaccatgcatacaataagaaatttctctgctgctatgttgataccgattatagcttatacgattaagaatcatatccaaaaaggaacacagtctatatatgctgaaaacattactgataaaatgatttaccttaaaaagttgcaagatgttgcgattgatgctgatcatcaaatattcttattaatgattattttcaatatggtcatgttcgtttcttcaattatacaaatgattttaggtaaaggtagacgtattacaccacctcgggaatcataa

SEQ ID NO: 666 - DNA, 126 bp, S.epidermidis
aacccgcctcacttacgatacgcttctgcgtatcagttaatgatgcggtttctttttctagtttttatttttaatactcaaatgattctgtatacgtcggtgcctactgaaatatattttttctaa

SEQ ID NO: 667 - DNA, 132 bp, S.epidermidis
cgtcctatccatccaatcgttaaagcaagtatcaaacctatcatggagttacttactaaacttaagatgactaatgcgataataaatgacggaatagccagcaacatatcggcaacaaacatgatgatttga

SEQ ID NO: 668 - DNA, 1434 bp, S.epidermidis
aaggagtaccattctatgtctaacatttcgatgacgacttctaaacgtaatgctatcgttacggtaatgctcattagtgcttttgtgtctatgctcaatcaaactattttaaacactgcactaccagcaatcatcaaaggactgaacatcacagaaacaacagcacaatggttaattaccggatttatgcttgttaacggtataatgattccactcactgcctttttaatggataaatattcgacacgccatttatatattttctcaatggctatttttcttataggatctattgtagcggcattttcacctacgtttacaattttaatgatatctcgtattatccaagcgattggtgccggcatccttttaccattgatgcagtttacagtatttacactgtttcctgctgaacaacgtgggtttgcgatgggattggcaggggtggttgtacaaagtgcgcctgcaattggaccaacgttaactggattattcgtagatttatttagttggagaatgccattttatcttgtttcagcaattgctgcggtagcttttattttaggtttcttcttcgtagaaaataatacaaaaacaaaagacattgttcttgataaaatttctgtagtttattctactttcggctttggtttaattttattcgcatttagtagcgtgagtacgtttggtatcacctctctacctgtcattgtgacatttgtactcggtatagccattatcataatttttacaacgcgtcagcttaaattaaaacatccattgttaaatatgcgtgtgtttaaaaataaagtgttcacactttcagctgtttcttcaatgcttgtatatattacgatggtaagtcctgcgttactcatacctatttacattcaaacaggtttaggtcaatcagcattactatcaggtgtcgtcgtacttccaggcgcggtcattaatggattaacgatggtttatacaggaaaaatttttgataagcatggtattaaagtgcttgtgatacctggttttatcttactcattagtatgacattcttatattcattccttactacaggaacgccatattggtttgttattcttgtttacactataagaatgattgcgttaggattattagttatgcctcttaatacagttggactgaatgcacttgagtcagatgatgtctcacatggtacagcaattatgaattccttacgcatcattgcaggtgctatgggtacagcggttagtgtgacgattctatcaatagtggcaaaacagtatacagcttcacactcgacaatgtcaaaaatgaaactaacacaagaagcaactgtacatggtatagatgttgcatttatttttactacagtattaatcattattggatttatcttagcgttattcataaaagaagaaaaaaatcattaa

SEQ ID NO: 669 - DNA, 144 bp, S.epidermidis
gacaaggtacatttcattaactgtactttgactaaacttatgttatgtatacaaaatgttacacatgtactttatattcaacttcactttttttcttatcaaaatacggtacaacaaatattacaaataaagcacatccaatag

SEQ ID NO: 670 - DNA, 153 bp, S.epidermidis
attgagaaacatatccatatcatagatattataaatgtgcgtttgggagtcctaacacataaattttatagacatttcaacttagagctcataagccatatggggattatattcaaaataaattctactctatctcattttccacgctcttaa

SEQ ID NO: 671 - DNA, 150 bp, S.epidermidis
ggaataagacaacacatttttcttattccctatccaagtattactgaatttaattatttacttattttaatcagtttagttaataattaccgccctgtccttttgcacgtgcttcaacttgtcctcttaaaaatttcatatactcgttag

SEQ ID NO: 672 - DNA, 1395 bp, S.epidermidis
tgtgaattgcacatgttaaaggtaacctttaatttacgtgatgggacgtttactgacattccagatgatgcacattactttttaattgaagactatgacaaattaactcccagtcagcaaactttattaaaacgttacattatcaaacatcaattagatatttcattacaacatgctattctttcatctccactccatagtttaaatatgattaaaaagttagagacttttgttaaggagagcaaagcataccatcctcaatttcacaatattatttgtggatggtgctttattgtacttatgtttgctttacccatctacttgtcttatcacgtttcagacggattacaatactacgtgtcacactggttaactaaactatcccaaatatcattatttcaagaaaataagctacaacatattttattcggtcattatggtgtcatttctttaggtacatattcattcgtctgggcgttaccagttgttttcatgattagtttatctacagctcttatagatataactcatttaaagcattatatcgtttggtctatcgaacctacgatgatgagacttggtcttcatggatcagatatcatacccttgttagaaggatttggatgtaatgctgctgctattactcaagctacacatcaatgtcatcgttgtacaaaagtacaatgtatgagcttggtaagtttcggaactgcatgtagttatcaaattggtgcgacattatcgatattcaacgcaagccaccgctcttggttgtttttgccatacataggcatggttttcttaggaggaatcatacataacaaactatggtatagtcatcaaacacctaagacaacaccatcagtttttcaacgacaactcgtacgttggcctaaaccaaacctactcttaaaagcagcgtggaaaagtattcaaatgtttattgtacaagccttacctatttttataggaatttgccttattgtaagtctattgtctcttacgcctattttgacttttatatcaaatgcattcatacctttattatggctactagatgtacctacacagcttgcaccaggtattctgttttcaatgatacgtaaggatgggatgttgttgtttaatatgaatggcggtactttaattcaaagactttccgcattccaattattgttgctagtcttttttagttcaacatttacagcatgttcagtaacaatgactatgctcatgcgtcgactcggttcaattctaggaattaaaatgataatgaaacaaatggtatcgtccacaatttgcgtcaccatactagtcatagcaatgttaagcataactaaaatttcagacttaggagtgatgttatggaaatcattattatcggtggttttttag

SEQ ID NO: 673 - DNA, 663 bp, S.epidermidis
ttacgattgcacatcggagacaaccttatgcttaaaatagagagattaaccaaatatatagacacgcaactgatatttaaagagatatcatgtacaattaacgaccagcacttactcataagtggggagagtggttgtggtaaatccacattagccaagattatcgctggcttagatacggattatcagggcgaattatatcttaatgggcgcttacgtgaatcttatacgtctaaagagtggatgaagcacatccaatatgtacctcaatatcaacgtgatactttaaatcagcgtaaaacggtattagctacattattagaaccacttaagaattataaggtaaataaacagcgttatacatcaagcattgaagcagtgcttgatcagtgtaatttaccacacgatatacttaatcataaagtttcgacattaagtggtggccaatttcaacgcgtctggatagctaaagctttaatattagaaccagagattctcatattggatgaagctacaaccaacttagatgtcattaatgaagaagctatacttcaaatgttgatttccttaaagatgacacaattaatcattatttcacatgatacatacgtcttaagccaatttgaaggaattcagttacagctaaataaattgaataattaa

SEQ ID NO: 674 - DNA, 384 bp, S.epidermidis
acaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctag

SEQ ID NO: 675 - DNA, 846 bp, S.epidermidis
ttatcatttaagaatgatactggaggaatgaagatgacaaatcgtttaatattattcgactttgatgaaacttactataaacatcgtactaatcaagcagatattccttatttaaaagaaatggaaagtttattacagaatataactgctaaaaacaatgtcattacggcgattttaacaggaagtactatagaaagcgtactgaaaaaaatgagtaaagttaatatgtcatataaacctcaacatattttttcagatttaagttctaaaatgttcacatggaataactgcgaatatattgaatctgatgaatataaaaacgaagtgttgatagaaccgttcttattggaagatatattagatatattaaaacacgtttcttctaaacataaagtagagtttataccgcaaagaatttttcgagaaaatgaaacattgtataatttttatctttattcttcgggtgacacgcatttagataaaacaattttagaagacctcagtcaatattctaagacaagggattatacgatgacatttaatcgttgtaatcctttagcaggtgatcctgaaaatgcttatgatattaattttactccaaagaatgcaggtaaattatatgccacaaaatttttgatgaataaatatggcgttccaaaagaattgattattggctttggtgatagtggtaatgatgaagcgtttttaagttatttagatcacgcaatgattatgtctaacagtcaagatgaggaaatgaagagtaaatttaaaaatacaaaatatccttattacaaaggtatttatacacatgtacgtgaatttatagaatatgaaaatgtttaa

SEQ ID NO: 676 - DNA, 915 bp, S.epidermidis
tgcaatattaaatccgcgtttaagggaggcaatgaaatgattgtgttacgtcgtctatttcaagatagaggtgccatatttgctatagctattattacaatctacgtagtgcttggagttttagctcctttaattacattctatgaaccgaatcacattgatacagcaaataaatttgctggtataagttggtctcactggttgggaacagaccatttaggtcgagatgtattaacacggataatatacgccataagacctagtttgttatatgtatttgtcgcattgattatttccgttgtgataggagcgatacttgggtttatttcaggttatttcccaggttatatcgatgcaataattatgcgtatatgcgatgtgatgttagcttttccaagctatgtggtcacattggcattgattacgttgtttggcatgggtgtagaaaatattattattgcatttatattgactcgatgggcgtggttttgtcgcgtgattcgaaccagtgtaatgcaatatattgaagctgatcatgtaaaatttgccaaagtaattggtatgaatgatttaacaatcattcgcaaacatattttgccactaacctttactgacatagcgattattgctagtagttcgatgtgttcaatgatattacaaatgtcaggattctcattccttggattaggtgttaaggcacctacagccgaatgggggatgatgcttaatgaagcacgaaaagtaatgttcacacatcctggaatgatgatgacaacaggtgtggctatcgtcataattgtgatggcgtttaactttttatcagatgctttacaaatggcgattgatcctcgtatgtccgctaaagaaaaacgactggctctgaagaaaggtgtgaaagcacgtgacactgcttaa

SEQ ID NO: 677 - DNA, 1425 bp, S.epidermidis
aagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaaaatattaatggttggtagtggaccggtcgctattcaacttgctcgactatgtaacttacatggggaacatatggttgatatggtgagtcgcgttcatgcatcaaccaaatctaagagagtctttgatgcgtatcatcgtgacggctttttttcagtaatgactcaaaatgatgcacatcagtgttttttaggtaagtttacggttagacatttttttaaagatgttaaagacattacacaatattatgacgtggtgattttagcatgtactgctgatgcgtatcgaccgatattacagcaattatctaagtccacattaaaacgtattaaacaaattatcttggtctcgccaacattaggatcacatatgcttgttaagcaaatactatcagatgttcattgtgaaggtgaagtgatttcgttttccacttatctaggcgatactcgaatatttgataaagcacaaccgcattgtgtcctaactacacgagttaaatcaaaattattcgtaggttcgactcattctcagtctattacattgtataagcttaagtctttattcgactatttgaatatagaattaacaacgatggacacaccgctacatgcggagatacataatagttcactttatgtacacccaccattgtttatgaatcaattttcattaaaggcggtatttgaaggaacgaaagtgccagtatacgtatataagctatttccagagggtccaattacaatgaccttaatacatgaaatgcgattaatgtggcaagaaatgatgatgatattaaaaaaattaaaggtaccctcggtcaatctcctgaagtttatggtgaaagaaaattaccctatacgtgatgagaccatgcgcgaagttgatattgaaagctttgaaaatttatcagctattcatcaagagtatctactttatgtgcgatatacagcaattttaatcgatccattttctaatccggacgatcaaggtgcatattttgatttttctgccgtaccatacaaacatgttgatactgatgaacaaggagttatacatataccacgcatgccgagtgaagattattatcgtactttgatgattcaagcaattggaagagcattaaacgttgcaacaccgatgattgacacattgttattacgttatgaaactaccgttaaacaatactgtgatacacatttacatcaacaactatcaaagcaattcgaattacatcattttaaacaggatttagcgttagtgacgaactacttaactttttataaataa

SEQ ID NO: 678 - DNA, 1137 bp, S.epidermidis
tataaatataaaagatgttttggaggaatacttatgtctaaatttatttatcaatcaccaggaagatatgtacaagggaaaggtattgttagctctatcgctgaagaaacagaacgtcttggtagtcacgcgttgattattgcagatgaagtggtttggaatatcactgaagaaaaaataaaagaaagtttctcagcaaataacaacgttgattttgaatatgaagtatttaaaggagaatcttctgaagaagaaattcaacgtatagttaaacaatataaagaaaaaaacattgacgttgttattggtttaggcggaggtaaagcgttagatacaggtaaagctgtagcatttgaacttaaagcaagcgtcatcgattttgcgtctacagcatcaatggatgcaccaacagcagcagtatctgttatttataacgaagatggatcatttagtggttatgaattctaccctaaaaaccctgatacagttatcgtagattctgaaattgttgcacaagcacctgtacgtttatttgcatcaggtatgagtgatggtttagcaacattaatcgaagttgaatctacacttcgtagacaagggcaaaacatgttccatggcaaacctacattagcaagtttagcaatcgctcaaaaatgtgaagaggttatttttgaatatggttacagtgcttatacttctgtagaaaaacatatcgtgacaccacaagtagatgctgtgattgaagccaatacattactttcaggtttaggatttgaaaacggcggattagcaggtgcacacgcaattcataatggattcacagctttagaaggagatatccaccacttaactcatggtgaaaaagtggcatacggtattttagtacaattagtacttgaaaatgcgccaactgaaaaattcatgaaatacaaaacattcttcgataatatcaatatgccaacaacattagaaggtcttcacattgaaaacacaagttatgaagaattagttcaagtaggtgaacgtgcattaacaccaaatgatacgtttgctaacttaagtgataaaatcactgctgatgaaatcgcagacgcaattttaactgttaatgatttatctaaaagtcagttcaactaa

SEQ ID NO: 679 - DNA, 168 bp, S.epidermidis
gggagggataacttaatggaacacgtttctaaattaggcgaagcgattgtggatacagtaacagcagcacaagcagaagatggtgctgaattagcaaaaagtatcgttaacatcgtagctaatgcaggtggcatcattcaagatattgctcacgcatttggttattaa

SEQ ID NO: 680 - DNA, 1218 bp, S.epidermidis
acaactatcaatctaaggagtgacaatatgaaaggtgccatgtcttggccttttttaagattatatattttaacattgatgttttttagtgcgaatgccatactcaatgttttcatacctctaagaggacatgacttgggggcgacgaatactgtaattggaattgtaatgggagcttatatgctaacggcaatgctatttcgcccctgggctggtcaaattattgcacgtattggtccgattaaagtattgcgtattatattattgattaatgctatggcactggtattatatgggtttacaggacttgaaggttatttgattgcacgtatcatgcaaggtgtgtgtacggcattcttctcaatgtctttacaattgggtattatagatgctttacctgagaaatatcgttcagaaggtgtatctctctattcattattttcaacgattcccaatttattaggaccattaattgcagttgggatttggcacgtggaaaatatgtccatatttgctattgttatgatttttattgcagtaacaacaaccttatttggttatagaactacttttgcaaatacacaaaaagaggtatcaccaaaagacgaagtcttgccttttaatgcaatgactgtatatgtccaattttttaaaaataaagcactcttctgcagtggtatgattatgatcttgtcatctatcgtgtttggtgcgatgagtacttttataccattatatacggttagggaaggtttcgcgaatgcaggtattttcctcacaattcaagccattacagtagtgatagctagattttatttacgtaagtatgtaccatctgatggtttatggcatcaccgttttatgatgattgtcttaacgttactgatggttgcttcagtcattgtagcttttggaccacatatagtgagtatatttgtatatataagtgcaatctttatcggaataacacaagcgctcgtttatcctacattgacaacgtatttaagttttgtcttaccaaagataggacgtaatatgttattaggattgtttatagcatgtgcagatttagggatttcactaggaggtgtgctaatggggccaatatcagatacggtaggatttaaatggatgtatattttatgcgctttattggttactattgcaatgacactaagtaaaattagacaaagacaaagtgtttcaaaagcctcatag

SEQ ID NO: 681 - DNA, 1026 bp, S.epidermidis
ttcattcacaaggagttgttattgatgaaaaatttacgtaacagaagctttttaactttattagacttttcacgacaagaggtagaatttttattaacactctccgaagatttgaagcgtgccaaatatatcggcactgaaaagcctatgctaaaaaataaaaatatcgcgcttctttttgaaaaagattccactagaacacgttgcgcattcgaagttgccgcacatgatcaaggtgcacacgtcacttatcttggacctacaggttctcaaatgggtaaaaaagaaactgctaaagatacagcacgtgtacttggtggtatgtatgatggtattgagtaccgaggtttttctcaacgtactgtagaaacattagcgcaatattcaggtgttccggtatggaatggattaaccgatgaagatcaccctacacaagtgcttgctgactttttaactgctaaagaagtattgaaaaaagagtatgctgatatcaactttacttatgttggcgatggacgtaacaatgttgctaacgcattaatgcaaggtgctgccattatgggtatgaatttccatcttgtttgtcctaaagaactcaatccgacagaagaattattaaatcgttgcgaacgtattgcgacggaaaatggcggtaacattttaataacagatgatattgataaaggcgtgaaagattctgatgttatttatacagatgtttgggtatcaatgggcgaacctgatgaagtatggcaagaacgccttaaacttttaaaaccatatcaagttaaccaagcactattagaaaaaaccggcaatccaaatgttatttttgaacattgtttaccttctttccacaatgcagaaactaaaattggtcaacaaatttatgaaaaatatggcattagtgaaatggaagtcactgatgatgtcttcgaaagcaaagcttctgtagtattccaagaagctgagaatagaatgcatacaattaaagcggtcatggtagcaactttaggagaattctaa

SEQ ID NO: 682 - DNA, 129 bp, S.epidermidis
aatgatagcaaaacattttatactcagaaaaacctactttttcagcaatttcataatgcttgtagtgctggtctaaaagatgtaatgattttaaaatacgataacgatttagataatcaactatcgtaa

SEQ ID NO: 683 - DNA, 768 bp, S.epidermidis
ggtgggagcaaaatgcttaaaggacacttacactccgttgaaagtatgggcactgtcgacgggccaggacttagatatatattatttactcaaggttgtttgttaagatgtttatattgtcataatccagacacttggaagattaacgaaccatcaagagaagtgacggttgatgaaatggtaaatgaaatcttgccgtacaaaccttactttgaagcttcaggcggtggggtaacagtcagtggtggcgaaccattactacaaatgcctttcttggagcaattattcaaagaattaaaagcaaatggtgttcacacatgcattgatacttctgcgggctgtgtaaatgatacaccagcatttaatcgtcattttgatgaattgcaaaagcatacagatttaatcttattagatattaaacatattgataatgataagcacatcaaattaacaggcaaacctaacacacatattttaaagtttgcacgtaaattatctgatatgaaacaacctgtttggattagacatgttttagtacctggtatttcggatgataaagaagatttgataaaactaggagaatttattaattctttagataacgttgaaaagtttgaaatcttaccatatcatcaactcggtgtgcataagtggaaaaatttaggcattccttatcaactcgaaaatgttgaaccgcctgacgatgaagcggttaaagaagcttatcgctatgttaattttaatggcaaaatacctgtaacattatag

SEQ ID NO: 684 - DNA, 213 bp, S.epidermidis
tttgtattaaaaaagcaatgctattctatagataacttaattaggaggagggaatacaacgtggaacatgtttctaaattagctgaagctatagctaatactgtatcagcagcacaagcagaagatggtgctgagttagcaaaaagtatcgttaatatcgtagcgaatgctggcggtattattcaagacattgcacatgcattcggttactaa

SEQ ID NO: 685 - DNA, 138 bp, S.epidermidis
cctgaaataaacccaagtatcgctcctatcacaacggaaataatcaatgcgacaaatacatataacaaactaggtcttatggcgtatattatccgtgttaatacatctcgacctaaatggtctgttcccaaccagtga

SEQ ID NO: 686 - DNA, 129 bp, S.epidermidis
cgcgttgtaaaaattatgataatggctataccgagtacaaatgtcacaatgacaggtagagaggtgataccaaacgtactcacgctactaaatgcgaataaaattaaaccaaagccgaaagtagaataa

SEQ ID NO: 687 - DNA, 171 bp, S.epidermidis
gtagctcaaaatgatttagagataagttcaagctcagaaccacgaggcaatattaaacttattattataacttatatttttcatataaaatatatagttataaataaaaataatcaaaaaataatttatattggaattgttattcgtttatcatatgtaaatttatattaa

SEQ ID NO: 688 - DNA, 234 bp, S.epidermidis
atacataaaaataccgagacatttgatgatgtctcggatatttatcatatatcactagttgatttatctacatgccttttcaagtcccaacttactagcgtcatcatttacacaacactatttaataacaaaacgcttttcgttaaacttaatcctcacgttgttatttatgatgttcaactttatttatatgatataaaacctgaaaatttctcaacgactgttatgccataa

SEQ ID NO: 689 - DNA, 1365 bp, S.epidermidis
ttaatgatgaaaaataaactaacattaaaagagaatctatttatcggctcaatgctgtttggtctattttttggtgctggaaatctcatttttccaattcacttaggtcaaactgcggggtcaaatgtatggaccgccaatttaggatttcttatcacggctatcggactacctttcttaggaattatagcgataggtgtatctaaaacaaacggggtctttgaaatttcctcaaggataagtaaaatatatggttatttgttcacaattggcttatatcttgttataggtccgttttttgcgttgccaagacttgcgacgacgtcatttgaaatagcattttcaccatttatttcatctggtacggcccaagcgttgttgcctatttttagtattttattcttcggagtagcgtggttattttcgcgtaaaccttctaaaatattagactatattggaaaattcctaaatccggtctttctcatcttgcttggaattgttgttgtgcttgcatttatccgtcctatgggtggaattagtcatgcgccagtaagtgctgattatagcaatagcgtgttactcaaagggtttatcgatggatataatacattagacgctttggcatcattagcatttggtattatcattgttactacaattaaaaagttggggattactaatccgaatacaatcgctaaagaaactttaaaatcaggtacgattagtattatagctatgggcgttatttatactttattagctttaatgggtacgatgagtttaggtcgttttaaagtaagtgaaaatggtggtattgcgcttgctcagattgcacaacattatttaggggattatggaattattattttgtcactaatcatcattgtggcatgtctgaaaacagcaataggattgatcacagccttttcggaaacatttacagagttattccctaaatctaactatctttggttagctactggggtgagtatattagcttgtatatttgctaatgtaggtttaacaaaaattattatgtattcaacaccagtattgatgttcatttatcctttagcgattactttaattttattagcgttacttagtccattatttaaacattctaagattgtctatcgatttacaacattatttacaatggtggcggcatttgtagatggtgtgaaagcaagtccagagttctttgttaatacaaaatttgcacaaacaatcattggatttggagaaaattatctcccattctttaacattggtatgggatggattgttccagcatttattggtttcattattggtattattgtatactttatgactgctaaaaaatcgtcccacgtacaataa

SEQ ID NO: 690 - DNA, 453 bp, S.epidermidis
aataaagtgaaacaatcttattattcgcatacacctcaatctaaaataaaaagtgtagctatcaataaacatgctcatcaatccatttcaattggcattgtatttgttgtcgtcatctttgtaagtgttatccaaatcctattacatcaacgtcttaaacagaacgcacctctcgaaagattatatttggtaccttatagtcaacttaaactatacttgacttatatcagtgtacatgtggtcatactgatgctcatgctattgatgattagccttttaatgcatcaaccattaagcattcttttctacttaaaaacactgattatagttttattttatgaggcaggtattgctttattactttttaaaattaatgttcttagtcaccgtatattcatggctattatttatacggtagcgataggtattatatatttatggattcaattgtaa

SEQ ID NO: 691 - DNA, 225 bp, S.epidermidis
gagagaccgaattatgggatgaacctgggacacaaatcgatgttccaggttttttataatgtaaaaacagtgatgaacttctgggcattaacagagtgtatttcaatagacaaagcaatttggctatcgactatcaaagagtggcacaatgaaggcattatgaatatatgtcttatacttcagctttttagtagaaaatcaaatggactaatggtggttaaataa

SEQ ID NO: 692 - DNA, 528 bp, S.epidermidis
gaaatgaggaaatgtgtattaatgacggtagcagcaagtgctacgctcttattggcaggttgtggcaatggtcaaaaagaagataaagatgttacggtatcgctacctactgaagcaaaggcggataaacttgacgcgcaaggctatgatgcagcgatgcccgtttatagtgcagtgtatgatgcattagttaaatatgataaagataagggtattaaagcaggtttagcagataaatggagcgttgatgaatcagggaaagtttatgaattccatttgaaaaagaatgttaaattctcagatggttcagcattagatgctaaggacgtgaaattctcgattgatcgtgcgaaagcgatgaacaaagattcgactgtagaaacgttaaaaaaattagataaggtcgttgttaaaaatgagcacgtggtccaaattagattgaaatctccttcaaatcaagtgttaaatgaattaacacaagtgagaccgttgcgtattatgagtccacattcagtagaaggttgttaa

SEQ ID NO: 693 - DNA, 792 bp, S.epidermidis
ataaggaggaagatagatatgagtaaaacagcaattataacaggtgcagcaggtggattaggtaaaggtattgcagaacgtcttgctaacgatgggtttaatatagtactacaagatattaatgaagcacttctattagaaactgagaaagaattcaaagaaaaaggttatcaagctgtcgcattcaagagtgatgtatctaaaaagaaagaacaggaagaattagttcagttcgcagttacagaatttggtcaattagatgtcatggtgaataacgcaggtgttgatgcagtgacgccaattttagaaattggggaagaggaattatctaagttatttaatattaacgtatttggtacattgtttggaattcaagcagctgctaaccaatttattaaacaaaaaagtaaaggtaaaattatcaatgcatgtagtattgcaggacatgaatcttatgaagtactcggcacttactcagctacaaaacactctgtacgttccttcactcaaacagctgctaaagaattagcagacaaaggcattaccgtaaacgcttattgcccaggagttgccaaaactgaaatgtgggatcgtattgatgaagaaatggtgaaacttgatgatagtctagaaataggagacgcgtttgaagcattttcttcagaaatcaaacttggaagatatcaagagccatcagatgttgcgaacttagtatcattcttagcttcaaatgattctgattatattacaggccaatccattttaactgatggtggattagtgtacagataa

SEQ ID NO: 694 - DNA, 1338 bp, S.epidermidis
tgcaaaattgaattgcgtttaatttatatgaggttaatcactttctttaaagatttaaaaagtattatatgttttaacagagaaagaaggatgaatgtgaagcaattaagtacaactttaaaagtccgattaatatgcgatttttttcaaaatattatagtcacggcatttttaccatttattgcgttgtatttaacagatatggtcaatcaacatttttcagggctttttttatttgggcttgtaatgataaattttccaatttctttgatttcaggtcatattattgaacgtttacctaaaaagacgttaacacttagttatcaatttatattaagtttaatgctcgtaattatggcgatttcaatatcacaacatacttttaagatcattttattttgtatcgcttacacaatatttagtatcacaataggcatgcagcaacctataatggacacgattattatggatgcgattacgcctgaagttgagcaatatatttataagataagttattggctgacgaatattgctgtcgcctttggtgcgctcataggtggattgatgtatggggcacataaatctatgttgtttttcatcgcttttgtcatttacattatggtttttatagcacttatcgtatggttgcctaaagatttaaatattgttactcagtcgcacacacatcatgctaatgagaaacaattctccatgggtcaaatattaaaaagttataaaccagcatttaaagatacaacatatctacttctaattataggatttagtattttaacaatgggtgagttatctgcatcatcgtacatttcagtgcgtttaaaacaagagtttgatccgatgatattgttttcgttacatatcaatggcgttaaaatgtattcacttctattaatgacgaatacaatcattgttataatttttacctattttatttcaaaaattgttatgagaatgaatgttaaaacagcattattggttggaattattttttatgtcattggatattcgaacctcacttatcttaatgattttacgttacttatcatatttatgattatagcgacgataggtgaaatggtatattctccaattcttgaagaaaatcgttttaaaatggttccttctcataaaagagggacatattcagcagtgcatgctttaggatttaacctagctgaattacttgcaagatttggaattatattaggagtgtttttaacttcaatggagatggggatctatatgtttgttttattattactaggtggcatgtcactttacattgcagtgagtcgttttaataatacaaattcacaataa

SEQ ID NO: 695 - DNA, 159 bp, S.epidermidis
gttcaatctgatgatttaaacgcaatctatatgctaaaagattcgcacattgatttaattgatgatatgtcatcgatcgttgttcatattgcaacgcaatactatcgggatgttggtgcacttgacgttcgaatctttcaaccacggttttataagtga

SEQ ID NO: 696 - DNA, 243 bp, S.epidermidis
aaaaccaccgataataatgatttccataacatcactcctaagtctgaaattttagttatgcttaacattgctatgactagtatggtgacgcaaattgtggacgataccatttgtttcattatcattttaattcctagaattgaaccgagtcgacgcatgagcatagtcattgttactgaacatgctgtaaatgttgaactaaaaaagactagcaacaataattggaatgcggaaagtctttga

SEQ ID NO: 697 - DNA, 528 bp, S.epidermidis
ccacagttagacgatacaacaccgtttaaaaaaggtgttggcatagatttagcacgtttatctttggaaaaggcagagacattaaaaggacaacgtccacttacatactatttaacagataaaccgcaagaaacgaagcacgtgtttgatacggcagtaagtacgtctgtcttgtacttaatagaagatattccgcaacatgcaaaagatttaaaagaggtattgaaaccaggcggtgtttattacgcttcattcgcggatttaactaataacccaagtcgtcagtttatggatgacacgattaatcaatatggtgcaacaccttctcagaatcactctctaaaacatatcgttgatagctttgtggatgcaggatttgaagttgcagtaatgaaagagcatgtacctgacgtgattgatttaacacattatagcgatttttatttatcaccgaatgattatttacaaacactatatgaagaatcgtttttaataaaagcaagtgtgaaagaaggtactgagaaatga

SEQ ID NO: 698 - DNA, 165 bp, S.epidermidis
ttgagcatagacacaaaagcactaatgagcattaccgtaacgatagcattacgtttagaagtcgtcatcgaaatgttagacatagaatggtactcctttcaaaatgaagttgcagacaccaaacttaagattgtgtggaagactattacagaaacaagttggtga

SEQ ID NO: 699 - DNA, 177 bp, S.epidermidis
gtaaaggtagacgtattacaccacctcgggaatcataaaaagatgttaaatcaaaagctaggcacattacaagtgatacattgtaatgtgcctagctctatatataaagatttagtattattcttcaggatatttagctcttacttcagagataacactatccatactcatatttga

SEQ ID NO: 700 - DNA, 147 bp, S.epidermidis
cgttttccagataaatgttcttcattgaaagtgaaggcaggtgatgtatctttagctattgcattcatatttggcatgccaaaaccattagttgtaaatgatggtgtgatggtctttgttgatagaggccaatgtttaaatgaatga

SEQ ID NO: 701 - DNA, 2079 bp, S.epidermidis
  unsure (2062): Identity of nucleotide sequences at the above locations are unknown.
tataaaaaagatagaggtgctttaaacatgaaaaataaaaagaattcatatagcattcgaaagttaagtgtaggtgcgtcttcaatcattgttgcatcgatgttatttattggcggaggctcagtacatgctgctgaatccaatcaccttgaaaatcaagaacaatcagaagtaagtgcatcacattctattgagatgcaacacaaaaatcaagaaactcaacaaactgagaataaagataataaaactaaccattcagaaacaattgataagactccaactatacataacaatggctactcatatcatgagacacctagtactgacgttaaatctaatgaagacaaacaaattgatagtcaattcaatcaacctcagacatctatgccaaataatgatcaacaaaaccctaaaaaagtagcggaacatacaacgaaaagtataaatgcaaaaaaagaagaaactagaaagaatgaaaatgcaaagagcctagtacaaccccaacaagatgataaaacaacatctgaacaaacaaaaatgaaagaatcacgtgaacaggagattacaaacgagcaaaagcagttacaaagtaaagatgtaaaaaatgctcaacaagaaaatcaaaatatagaccaagaaaaatctcaagaaaaaattaaagtccaacaatcgaacatcgaaaaggctcaaaaatcttcaagaatagatggaaaattagataatcaatacaataaagatgcaacgcaatcggatgaggggactgcatctgagaacgtttcagaacagcatataacagcaaaagatggaggtgttacacgaaataatcgtggagataaacatttaaatcaagaaaagccaacaacatcatcagataaagaacttaaagtggatgacatagacaaagatctttccacaaaagaatctcctgaaaatgaaaaagatgattctagaaaagggattaaagcaatcactaaaaattctcaggcaacaacaagaaatactgcgacaacagaagcatccaaagaattgaaggatcaaacaaataaagtagcatcacaaaaagaatataaaaatcatgaccctattattcttgtacacggctttaatggttatgcatcaggaactggtcccgttacaggaaaaggtaactattggggtggtgaccgtctcaaaattattcaagattatagagctaaaggttataacgtgatggaagcaagtgtaagtgcatttggcagtaattatgatagagctgtagaattgtactattacattaaaggtggacgcgtagactatggtgcggcacatgctgcaaaatatggacacgagcgttacggaaaaacatacgccggtgcttataaggattggaagcctggtcaaaaaattcatctcattggccatagtatgggtggtcaaacaattcgttatcttgaagagttattacgacatggtagtccagaagaggtagaataccaaaaacaacatggtggtgacatttctccgttatataaaggtggacaagataatatgatatcgtctattactactattgccacaccacataatggcacccatgctgcagatttattaggtaatgaagaaattattagacaagtagcatatgactatgcaaggtcaaaaggtaataaattatctcatgttgatgttggtttaagtcaatggggacttaaacaaagagaagacgaaacattagttcaatatattcaacgtgtgaaacaaagtaaattatggacaacaaaagataatggattttatgatttaactactgagggtacagatatcttaaatcaaaaaacatccttaaaccccaatattgtttacaaaacatatcagggtgaatctacaagaccaggtccaaatggtactcaaaaagcagatgtcaatatgaacataggctatacattaactgcaaatacgattggtaaagtaaaagacaaagcgtggagagaaaacgatggactagtgtctgtcatctctgggcaatatccattgaaccaagcgcatacgtttgcgacagataaagttcaaaaaggagtatggncagggacaccagtttaa

SEQ ID NO: 702 - DNA, 984 bp, S.epidermidis
atcatgaaagaaaatttttggagtacattgccacgtccgttttttattctggcacctatggaagacgtgacagatattgtctttcggcatgttgtcagtgaagctgcgagaccagatgtattttttactgaatttaccaatactgagagttactgtcaccctgaaggtattcatagtgtgcgcggacgcttaacttttagtgacgacgaacaaccaatggtagcgcacatctggggcgataaaccagaacaattccgagaaatgagtatcggcttagcggatatgggctttaaaggtatagatttaaatatgggttgccctgtcgcaaacgttgcgaaaaaaggtaaaggatccggcttaattctacgacctgaaacggcagccgaaatcattcaagcttctaaagcaggtggtctaccggtcagtgtaaaaacacgtttaggttattacgatatcgatgaatggcgagactggttaaaacacgtcttcgaacaagatatcgcaaatttatccattcatctacgtacccgtaaagagatgagtaaagtagatgcacactgggaattaatcgaagcaatcaagacattacgtgatgaaattgcgccaaatacactattaactatcaatggtgatatccccgatagacaaactggtctagaactcgcaaataaatatggtattgatggcattatgattggtagagggatcttccataacccattcgcatttgaaaaggaaccacgcgaacattcaagcaaagaattattaggtttattacgcttacatctctctttatttgaaaaatatgataaagatgaagcccgacacttcaaaagtttacgcagattcttcaaaatctacgtacgcggcattagaggcgctagcgaactccgccatcaattaatgaacacccaatccattgccgaagcaagagaactactcgatacttttgaagcacgtatggatgcacgttcagaagtataa

SEQ ID NO: 703 - DNA, 513 bp, S.epidermidis
caaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataaggatacatttaatctacttaacggcattggcttaatcatattaatcgtcgcttatatcatgttatttatagtcataaagacactagggcgtatttggacattgaaattatttatactgccaaatcaccctattatcaaatcaggattatataaagtaacaaaacatccaaactattttttaaatatcattccagaattaattggtgtattactactaacaaatgctacatacacaacactcttattagttccatatgcttattttttaattgtacgtatccgtcaagaagagaaattaatgaatatataa

SEQ ID NO: 704 - DNA, 978 bp, S.epidermidis
tcattgaaggaggataatatgaagaattataaaaaatatctgattgttttagtattatgtctaacagtgttatctggatgtaacttacccggtttaaaaaatagtcattcagatgacgatgttagaatcacaagtttaggaacaagtgaatcacaaattatatcgcacatgctgagattacttattgaacatgatacaaaaggtgaaattaaacctaccttaattaataatttaggttcaagtacgattcaacataatgctgtcacaagtggccaagctaatatgtcaggtacgcgttatacaggcactgacttaacaggggcgttgaaagaagatccgattaaagatcctaaaaaggccatgaaagcgacacaagaaggatttaaaaagaaatacaatcaaacattcttcaattcgtatggtttcgaaaacacgtatgcattgatagtgacaaaagaaacagctaaaaaatatcatttagaaactgtttcagacttggaaaaacatgcgaaagatttaagagtaggtatggatagttcatggatggaccgcaaaggtgacggttatccagcatttaaaaaagaatatggttatagctttggtactgtgagacctatgcaaattggcctggtttacgatgcacttagttctggcaaattagacgtagcagtaggttattctacagatgggcgtatttcagcatacgatttaaaagtgttggaagatgatcgtcgattcttcccaccatacgatgccagtccccttgcatcagatcaattgttaaaagagaagccagagctcaaaccgattgttaaaaaattagaaggtaagatatcaacagaacaaatgcaagaattaaattatcaagctgatggtaaaggaaaagagcctgcaacagttgcagaggacttcttgaaaaaacatcattattttgaagacgatgacaataaaaaagataaacagaaaggtggtcaataa

SEQ ID NO: 705 - DNA, 1578 bp, S.epidermidis
ctgtcgaaggagatgaaaccgttggaacaagcgatcaatgataataaaaagaaaaaacgttttaactttagaatgccaggtgcatttatgattctctttatcctaacagttgtcgcagttatagcaacttggataatccccgcgggtgcatactcaaaactttcatatgaaccttcatcccaagaattaaaaattgtcaatcctcatcatcaagtaaaaaaagttcctggaacacaaaaggagcttgatcgattaggagttaaaatcaaaatagaacaatttaaatctggtgcaattaataaacccgtttcaattcctaatacttacgaacgtctaaaacaacatccagctggtcttgatcaaattaccagtagcatggttaaaggaaccatcgaagccgtcgatattatggtctttatacttgttctaggtggattgattggcgttgttcaagcgagtgggtcctttgaatcaggattgttagcacttactcaaaaaacgaaaggccacgaatttatgcttatcgcctttgtctccatacttatgattataggcggaacgctatgtggtattgaagaggaagctgtagcgttctatcctgttctcgttccaatatttattgcgctcggatatgattctattgtctcagtcggtgcaattttcttagcaagctctgtgggcagtacattctcaacaatcaacccattctcagtcgtcattgcttctaacgcagcaggaacaacttttactgatggtctttattggagaataggcgcttgtatcatcggtgctatatttgttattagttatttgttctggtattgtaaaaaaattaaaaaagatcctaaatcctcttattcttatgaagacaaagcagcatttgaaaaacaatggtctgtgctccatgatgacggttcttctgagtttacattacgtaaaaagattattcttacgcttttcgtcttaccgttccctattatggtttggggcgtcatgacacaaggatggtggttcccagtcatggcatctgcattcttaatctttaccattgtcatcatgtttattgctggaacaggacaatatggtttaggtgaaaaaggtactgtagatgcattcgttaatggcgcttcaagtttagtaggtgtatctttaatcattggtttagctcgaggaattaacttagtattgaataaaggaatgatttctgacacaatcttgcacttttcatcatctatcgtgcaacatatgagtgggcctttatttatcattgttctgctctttatctttttctgtttaggatttatcgtgccatcatcatcaggattagcagtactatctatgcctatctttgcgccattagctgatacagtaggtataccaagatttgttattgttacaacatatcaattcggtcagtatgcaatgttgttcttagcgcctactggacttgtaatggcaacacttcaaatgttaaacatgcgttactcacactggttacgtttcgtatggcctgttgtcgcgtttgttttaatatttggtggaggcttactaattacacaagttttaatatactcataa

SEQ ID NO: 706 - DNA, 126 bp, S.epidermidis
aatggagaggagtggaataacaggatgcactgtatgaatatgattaaattaatttctacttatacgttaaaacgttactttgtaatgagtgtgccaattttaccttctagtgctgcatctaattga

SEQ ID NO: 707 - DNA, 879 bp, S.epidermidis
gggtcaagtttcaactgtcgcaacaggacaagcatatatagaacaggagacaatgacgcaaatatgaatgagcatacaaaaatagagaaccaattacaatattatttagaacaatttacgtacttacatcaactcgttttggaagatagtcggcatattgttgatttagaaaatttgattgatgaatacagtcaatggatacttcaacctttggcagagcatcattatttaacatggaatgatttagaaacaaaaataagctttaccaagaagcttcaagaggtatcagcaaagtgtgtgaaacaggtagaagtcattcgagcacaacgtttgttgaatggtagggcctccacgtcaggttatttcgaaaatatagagcattgtattaatgaagaattcggaagatggcaaattggacaaaatgacaagttgttactgattgggtcgggtgcatatcctatgacattaattcaagttgctaaagaaactggcgctgcggtcattggtatagatatagattcggaagcagttgatttagggcaacgtgtcgtcaatgtactagctccaaatgaagatatcgttattagtaatcaaacagttgatcaattagaagacatccaatctgtgactcatattattttcagttcgacgatacctatcaaatatgacattttgaatgaactttacacattgacgaatgatgaagttgttgtagctatgcgatacggtgatgatatgaaagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaa

SEQ ID NO: 708 - DNA, 126 bp, S.epidermidis
acatttcaacttagagctcataagccatatggggattatattcaaaataaattctactctatctcattttccacgctcttaatttacctctttattattaacttctttctttttaaaaagccataa

SEQ ID NO: 709 - DNA, 921 bp, S.epidermidis
aaaataaaacttttagaggtgttaatgatgcaaaaagttgttttaacagcagctattactggcgctggagatacaatacaaaaaaatgagaacgtaccagttacaccacaagaacttgcagattcagcaattaaatgtgcacgagcaggagcaactgtcgcacatattcatgtaagagatcctgaaactggaggagtaagtcatgatccagaactgtatgctgaaacagttagattaattagagaagctgatgaagatatcgtcattaatgtgacatctggtggcggtggagacttcattccaagtcttgaacatccagagacaggtggagaaggaacttggatacaaacaccagaagaacgttttaaacctattggtgacttgttaccagaaatgtgtacattagattgtggtagtgtcaacatgggagatgcaatttatttaagtccggcatcatggctacgtaaacaagcacaaatggttaaagatgcaggagtcaaaccagagcttgaatgttttgatacaggccatgtgagttttgccaaacaaatgatagaagaaggattaattgatggagaccctatgttccaattttgtttaggtattccttggggtgcagagaatgatcctgaaacaatagaatatcttaaatcacgtataccagaaaatgcacattggtcagcatttggcattggtaagatgcaactgccaactgtaagaaaagttgcgcaacgtggaggaaatgttcgtgttggattggaagataatatttatttaagaaaaggtgtaaaagcaacgaatgaagcattggtagaagaggcaaaaagaattttagcagaactagatattgagccacttacacctgctgaagcaagagaaaaatttaatcttagaaatcctcatggtaaaggagacaaataa

SEQ ID NO: 710 - DNA, 1959 bp, S.epidermidis
gggaaaaaacttatagaggtgatttttttgaaaaataataatgaaacaagaagatttagcattaggaagtacacggtgggagtcgtgtcaatcattactgggattacaatatttgtcagtggtcagcatgctcaagctgctgaaatgacacaatcatcatcagattctaacgaacagtcacaacaaacagaacaagttgaacacaaagaagatacaactcatttatctaacgaattgaatcaagagggtgagacagcgagccaatcaaagactagtcaagagaatcaatctgatggcaatgtacaaaaaaagagtaatcaaatacaacaagattcaacacaaacgtcaccattaaatgaccaaaaacaaacttcaatggaacaacaatcaaaagacaatcatgttaccccaaattcacgtcaggatacatatccaaaaggccaaaatcaagatgataaaggcaaacaacagtttaaagataatcaacactcacaaacaggacatcaacctaatactcaaaaccaaaataatgatcaagattcatcagataaaaagcaacacccatctgatcaaactcaagactcatcttcaaaaggaacacaacctaaacaatcacagtctatagaagatagagataaaacagtaaaacaaccatcttctaaagtacacaaaataggtaacacaaaaactgataaaacagttaaaacaaatcaaaaaaagcaaacatcattaacttcaccacgcgttgtgaaatcaaaacaaactaaacatatcaatcaacttactgcgcaagctcaatataaaaatcaatatccagtcgtgtttgtacatggatttgtaggtttagtcggtgaagatgcattcagcatgtacccaaattattggggtggtactaaatataacgtgaaacaagaacttacaaaattaggttaccgagttcacgaagccaatgtaggggcatttagcagcaattatgaccgtgctgttgaattgtattattatattaaaggtggacgagtagattatggtgctgcacatgctgcaaaatatggtcacaagcgttatggcagaacatatgaaggcatcatgcctgattgggaaccaggtaaaaagatacatcttgttggacatagtatgggtggccaaacgatacgcttgatggaacattttttaagaaatggaaatcaagaagaaatagactaccaacgtcaatatggtggtacggtatctgatttgtttaaaggtggccaagataacatggtgtctacgattactacattaggaacacctcataatggcacgcctgctgcagataaactagggtcgactaaatttatcaaagatacaattaatagaattggaaaaattggtggaactaaagcgctcgatttagaactaggtttttctcaatggggcttcaaacagcaacctaatgaatcatatgctgaatatgcaaaacgtatagcgaatagtaaagtttgggagactgaagatcaggctgtaaatgatttaacaactgctggagcagaaaagttaaaccaaatgacgacattgaaccctaatatcgtctatacatcgtatacaggtgctgcaacacatactggaccattaggcaatgaagtgccgaatattagacaattcccactattcgatttaacaagtcgtgtgataggtggagatgataataaaaatgtcagagtaaatgatggcatagtacctgtgtcttcttcactacatccaagtgatgaagcatttaagaaggtaggtatgatgaacctagcaactgacaagggtatttggcaagtgagacccgtacaatatgattgggatcatctagatttagtcggattagatactactgattataagcgaactggagaagaattaggtcaatgttatatgagtatgataaataatatgttgaaagtcgaagagttagatggtattacacgtaagtag

SEQ ID NO: 711 - DNA, 234 bp, S.epidermidis
aaaaaaccttggtttcgagaaacacataaaaaacacccccaaccggttcaaatttttatggaccggaataggggccttgaatttttcttaattaaaaaagggttatccgccatttttcaattaggtccaaattttccaaacatgtggtcccaaaattttctaatttcttctttagagatacgaacttctgatgtatctgaaccacgaaagtcaccatggtcccatttatgttaa

SEQ ID NO: 712 - DNA, 906 bp, S.epidermidis
aatttcagacttaggagtgatgttatggaaatcattattatcggtggttttttaggaagtggcaagacctcagcaataaatcatttaatcgctgatgcacttgaaaacaacttaaatcctgctgttattatgaatgaatttggaaaaagaagtgttgatggccaacttatagaacgtcctgaagtacctatgagtgaaatcactgaaggatgcatttgttgtgcgatgaaatcagacgtatcacaacaactacatgaactatacttaaaatatcaaccagatatcatctttattgaatgcagtggtgtagctgaaccactagctgtcgtcgatgcatgcttcacacccgtacttgcaccttttatcactttaaggagtatggtgggaattattgatgcaagcatgtattcacgaattaaatcttatccacaagacattgcagctctattttatgaacaacttcgtcattgttcgactttatttgttaataaaatagataagatagaggtggaagaaaccgcccgcttgctacgtcaactcgagcgtctcaatagcgatgccaatattcaagttggtcaatttggagaattaaatttaaaatcactgctagagccaacacatataaattcaaatgcatgtggcactttgcatagtaatataaatcatcaattcatcgaaaatcctaggctacaaacaaaagaagaaatgattagtgcgttagataacttgcctcaagatgtttaccgtgtcaaagggtttgttcgtttttcagatcagcaacacgtttatttagtacagtatgcacaaggaaatatagaattatctcccattcaacttaaaaacgatgtaccattgtacctcattgttataggcaaacatttaaaacaaatacaacttgatttataa

SEQ ID NO: 713 - DNA, 132 bp, S.epidermidis
agggtgctatgtttatttataagtgttatatttagaaatgacttactgctcattatctataaagatttatacattgaaaatattgattgttttaacaataggaggtcatgttgttattatgagtcagtttaa

SEQ ID NO: 714 - DNA, 159 bp, S.epidermidis
ctaaatcaatgcgaaaagcacatatatcgaaaattcattaaatatatagaagacattcaattaataaagaagaataaccttatttgtaacctcaacttatacttttgccacctctcctattccaataattccatatttaaacattttcatattctataa

SEQ ID NO: 715 - DNA, 720 bp, S.epidermidis
actttaaaatgtaataagtttacattaaagataggtgacatgataaacatgaatatatttgtaactggaacgaatactgacatcggtaaaacgtatgtcactaaatatctctataaagcattaagaacgaggggatatcgggtatgtattttcaaaccttttcaaactgaagaaattggtggaggtagatacccagatttagaaatttataaaaacgaatgcgatttagactatgacgttacgtctctttacacattcaaagatccagtttcaccacatttagcattcaaaattgaaaggcatcagcaattgaaccatcaaacaatgatagacaaactcgaatcactaaaagcacaattcgatatgattctcattgaaggtgcgggcggtattgcagtgcctatctatgaatacagtgaccatttttatatgacaacagatttaattaaagacacatcggatttcattgtgagtgtcttaccttcaaagttaggtgcgattaatgatgccatcgttcaccagaaatatattgatcatcaagaacttcccccgaacgtgttaatcatgaataactatactgatagtgctattgaacaggataatttacataccattgaaaaattaatacacaagtctgtttatacgttaggtcatcaagcgactcaagaaagcttttccgaagcatttatacaacgaattataggaggatccaatggctaa

SEQ ID NO: 716 - DNA, 144 bp, S.epidermidis
ccctcaaaatgttttaacacaataacttcaatacttaataatcatataccaaaactgccattaactaataagttaatggcagaaagtttttatatgaaattatttttcattaccttttttacgacgaccaaatatgaacaatga

SEQ ID NO: 717 - DNA, 804 bp, S.epidermidis
atagaaagatgtgaaaatatgcaacattcaagcaaaataatagtatttgtaagtttcttaattttaacgatttttattggaggatgtggttttataaataaagaagatagcaaagaaacggaaatcaaacaaaactttaataaaatgttagacgtgtatccaactaaaaatctagaagacttttatgataaagagggctatcgtgatgaagagtttgataaagatgacaaaggaacatggattattaggtctgaaatgacaaaacagccaaaaggtaaaattatgacctcaagaggtatggttctctatatcaatcgcaacactagaacagccaaagggtattttttaatagataagataaaagatgatagtaatggtagaccgatagagaatgaaaagaaataccctgtaaaaatgaaccataataagatctttccaacaaagccaatatctgatgataagttaaaaaaagaaattgaaaacttcaaattttttgtgcaatatggaaattttaaaaacttaaaggattataaaaacggggatattttatacaatcctaatgttcctagttattctgcgaaatatcaattgagtaataatgaatataacgtacaacaattaagaaaaagatatgacatcccaactaaaaaagcacctaaactattgttaaaaagggatggcgacttaaaaggatcatccgtaggtcataaagacctagaatttacctttgtagagaataagaaagaaaacatcttttttacggatagtattaattttaaaccgactgagcgtgatgaatcatga

SEQ ID NO: 718 - DNA, 669 bp, S.epidermidis
acagaaaggtggtcaataaacatggaagggaatttaatacaacaactcgttcactactaccaaatgaactttggctacctatgggaattgtttgttaatcatttgttaatgtctgtttacggtgttttactagcatgtttagtgggcatacctcttggtatcatcattgcaagatttggtaaattatcaggtgtgattattactatcgcgaatattattcaaactgttccggttattgctatgttagcgatattaatgcttagtatgggactcggtatgaatacagtcatttttactgtgttcttatatgccttgcttcctattattaaaaatacgtatacaggaattaatgaagttgatccaaatattaaagatgctggaaaaggtatgggaatgacgcgtaaccaagtattaactatgattgagttacctctgtcactttcagttattataggtggtattcggattgcccttgttgtagctattggtgtcgtagctgtaggttcatttattggtgcgccaacattaggtgatattgtgattagaggtacaaatgcaactgatggaacactattcattctagcaggtgcaatacctatcgttatcattgtcatacttatagatgttttattacgtttattagagaaaaagctagatccagctacgtaa

SEQ ID NO: 719 - DNA, 132 bp, S.epidermidis
aaatctttgctcaatcaatatgtgtttgaatatttttcaaaccatccaacaagtaaatttaaagtgcttagaaaaataataattaaagaatacaaaggagaattaatgttaagcatacaaaaacaacgctag

SEQ ID NO: 720 - DNA, 150 bp, S.epidermidis
gatttaattcgtgaatacatgcttgcatcaataattcccaccatactccttaaagtgataaaaggtgcaagtacgggtgtgaagcatgcatcgacgacagctagtggttcagctacaccactgcattcaataaagatgatatctggttga

SEQ ID NO: 721 - DNA, 963 bp, S.epidermidis
atagcaatgctcaaacgtacaattaaattcatactttatttaatcgtaagttcgtttattatcttcattttagttgagaagacatctggtaatccagcgattctgtatctacaacgtcatggttatacgtcgattacgcaagacaatattgaagcggcacaacatcaacttggcttaggacaacatgtgttactaagatatatcgattgggttggacatgcactcacgggcaacttaggatacggctttagtacgaacgaagcagttaccgctatgataatggaagccatcgtgccgacgcttgtgctaatcattgtctctagttgtatcatgttgccatttggctatattgttggttacttcgttgggacgcgtccgcatacacgttacgctaatggaattcgtggattcgcccaagtgatgacctcaatgccagaatactggttagctattttattcatttattatttaggcgtacgttggcaattgttaccatttgtaggtagtgattcatggcaacactttgtgctgccaatcttcacaattgttgttatagaagggtgtcatatcttattgatgacagcacatctgattacacaaacgttagatcaagatgcgtatcaactggcgcagttaagacatttttcgttaaaagcgcgtatcatcgtacaaattaaagagatatttgcaccactaatgacgatttcaattaacagtatcattcatttaattggaaaagccgtaatactagaagtcatcttcagcatgtctggtataggtaaattgttgattaatgctattaaccaacgagattatccactgattcagggcattgtcatctttatcattgtctttattatgctaatgaattatttaggcgatgtgattattttgaagaatgaacctagacttcgacgacgtcatacccagcagtcaggcaatgagaaaagaggtacgatgtga

SEQ ID NO: 722 - DNA, 330 bp, S.epidermidis
aaaggtgtgcttatgcataattacaacaacattaacatcgtaagtgatgattcaaaatatcaagaaatttgttggttccatacattagaaggtatttggcaccctgtagaagtagaaacttcaccattaaatattacatttaataaagatataacacctaattacgtttgtacgttaataaatgaagattccagaaaaataattttaagtaatgtagacaatccgaatatcattattgaaatgattcttattaattcaaaaaaattggtttttaatgctataagtaaagaaggcttaggtacctcgcctaaaatcacatttacaaaataa

SEQ ID NO: 723 - DNA, 129 bp, S.epidermidis
acaattaagcgcgaaaactcagtaatcatttatttaaaagttgtagtcagctatgtgagttttgtggtaatatcatcatgcgtaaaaattcgagattattattataaagaaggtttaaataaatcatga

SEQ ID NO: 724 - DNA, 1035 bp, S.epidermidis
atattaaagcgtaacaatttcgatttaggagatgtacacatgtataaaaaaggtttaattttattttttgtagcagtactaacattggcacttgctgcttgcggtaaagatagtcataatcagtcatctgatcataaaggaaaattagatgtgaacacaacagtctatccacttaaatcatttgcacagcaaattggtggtaaatatgtaaatgttgaatcggtttaccctaaaggcgtagatccacatacatatgatccaagtcaaaaacaaatggtagatattgggaaatcagacttattcttatatactggtgataacttagatcccgtagctaagaaaatcgctaaagctataaatgataaagataaaacactatcactagaatcgactttagataaaaataaagatttattaaaaggcgaagaacatgaacatgagcacggagaaggtcacgaacatggtgaatcacatgaagatgaacacgaacatgaacatcatcaccatggaaaatacgacccacacatttggttggatcctgtagtaagtcaaaaatttgctaaagcgattaaagatgaattgattgagaaagatagcaaacataaatcttattatgaaaagaattacaaccaactagttaaagagttaaaagacttagataaagatatgaaacatgctgtgaaaggtaatgaagataaaactgtttatatttcacacgactctataggttatctagctgaacgctatcattttgaacaagaaggcattgaaaatatgaatgcggaagaaccaagccaaaaagatttaacaaatattgttaagcaaattaaagaagataaagtgaaaaatattttaatagaagaaaatgtatctcataaagtagcagatacggtaagaaaagagacaaatgctaaaacaattaaattttacaatatgggatcacacacaaaacaacaagatgatgacaacaatacttaccaatcatttatgaaagaaaatattaaagctattgaaaaagccctacaaaatgaataa

SEQ ID NO: 725 - DNA, 195 bp, S.epidermidis
tctaatattttagaaggtttacgcgaaaataaccacgctactccgaagaataaaatactaaaaataggcaacaacgcttgggccgtaccagatgaaataaatggtgaaaatgctatttcaaatgacgtcgtcgcaagtcttggcaacgcaaaaaacggacctataacaagatataagccaattgtgaacaaataa

SEQ ID NO: 726 - DNA, 144 bp, S.epidermidis
aaaacaattaggaaaataaaaattaacaaaatcttaataaatatagttttattaaaattacgagcaatttggtatgaattatacatttctaatttaaaaaattattgtgaatttgtattattaaaacgactcactgcaatgtaa

SEQ ID NO: 727 - DNA, 1401 bp, S.epidermidis
cggaagagtaggaggccacttacgatgagcgaacagtttaataaagggaaacaactaattgtagcgattatcttagggattctcacatactggttatttgcacagtcttttttgaatatcgcaccacatgttcaacgtttttatcatgtagatatgagtattgttaatattgcggtcagtctgacatcactcttaacaggtgtatttatagtcgtagcagggggattatctgataaaataggtcgagttaaaatcacaaatgcaggtctaatattaagtatacttggctctattgcattgatcatctcgcatgcaccaattttattattattagggcgtgttttacagggcttatctgccgcatgcttacttccagcaaccatcgcgttaattaattctttcttccaaggtgaagaaagacaaaaggtgcttagttattggtcattcggatcctatggtggaacagggttagcatccctatttgctggaattatagctacatttattggatggcgatggattttcgtgttgtcaatcattttttcaattatcgccttaatattgcttagaggtataccagaatctaaagatgagtctgcatataataaaaaatttgatatcgttggaatcattatttttgttgtcatgatgttaagcattaacgtagtgattacgcaaggagatagaattggatggttaaatcctcttatattgatattaattgctatattcattgtgacattaattgcattttatatatttgaaaaacgtcaagatgaaccttttatagatttaagtttattttcaaataatgtttatattggaacaacattagccaacttgatggtgaacatggatattggttcattagcattatttaatatttatgttcaagacgataagcatttatcagctgcacaagccggtttaattacaattccatatatgctgtgtagtttgttaatgattcgtgttggtgaacgttttatgcaaaaaagaggaccgcaattgccattgatgttaggtccggtatcaattactgttggtattatacttttagcattcacttctttgcctaatatgatttattatattgtggcatgtattggctttatctttataggtctaggattaggattttttgctactcccgcgctatctactgctgtatctaatgttccagctgaaaaagcaggtactgcatcaggaattatcaaaatgacttctacactaggtgcagcatttggaatcgctgttgtgacaacaatatatacggcattatctgtaaatcacccggcatatttagcagctactatcgcatttatcgtgggtgcaggtttagtgtttatcgcatttattgcggcgtattgtttaattcctaaaaagaatgtagatatttaa

SEQ ID NO: 728 - DNA, 144 bp, S.epidermidis
atatttaaaaggtatattgttgcagtaaaaagcagtgttagtaatttgaagttgtatttaataatgcataaaaacaacaacttttcgacaaatatattaacaacatttgacatttcccaatcttattactaccaccatgtttaa

SEQ ID NO: 729 - DNA, 153 bp, S.epidermidis
aaacggggaagaaatagagtaaaagtacagtcaattgtcgaaattaaaaatttagaaaatggaaatatttcccaggaaattgacaacgttagcatattaaaagctagcgttgtttttgtatgcttaacattaattctcctttgtattctttaa

SEQ ID NO: 730 - DNA, 126 bp, S.epidermidis
ataggtatgagtaacgcaggacttaccatcgtaatatatacaagcattgaagaaacagctgaaagtgtgaacactttatttttaaacacacgcatatttaacaatggatgttttaatttaagctga

SEQ ID NO: 731 - DNA, 948 bp, S.epidermidis
aaggaagtgagtgaaatggctaaaattgtagtagctttaggtggaaacgctttaggaaaatcaccacaagaacaacttgaattagtaaaaaatacagctaaatccctagtaggattaattactaaaggtcacgaaattgtgattagtcacggtaatggaccacaagtaggaagtattaaccttggtctgaattatgcagctgaacacgatcaaggtcctgcttttccatttgctgaatgtggcgctatgagtcaagcctacatcggctatcaacttcaagaaagtttacaaaatgaacttcattcaatgggcatagataagcaagttgtcacactagttacccaagtagaagttgatgaaggcgatccagcttttaatagtccaagtaaacccatcggtctgttctacactaaagaagaagcaaatcgtattcaacaggaaaaaggttatcaatttgtagaagatgctggtcgaggttaccgtcgcgttgtaccatcaccacaaccaatatctattatcgaactggaaagtattaaaactctagtagaaaatgacacactcgtcatcgctgcaggtggaggtggtataccagtcattcgcgaacagcatgatagctttaaaggtatagatgccgtcatcgataaagacaaaacaagtgcattattaggtgctgatattcactgtgatcaactcattattttaacagcgattgattatgtttatatcaactatcatactgaccaacaacaagcacttaaaacaacaaatatagatacgcttaaaacatatattgaagaaaaacaatttgccaaaggcagcatgctacctaaaatcgaatctgccatctcctttattgaaaataatcctaacggtagcgtgctcatcacatcattaaatcaattagatgcagcactagaaggtaaaattggcacactcattacaaagtaa

SEQ ID NO: 732 - DNA, 336 bp, S.epidermidis
atcatacggaggtttttttctatgaaaagagcttcttattcagtagaaacaaagtataaagcagttgaaatgaaagcagcaggattttcaacaaaagaaattatgaaagaattaaatattagaaataggacgcaagtgaaaacttggtggcgatggtatcgaaatggggaaagttatagattttcacaacaagttggtaaacaatatacctacggtaaaggattagaagagctgtcagaagtagaacaattaaaattagaaaataagagaaaagatatagaattggatattttaaaaaagtacaaggcattggaaaggaagtggtaccaacagtag

SEQ ID NO: 733 - DNA, 246 bp, S.epidermidis
tataataggaggaacagtaagatgaaagtgtataagttgaattatcaacaccataaagatattgttgatgataatgtattaacgatgttcgtaacagctgacaatcaagatgaagttgaagcgtttgcgaaaaaattacattacaagattgaacatttatctccattaactaaaaaggaatttgaagatgagaaagcgaaagattcacactatagacttgaacacgtggatcactatttaaattaa

SEQ ID NO: 734 - DNA, 2994 bp, S.epidermidis
atacatgggaggtataatatgggcaaacgtagacaaggtcctattaataaaaaagtggattttttacctaacaaattaaacaagtattctataagaaaattcactgttggtacggcctcaatattacttggttcgacacttatttttggaagtagtagccatgaagcgaaagctgcagaagaaaaacaagttgatccaattacacaagctaatcaaaatgatagtagtgaaagatcacttgaaaacacaaatcaacctactgtaaacaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctagctagaaaagaagatatccctgctgtttctaaaaacgaggaattacaatcatcacaaccaaacactgacagtaaaatagaacctacaacttcagaacctgtgaatttaaattatagttctccgtttatgtccttattaagcatgcctgctgatagttcatccaataacactaaaaatacaatagatataccgccaactacggttaaaggtagagataattacgatttttacggtagagtagatatcgaaagtaatcctacagatttaaatgcgacaaatttaacgagatataattatggacagccacctggtacaacaacagctggtgcagttcaatttaaaaatcaagttagttttgataaagatttcgactttaacattagagtagcaaacaatcgtcaaagtaatacaactggtgcagatggttggggctttatgttcagcaagaaagatggggatgatttcctaaaaaacggtggtatcttacgtgaaaaaggtacacctagtgcagctggtttcagaattgatacaggatattataataacgatccattagataaaatacagaaacaagctggtcaaggctatagagggtatgggacatttgttaaaaatgactcccaaggtaatacttctaaagtaggatcaggtactccatcaacagattttcttaactacgcagataatactactaatgatttagatggtaaattccatggtcaaaaattaaataatgttaatttgaaatataatgcttcaaatcaaacttttacagctacttatgctggtaaaacttggacggctacgttatctgaattaggattgagtccaactgatagttacaattttttagttacatcaagtcaatatggaaatggtaatagtggtacatacgcaagtggcgttatgagagctgatttagatggtgcaacattgacatacactcctaaagcagtcgatggagatccaattatatcaactaaggaaataccatttaataagaaacgtgaatttgatccaaacttagccccaggtacagaaaaagtagtccaaaaaggtgaaccaggaattgaaacaacaacaacaccaacttatgtcaatcctaatacaggagaaaaagttggcgaaggtgaaccaacagaaaaaataacaaaacaaccagtggatgaaatcgttcattatggtggcgaagaaatcaagccaggccataaggatgaatttgatccaaatgcaccgaaaggtagtcaaacaacgcaaccaggtaagccgggggttaaaaatcctgatacaggcgaagtagttactccacctgtggatgatgtgacaaaatatggtccagttgatggagatccgatcacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaataa

SEQ ID NO: 735 - DNA, 195 bp, S.epidermidis
cgtatttatggttattggtcattgattccaaagtttagttattatatttttaatgaaataccatgccattttcatatctttaacagtataaataattacattatctttttaaaaataaaatatattaagattttctttttcatttttaatatcatcatatcagtttatttacccaccttaccattagcgttataa

SEQ ID NO: 736 - DNA, 318 bp, S.epidermidis
tcctcccatggaaccatttgctttaagccttctcttataatcctttcatcatcacaaataactactttaaacatctttattcctcctagacaagtggtatttggtaacacattaatgtcccttgctggcttcttgagaaaatgtgcagacgtgcatatgttccatattgaatcatggctctattatgtaaatgatttaaacctaggtgtgtcgtatcaaaaacatcgtgatgaagggattggcgcacgtgttctaaatgtgatggagacataccgatgccattatcatgaaccagaatatgtaatttgcgcttcgtaa

SEQ ID NO: 737 - DNA, 3246 bp, S.epidermidis
atcaagccaggccataaggatgaatttgatccaaatgcaccgaaaggtagccaagaggacgttccaggtaaaccaggagttaaaaaccctgatacaggcgaagtagtcacaccaccagtggatgatgtgacaaaatatggtccagttgatggagatccgatcacgtcaacggaagaaattccattcgacaagaaacgtgaattcaatcctgatttaaaaccaggtgaagagcgcgttaaacagaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattactacaccaactactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgatcacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaagatgaatttgatccaaatgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaagaaatcaagccaggccataaggatgaatttgatccgaacgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaggatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaatgcacctgtagatagtaaaactgaagttccaggtaaaccaggagttaaaaatcctgatacaggtgaagttgttaccccaccagtggatgatgtgacaaaatatggtccgaaagttggtaatccaatcacatcaacggaagagattccatttgataagaaacgtgtatttaatcctgatttaaaaccaggtgaagagcgcgttaaacaaaaaggtgaaccaggaacaaaaacaattacaacaccaatattagttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttagtcggatctctattagcaattgtcggatcattgttcatatttggtcgtcgtaaaaaaggtaatgaaaaataa

SEQ ID NO: 738 - DNA, 1128 bp, S.epidermidis
attcagaaaggatgtactatcatgtctcatcatcgcatcatcatcatcggcgcaggagccgctggtgtgggtatggcaatcactttacaagaattcaatattaaagatgttctaattgttgaaaagggaaccatcggtcattcatttaaacattggcctctatcaacaaagaccatcacaccatcatttacaactaatggttttggcatgccaaatatgaatgcaatagctaaagatacatcacctgccttcactttcaatgaagaacatttatctggaaaacgttatgctgaatacctctcactagtagctacgcattacaatctaaatgtcaaaacaaataccaatgtttcacgtgtaacatacatagatggtatatatcatgtatcaacggactatggcgtgtatacagcagattatatatttatagcaactggagactattcattcccatatcatcctttttcatatggacttcattacagtgaaattcaaacattcactcaattaaaaggtgatgcttttacaatcattggtggtaatgagagtgcttttgatgcagccataaaccttagtcaaacaggtgcaaaaatatcaatatatacatctaaaactggacttaaaaaggaagatgcagacccaagtataagattatcaccgcatactcaacagcgattacagaatgctatacaagagggtgcattaatcgaaatgcatgttggctaccaggcacgcaaaataacatatcaaaatcattcctataagatacactttgataatggacatattgttcactctcatactgaaccgattattgcaactggatttgatgttacccaaaaccctttaatagaacaactatttcaagtacgacaatcagaagttcaattaacagaattagacgaatctacaaagtttcctaatgtatttttaattggggcgactgtacgtcatcaaaatgccattctttgttatatatataaattcagagcacgttttgcagtattagcacgcatagtaagcctacgcgaaggcttacctgaagatacgtctttaattcagtcatatcgtcaaaaaaatatgtttctagacgattatagttgttgtgatgtgaattgcacatgttaa

SEQ ID NO: 739 - DNA, 939 bp, S.epidermidis
gtggaaagggggagtcaaaaggtgaaaacgctaatgattaaagcaatggggacggtgatacgtttatcgattgaacatcaacatccggatacattacttcaagaagctgaaataaaaattcgtgcttgggaatcacaatttagtgctaatgatccgaaatcagatttgatgaatgtgaatcaacatgcaggtatcgcaccagtcaaggttagttctgaaatctttaacatgatacgttatggttatgaaactacattatcttctaattttaagatgaacattttgatagggccactagtcaaattatggaaaattggttttaaagatgcattgaaacctaaagaagtggatatacaacgtgctttattgtgtatgaatcctgaaaatcttgttctaaattcaaaaacacatgaagtatttcttacacaatcaggaatggagattgatttaggagccatagttaaaggttattttgctgatcaattacagcaatactttttagctcatggtgtatcttctggcattatcgatttaggtggtaatgttttaacaattggtagacaacccgaaacattagaaaaatggcatgtaggtgtacgtaatccatttcataaggatacactaccactcgttacattaagcgtagagcatcaatcagttgtcacatcaggtatctacgaacgctacttcatacaggaaaatcaattatttcatcatatattggattcaacaacaggttatcctgtagataatgatatcgctagcgtgacaatcatatctgatcatgggattgatggcgaggtatggagtacaatttgtagttttggtcagtcacaaaaaaatattgaattattaaatctcattgacggtattgaaggcattattgtgacaagagatggaagcgttttaatgacttcgaaaatgcaaaagtatttataa

SEQ ID NO: 740 - DNA, 984 bp, S.epidermidis
tgggatattatgaaagttaaactttatacgttgttattattactcatttttctgatagcatgcgctccaacatcgacttcacaatcacctcatcctttacgtacgttgattgtttattctccttatccatcacatttaattcgtccgattttaaatgattttgaaaagcgagaacatgtgaaagttgaaatcaaacatggctcaactcaagtattactatctaatattcacaaagaagcactttctaaacgtggggatgtctttgtgggtggcgtgttatcagagatgatagatcatcaagaagattttgttccttaccataatcgttctacactgaaacaaatagaggattatcgctctaacaacccattagtcacgagctttctattgatgccaacagtaattgtagtgaatacagatttacaaggtgatatgactattcatggatataaagacttacttcagtcttcactaaaggggcgtgtcgtttattctaatcctcattctacgacgacaggataccaacatatgcgtgcgatgtatcatatgcgtcaccaagtaagcgatgttcatcaatttcaacaccatgctgtacagttatctaaaagttctcaagtgattgaaaaggtggctaaaggtgcttattacgctggattgagttatgaacaagatgctagaacgtggaaacaaaaaggataccctatctcaatcatttaccctactgaggggacgatgttaaatgtagatggtattgctttagttaacaatgcacaacctcatcccaaacgtaaaaagttagtacaatatttaacaagccgttctgtacaacaacgtttggcagaagaatttgatgctaaatcaatacgtaaagacgtgactgaaacaaatcactcatctattgaaaacttggatcatattccactaatcccacaatcacgtgtatccaatattccacatcatcaatttttggagatgattcaatga

SEQ ID NO: 741 - DNA, 777 bp, S.epidermidis
gccaagattatggctcatattacattaaattatttatctaaaactttaggaatgcatcaaacgattaatgtcattcttccagaagataaaagttactttgatacaaatgaaaatgcgaaaccattaaaaactatgttattgctacatggtttatcaagtgatacttcctcttatatgagatatacgagtatagaacgctacgcgaatacccaccaactagcagtggtgatgcctaatgccgatcatagtttctattcaaatatggcttatggacatagttattatgactatatactagaagtttatgattatgttcatcaaatattgccattgtctaaaaagagagaagataattttatagcaggtcactctatgggaggttatggtgcaatcaaatttgcattaacgcaaagttatcgtttctcaaaagccgccatgctttcagcgccatatgatgtttctatgattggtcaatatcaatggtatgattttacgccagaagcgattgtaggtaatacgcaacatgtcgcggggacatcttttgatccatactatttagttgaacaagcaatagacaatggacaagcgttaccacaactatatattacttgtggaactgaagatgaactgtatcaaggtaatattgattttgtgaactatttagatgaaaaaggtattccatatcaatttaaaaaagcgccaggtaatcacgattatgcattttgggataaagcaatagaagatgtcattgaccgttttacatcatcacatatttaa

SEQ ID NO: 742 - DNA, 393 bp, S.epidermidis
ttagtttatattataaatatattaatatttaagattttaggagatgcacaaatgcttaaaattaatttttttaataaggaatatggagttttaaaatcacaaaattacgaaagaatttcactagaattattgaacaaacattaccatataactgaaaatgattttaaaaacaaagattattgtttggataaatttaatagtaaagatacatttattggcgatatagcacatacagagaaagagttaatttctttaattgaagataatattaaaaatcctaaaaatatggagcatcaaaatctatcaagcatattcgattatacagatcatcataataaccaacgtgtctatcacagtattttagatcttatacaagacaatacgtcttcttaa

SEQ ID NO: 743 - DNA, 774 bp, S.epidermidis
tcaccgtatattcatggctattatttatacggtagcgataggtattatatatttatggattcaattgtaaaggagtcatattcaatgatagatattcaaaatgtttccaaaagctataaaaagaagcatattttcgattccctagatatgcaatttcaaaatcataaaattactattttattaggtgaaaatggtgctggaaaatctacattattgcgtttaattgcaggtattgagaatgcagacgaaggacgtattcaatacttcaatcaatatttgtcaagacgtcgaatacgtcatattgtaggctatgtccctcaagacatcgcactattcgagcatatgactgtcatggagaacattgagtttttcaagtcactttgtgaaaatcctatttcagatgaaacacttcattcttatttatcacaattaaactttactgatacaaaagtgaaagtatctaacctttctgggggaaataaacgtaaagtcaatattatgataggtctacttagtcggcctaaaatacttattctagatgagccaacagaagacattgatttagaatcaagatatgatattcacaacttattacaacaaatgaccgatcaatgtttaatcatcatgacgacacatcatttagacgaagttgaagcactagcagatgatattaaagttataggtcaaaatcctttttatcatgatattttagaaaataaaggttggtcttttaaaaaatatgcaaatgccttagctgataatacgaaatcttaa

SEQ ID NO: 744 - DNA, 243 bp, S.epidermidis
acttatcatataatatatgttcctctgtcaacgtcggttaattatgaaaaaatattaagtagctccattccgttgcttaatacttttttattcacttttaaaaatccaagaaaagagagaacgaattcgccctctcttttttgtgtagtagtactattaaattttatctcactaacaattaatatacttattactaaaatgatgtatttaaaaactataataatcttgaaatataataattaa

SEQ ID NO: 745 - DNA, 219 bp, S.epidermidis
ataattaatattgaagctacccaatatgagggtagagctgttagtagaaaagctattgaacgtatagcacgatctggaaatctaccactagtcaaagcactcactatgcctagtacaacagacgttatcatcaccacaacactggaaatcaaagtgagttttaatgtattcataaacgctggccccatacgctcagatactggatcccctgtgatataa

SEQ ID NO: 746 - DNA, 129 bp, S.epidermidis
tataacaatataaatgaagttcaaaagggtggaggacggttaattgaaaaagtttttaaaaggatttattttattttttctcattgtgatgctaggatttgcagggggattgggatacagtcattataa

SEQ ID NO: 747 - DNA, 396 bp, S.epidermidis
gaagcaaatatttcattaaaaataaggtgcatatcaatgaaaagattgatttttatagttgttattctctttatccaagcctgtagttatgttgttattaactttttcttcttcgacatgtgggtgattcactctagtgaacaacaattaaatcaatccatacaacatcatgacacaaagcaacttcataagattgctaaagataagcagacatatcagtttttaaaaactataaaaaaagccgatttcgaaaatgcgacagataaccaaggtggtgggcctattggttattatcgtttagatattaataaaaaacccgtcggacttacaatcaatattaaatataacttccttccagaaaagacaactattaaatcaataaagttatatcaataa

SEQ ID NO: 748 - DNA, 3054 bp, S.epidermidis
tgtgaaaatattcacaaaaaactaggaggatttgctatgagtaaggaaatattcgatacttttaaatttaaatgtggtgccgaattaaaaaatagagtattaatggcacccatgactatccaagctgggtattttgatggaagtgttacatcagaaatgattgattattatcaatttagagctggtgatgcttcagcaatcattgttgaaagttgttttgttgaaaatcacggacgaggatttccgggagctataggtattgataatgatgacaaaatacctggactcaaacgtttagcagaagcgattcaagctaagggatcaaaagcgattttgcaactttatcatgccggaagaatggcaaatcctaaatttaatgaaggagagcagccgatatctgcgagccccattgcagcattaagacctgatgctgtaccacctagagaaatgacacatgctcaaatcaatcagatgattgatgactttggagaggctacacgtcgcgctatagaagcggggtttgatggtgtcgaaattcatggcgccaacacatacttattacaacaatttttctctccacattctaatcggagacaagattcatggggaggcagtcgtgaaaaacgtacacgatttccaatcgaagttttaacaaaggttcaacacgtcgttgctgaaaaagaggcttctcattttattataggatatcgattctcacctgaagaaattgaagaaccaggcatacgttttgaagataccatgtttttactaaatacattagcagaatatgaacctgattacttccatatatcagcaaacagttatcaacgtacatctattgtgaatcaagaagatacagaacctttaattaataagtacatcaaaatgcaaagtgcacagttggcaaaaattccattaattggtgtaggtagtattgcccaacgacaagatgcagaacatgcccttgaactaggatatgatcttttaagtgttgggaaagcctatttagtggaaccacaatggacagataaaatttcacaaaacgaagaagtagaacaatttgtcgatatacatgatcagaaagtacttcacataccatcccctttatggaaagtaatggactttatgattttagataaagaagaagagcatcgtaaatatgaaaaattaaaagcacttcaaaataaaaaagttaaatttaacaaaggtacgtatcatgtctatgcaaaaggtcataatggcaacttacctatgaaagtccaattatcagaagataagattgtaagtatcgaggtagatgatagcggagagtctgaaggcatagcgaacccagtgtttgaacgtttacctcaagatattatcaatgggcaaacactgaatgtagatgtcatttcaggtgcgacagtaacaagtgaaggcatcgtgcaaggtattgcagatgcaattgaacaagcaggagaagacccagatattttacgggcgcgtcctaaaccagtcgttcagtggtctgatgaggtcgttgaagagacgactgacgtcgttgtgatcggtacaggaggtgccggactcagtgcagctgctacggtattagatgaaggaaaagaagtcatcatgcttgagaaatttgcggctataggtggcaatactatccgtacaggtggtcaagtcaacgctgctgagcctaaatggcaaaatgcattcccggcacttgctggtgaaaaagagacactcatacagttattaaatcatgatgaaaatgatatagatgaagcttacattgaagatttcaatactttaaaacgtcaaattaaagactaccttgaaaatagcagtaatgaagatgaatatctttttgattctgtcgaattacatcgtattcaaacatatttaggtggtaaacgtaaagatcgtaataatgtcgaaatatcaggtgattatgatttagttaaaacactcacagataacgttttggaatcagtatattggttgaaagacaaaggtgtacattttgatcgttcgtttgtagatatgcctgtaggtgctttatggcgtcgtggtcataaaccaatgaaagcacaaggtttagagtacattgaaaatttaggagactacgttaaacataatcatggtcgtatttttacagaaactactgcagaaaagttaatcaaagaaggtaatcaagttgttggtattgaagcacgtaaagcaaatggtgctaaagtgaagattcatacacgtcatggtgtagtgttggctactggtggctttggagcgaatacaaaaatgctacaacaatataatacgtattgggataatattcctgatgacattaagacaacgaattctcctgcaattacaggtgatggtatacgtttaggtgtgcaggcaggcgctgacatcgtaggtatgggattctctcaaatgatgccgatttctgatccgaagacaggtgcattgtttactggattaattgtaacaccttcaaactttgtcttcgttaataaggaaggacagcgttttgttaacgaatttgaaagtagagatgtattatctaaggcagcattagaacaaaaagacggtatcttctatattattgcagatgcaaatattaaagcactagctatgaatacaactgaggataaaattaatcaagaattagaagacggcactttagtaaaagcagataccttagaagcattagcccaaaaattaaacattgatacaactacttttgtgaacacgattgaaagatataataccttcgtagaacaaggacaagatgaggatttcaataaaaatgcatttgatttaaaaattgaaaaagcaccattctacgcgacaccacgtaaacctgcaatacatcatactatgggtggtttaaaaataaacacgcatgcacaagttatagatgttgaaggtcatatcattgaaggtttatatgcggctggtgaagttgccggtggtattcatgctggtaaccgtttaggcggaaatgcactggcagatatttttacttttggtcgcattgcaggtcaaagtgctgtaacgaaataa

SEQ ID NO: 749 - DNA, 1221 bp, S.epidermidis
gtatgtctaataaagaaattaaaaaaatggttaaaattttcaacaaagccttacatcaaacattgggtaagaagtaagaggggatttatggacattaaagcacagttaaaacagattcaagataaaggtttatatagagagcttcagccgattcagtccgtagaaaaacaatatatttatatcaatgaccaatcttatattaattttacttcgaacgattatctcggtataggacaacttgaatatcaacctcaaaatttcttagattttataaagacatatagtatccatctatcaagttctagattagtgagtggcaactcagtcgtttatcagcaattagaacaggcaattagcgagcattttaattttgaagacgccttaatttttaatagtggttacgatgcgaatttggcggtatttaatatttttaaaaataataatgtagttatcttttcggatcaacagaatcacgccagtataatagacggtattaaattaagtggtttatcaaaagtgatttatcaacatttaaactatgatgacctggaaagtcatttagcacggcacaccaatccagatgttcaaaaagtaattgtctctgatagtgtgttttctactaatggcactaaagcagatattaataggctagtacatctcaagcaacgttacaatgcgattttaattattgacgcatctcatagtttaggattaaatctctttgagtatcatgcagacattgacatagttacttcaagtttatctaaagcgtggggagcccatggtggcttaatactaagttcaaaagatataaaagatttaattattaataaaggtcgttcgcttatctactcgagtagtttacctagctatcatttgtattttattcaagtgagcttacaacatgtgattgaagatacatacagacgagagaagttgaatgcacttagtgaatattttaaccaccaatttatggaattatttcccaatcaaccattatctaatacacctatcaaaaatatcgtttgtgatagtttggcttcagcacaagcacaatacgacatgttatttgaacatggtatatttgtcagttatttaaggtatccaacagtgtcacagccaacattaagaatttcattatcctattttcatgacacagatgatattaatcgacttttcaatgtaatgaaacaatacgatgaaggtgatagctatgtatag

SEQ ID NO: 750 - DNA, 141 bp, S.epidermidis
cctatcataataaaaataaagcatccttcactttacgatgagggatgctttatgaattttcatataaaaattaaatctgcagactattcttttttattcaattctttatcaagttttacaagtgttggttttggaatatga

SEQ ID NO: 751 - DNA, 321 bp, S.epidermidis
tgtgactttttcaaaaaaatgtgtcgtaaaattcttgtatataagcatactatcacagtaattaagggtttctttctccacacttcacacaatttttttaatacccctttactatcaatagttatcgagtttaactacataccttttgatattggtaagcttaataaaacttttcaaacatacaaacaattgaatataccattattattcaaaagaatcctttctaacgaactatatactataattaaagttttacaaaaatttgaaagtctaaattttacatattttatatatatagcgcacttcattattatgctataa

SEQ ID NO: 752 - DNA, 885 bp, S.epidermidis
ggtgaatcaatgaataaattatcaaagtacattgcaatagctacattagcatcgacagttacaatttcagcaccaattcatacatatgcatgtgaatctcatactaaagataaccataatcaaacgacacaacatcaaaatgaccccaaccttggtgaacaaaatgtaatggctgtctcatggtatcaaaattctgccgaagcgaaggcactttatctacagggatacaatactgcaaaatatcagttagatgaacatattaaaaagaataaaggtaagaaaaaacttgctatagctttagacttagatgaaacagttcttgataattcaccatatcaaggatatgcttctatgcacgatacgtcttttccagaaggatggcatgaatgggttgctgcagcgaaggcaaaacctgtttatggcgccaaatcattcttaaaatatgctgacaaaaaaggtatcgatatttactatatttctgaccgtgataaagaaaaagattttaaagctacaaaggaaaatttaaaaaatattggactaccgcaagcgaaagataatcatattttactaaaagggaaaaacgataaaagtaaagcatcacgacgtcaacaagtcgaaaaaaatcataagttagtgatgttatttggtgacaatttgttagattttacagatcctaaaaaatctactgctaaagaacgtgagaaactcgtgaagaaacatgcaaaagattttggcaaaaagtatattattttcccaaatccaatgtatggaagttgggaatcgacactttatcataatcaatacgaaataagtaagaatgagaaggatgaactacgaaaggcatcaattaaacaatttaatcctaaaacgggtgaagtaaaataa

SEQ ID NO: 753 - DNA, 1365 bp, S.epidermidis
gaggatccaatggctaatacacgagagttaaatcataaagatgcacagtatgtatggcacccattcacacagatgggagtctatgctaaaaatgacaatattattattgaaaaaggtcgcggaagttatttatacgatactgaaggtaataaatatttagatggttatgcgtcattatgggtcaatgtgcatggacatcagcataaaaagttaaataaagctattcataaacaacttgataagattgcccattctacgctattaggttcgtctaatattccatcgattgagctagccgaacagttagtcaaattaacaccagatagattacaaaaagtgttttactccgatacagggagtgcgtcggtagagattgctattaagatggcttatcaatattggaagaatatcgatgctaaacgatatgcgaagaagaataaatttcttacattacatcatggatatcatggagatacaataggttctgttagcgttggtggtatcgatagtttccacaaaatttttaaagaccttatttttgaaaatatacagatagaaacaccgtgtttatataaaagtaagtaccgcaatgaagcggaaatgcttaattcaatactgaatcaaattgaaaatatattatctgagagaaatgatgaaatagtaggatttattctagagccacttatacaaggtgcaacaggtttattcgttcatccgcatggttttttgaaagctgtagaacagttatgtagaaaatatgatgtattactaatttgtgatgaagtagctgttggtttcggacgtacgggagaaatgtttgcttgtaaccatgaagatgtacaaccagatattatgtgtctgggtaaggcgattacaggtggttatttaccgttagcggcaactttaacatctcaaaagatatatgatgcttttttaagtcagagtcacggtaagaatacgtttttccacggtcatacatatacaggtaatcagttagtttgttccgtagcacttgagaatattaatctttttaaaaagaagcatctgattgggcacattcaaaagacatctcaaacattaaagcaacgcttagaggcacttcaacctcataaaaatattggagatattaaagggcggggattaatgtatggtgtggaattagttgaaaacaaatcaacgcagacaccactcgatattccaactgtagaactgattatacgtcgatgtaaagagaatggattgatgattcgtaatttggaaaatgtcatcactttcgtacctattttaagtatgtctaataaagaaattaaaaaaatggttaaaattttcaacaaagccttacatcaaacattgggtaagaagtaa

SEQ ID NO: 754 - DNA, 588 bp, S.epidermidis
ataattacaattatatattatttagaattcgataaagaaggtgacgaaatgcctagaatttccaaaagacaattaatattagaatcggccgcagctattattaatgaaaaaggtgctgattatctcacgttggatgctgtagctcaaagggctggaataagtaaaggtggtttattttatcattttaaaagtaaagatgaactcatcaaagagctggttaactatgccaataatttgtacagagagaacgtgaaccaacatatcggtaatgaaaagaacaaaaaagggcaatggctcaacgcatttatagaagcgacaagagcacatcgtacggataatgcgcctattacttctggaatgttagcggcgcaagggactaatagaagtttattatcaccattaaagacctcatatcaagaatggcaatatcaaattacccacgacgggttagatgaggtagatgcaaccattattcgtttagctgtcgatggtttatggttgtcggaaatattcggaattagtgctatagatgaagaaatgagagagaaagttattgaacgtttaaagatgcaaatagaaaaaaagtaa

SEQ ID NO: 755 - DNA, 816 bp, S.epidermidis
atgtatacaataatagagagatgtgaaaagatgaaatattatgggaagtgcatttcttacataagcattttaatattaacgttttttattggcggatgtggatttatgaataaagaaaataataaagaagcagagattaaagaaaattttaataaaacattaagtatgtatccaattaaaaatttagaagatttatacgataaagaaggctatcgtgatgaagaatttgaaaaagaggacaaagggacatggattattaattcagaaatgaatattcagaaaaaaggtcaagcgatgaaatctagaggtatggttttgtatatgaatagaaatactagaaagacgactggtcatttttatacaaatataattacagaagataaaaaagggagagtgcacagtaaagataaagaatatccggttcgccttaaaaacaataaaattgaaccgactaaatctatcgccgatgaaaaattaaaaaatgaaattaaaaactttcagtttttctctcaatatgggaattttaaaaatttaaaagactacaagaatggaaatgtgtcttataacccaaacgtaccaagctattcggcagagtaccaattaagtaatgaagatgacaatgtgaagcaactcagaaagaggtatgatattccgattaagagagctcctaaactaatattaaaaggggacggtgaccttaaaggttcatctataggttataaagatatcgagttttcttttgtcgacaataaagaagaaagcgtctactttgtggatagtttggaatttaatccaagtgatgtaaataatgagtag

SEQ ID NO: 756 - DNA, 156 bp, S.epidermidis
atgttcacaattatatcaaatattaatcaaagaataaattttactcttttaaattatgcttctttgaatctttttaataaaaaaagagtggaacagaatccatacagaattctttattccactctcacaaaactaactagagttgacagcctttaa

SEQ ID NO: 757 - DNA, 195 bp, S.epidermidis
gttattcaaatgaatcattttggtaagcttcatcgtatatcattaatattaaatattatgtttttaatactcatgcctaaaatctatagttttgataatatttatttatcaataatttggactttgttaggaatagcaaatgctgtctacttattgattaagcaaaaacaagaaaacaccattaaacgtaaataa

SEQ ID NO: 758 - DNA, 978 bp, S.epidermidis
aggagacaaataatgaaattcgcagttgttggaacaggtgtaattggtagtggatggattactagaatgcttgcgcatggtcatgaagtgattgctactgatccaagtgaaggtgcatatgaacgcatgttgacacaagttaaacaaaattggccttacgcagagcaaatgggccttgctgaaaatgcatcaattcaaaacctaacatttacaccacatttagaagaagcggtcaaagatgcggatcatattcaagaaaatgtaccagaagtagaagaaattaaagatgctgtattaaaagagattgatttttatgcgaaacctgaagcaacaattggttcaagtacatcaggaattatgccttcagaattacaagctaacttatcacatcctgaacgattagttgttgcccatccatttcacccggtatatattttgccattagtcgaaattgtgccaggtaagcaaacatctgaagaaacaacagttaaagccgaacagatttatgaaagtattggtatggatgttttacatgtgcgtcatgaaatagaaggacatattgcagatcgtcttatggaagcattatggcgtgaatcattgcacatagttaatgatggtattgcaacaacagaggaagttgataaggcgtttacccatgcagcaggtttacgttatgcacaatatggtccatttatgacgttccacttggcaggtggtgaaggtggtatgcgtcatatgttaaaacaatttgggccagctttaaaaaaaccttggacaaaactcatcgcgcctgaactgacagatgacctatatcataaagtagtaagtggtagtgaagcatcttctcaaggatatacaatgtctgaacttgatcaaaaaagaaacgaatttctaattaaagtgaaagaattagcagaacaatattggccaagtgatagtaaagcgatgaaaaagtctaacggagcggaattacaatga

SEQ ID NO: 759 - DNA, 1257 bp, S.epidermidis
aaagtgaaaatcattactaaaaatgaggaggactgtgaaatgactgtattgagtgagcaagacaaaataagattattagctgatatcgtcaagattcaaactgagaatgatcatgaaattgaagtatgtgagtacttaaaagacctgttaagtcaatatgatattgattctaagattgttaaagttaatgattcacgcgctaatttagttgctgaaattggtagtggcgctccagtcttagcaatcagtggacacatggatgttgtagatgctggtgaccatgatgattggacttttcctccatttgaactcacagataaggatggcaagttattcggcagaggtaccactgacatgaaaggtggtcttatggcgatggtcatcgcgatgattgaattgaaacaatcaaacgcattaaagcaaggtacgatacgtttattagctactacaggagaagagacggaacaatatggtgcacaattacttgctgatgaaggttacttagatgatgtgagtggtttaattattggcgaaccaactagtaatatcgcttactatgctcataaaggttctatgagctgtgtagtcacagcgaaaggtaaggctgcacacagttctatgccacacctaggtacaaatgctgttgatattttagttgattttgtaaatgaaatgaaacaagaatataaaaatattaaagagcatgataaagtacatgagctagacgctgttccaatgattgagaagcatctccatagaaaaattggtgaagaagaatcacatatctactctggatttgtaatgttaaactctgttttcaatggtggtaaacaagttaattctgttcctcataaagcgacagctaaatataatgtaagaactgttccagagtatgacagtactttcgtgaaggatttatttgaaaaagtcattcgtcatgtgggtgaagattatttaactgtagatatacctagcagtcatgatccagtggcaagtgatcgtgataatcctcttattcaaaatattacacgtattgcaccgaattatgtacatgaagacattgttgtgagtgcattgattggtacaactgatgcatctagtttcctaggaacaaatgaaaataacgtagattttgctgtctttggacctggtgaatctattatggcgcatcaagttgatgaatttattagaaaagatatgtatttaagttacattgatgtttataaagatgtatttaaagcatatctagaaaaataa

SEQ ID NO: 760 - DNA, 2271 bp, S.epidermidis
caatacgaaatggaggcggagagtatgttagaaacaaataatcatactaatgcttggcaaggatttaaaacaggtcgttggaataaaaatatagacgtgagagaattcatacaattgaactattcattatatgaaggtgacgatgaatttttagaaggtcctacaaaagcaactgaaactttatgggatcaagtaatgcaattatcaaaagaagaacgtgagcgcggtggcatgtgggatatggatactaaagtggcatcgacaatcacttctcatgacgctggttacttagacaaagatttagaaaaagttgttggtgttcaaactgaaaaaccattcaaacgttctatgcaaccattcggtggtattcgtatggcaaaagcagcatgtgaagcgtatggttacgaattagacccagaaacagaaaaaatcttcactgaatatcgtaaaacacataaccaaggtgtattcgatgcatattcaagagaaatgttaaattgtcgtaaagctggtattattactggtttaccagatgcttacggacgtggacgtattatcggagactatcgtcgtgttgctttatacggtgtagacttcttaatggaacaaaaacttaaagactttaacacaatgtccactgaaatgtctgaagatgtgattcgtttacgtgaagaattatcagaacaatatcgctcacttcaagatttaaaagaattaggacaaaaatatggatttgatattagccgtcctgctactaacttcaaagaagctgtgcaatggttatacttagcatatttagctgctatcaaagaacaaaatggtgcagcaatgagtttaggacgtacttcaacattcttagatatttatgctgaacgtgatttacaaaatggtgacatcactgaacaagaagttcaagaaatcattgaccacttcattatgaaattacgtatcgttaaattcgcacgtacgcctgaatataatgaattattctctggagatccaacttgggtaactgaatctatcggtggtgtaggtattgacggccgtccgatggtaactaaaaactcattccgtttcttacactcattagataatttaggtccagcaccagaaccaaacttaacagtattatggtctacacgcttacctgaaaacttcaaaatctattgtgctaaaatgagtattaaaacgagctcaatccaatatgaaaatgatgatttaatgcgtgaaagctatggcgatgattatggtatcgcttgctgtgtatctgccatgaagattggtaaacaaatgcaattcttcggtgcacgtgctaacttagctaaagcattactttacgctatcaatggtggtaaagatgaaaaatctggcaaacaagttggaccaagttatgaaggtattaaatcagacgtactagattatgatgaagtcttcgaaagatatgaaaaaatgatggactggttagctggcgtatacatcaactcattaaatatcattcactatatgcatgataaatacagctatgaacgtcttgaaatggctttacatgatacagaaattattcgcacaatggcaactggtatcgctggattgtctgtggcagctgactctttatcagcgattaaatatgcacaagttaaacctatccgtaatgaagaaggtcttgtaactgactttgaaatcgaaggcgacttccctaaatatggtaataatgacagtcgtgttgatgaaattgcagtagatttagttgaacgtttcatgactaaattacgtagccataaaacataccgtaattctgaacacacaatgagtgtattaacaattacttcaaacgttgtttatggtaagaaaactggtaacacaccagatggacgtaaagctggcgaaccatttgcgcctggtgcaaacccaatgcatggtcgtgaccaaaaaggtgcattatcttcactaagttctgtagctaaaataccttatgattgctgtaaagatggtatctcaaatacatttagtatcgtaccgaaatcactaggtaaagaagaagcagatcaaaataaaaacttaactagtatgttagatggttatgcaatgcaacatggtcatcacctcaatattaacgtgtttaatagagaaacattaattgatgcaatggaacacccagaagagtatccacaattaacgattcgtgtatctggatacgctgtaaacttcattaaattaacacgtgaacaacaattagatgttatttcacgtacattccacgaatctatgtaa

SEQ ID NO: 761 - DNA, 504 bp, S.epidermidis
cggagcggaattacaatgatgaatcaacagtatgtgtttcacacaaaagtacatcgtgattgggtagatcataacgggcacctaaatgatgcaatgtataaccgaattttcagtgatacaacagatgattggttaggtcatttaggcttaactattaatgccattcaatcttatcaatataccgtattcaccttagaaaatcatgtcatgtttcttaatgaaatgaaagaaaatgaagatgtcattgttaaagtacatcttcacgattatgatagcaaacgattacatgtcctaatggaaatgtttaatgcagatgatgatttatgtgcaacatatgaagtgatgctgatgggcattgatacgacttcaggaagaccttcagcctttccgaacgacattttgaataacattgaacactattataatattgagaatgtggagatgacatctcaatatataggtcatcgtattggcatcaagaaaaagccaaaaagcaaagagtaa

SEQ ID NO: 762 - DNA, 291 bp, S.epidermidis
ctaagcaccttttgtctttcttcaccttggaagaaagaattaattaacgcgatggttgctggaagtaagcatgcggcagataagccctgtaaaacacgccctaataataataaaattggtgcatgcgagatgatcaatgcaatagagccaagtatacttaatattagacctgcatttgtgattttaactcgacctattttatcagataatccccctgctacgactataaatacacctgttaagagtgatgtcagactgaccgcaatattaacaatactcatatctacatga

SEQ ID NO: 763 - DNA, 255 bp, S.epidermidis
tacgttatgatggattttttacattacatactgccagtcattatatacgctgttttgcttgctattcattactttttatcgcgtacgggaaataaaatattaggccttattgtgcctgttggtgtgattgcaagtcttgtatatatgtatcaagccgatattatacatatgaaaatgattggcgttattattataggtattgtggctctattattcttggcagaggagtggcagagagcacaaaaggataaataa

SEQ ID NO: 764 - DNA, 642 bp, S.epidermidis
gacaccatgataaagtttatttcggaacatagtggtatgttatttgcaaagactttcgaacatttgtacatatcgatagtggcattggttattgcaatgatcgtagcggttcctttaggcattttattatctaaaaaagaaaagctttcgaaagtgtcattgacgatagctggcgttttacaaacgatacctacattagcggtattagctttaatgattccattatttggcgtaggaaaaacacctgcaattatagcgttatttttatatgtattattaccaattttaaataatacgattataggcattcaaaatatagattccaaccttagagaagcaggacgtagtatgggaatgactaactttcaattgatgaaagatgttgagttgccactcgcattaccattaatacttagtggaattagactgtcttcggtctatgtcattagttgggcaacattggcaagttatgttggtgctggtggtttaggtgattttatctttaacggattagcgctatttgaaccgagtatgattattactgcaactattcttgtcactgctattgcacttattgtagattatgttttatcactgattgaaaaatgggttgtacctaaaggattaaaagtttccagataa

SEQ ID NO: 765 - DNA, 192 bp, S.epidermidis
ttaaactcgataactattgatagtaaaggggtattaaaaaaattgtgtgaagtgtggagaaagaaacccttaattactgtgatagtatgcttatatacaagaattttacgacacatttttttgaaaaagtcacactatcaaaaattaaaaaatattattataataaatgttgtgaaaaacgtattagattaa

SEQ ID NO: 766 - DNA, 711 bp, S.epidermidis
aacaatacgatgaaggtgatagctatgtatagtataaaaatgcgtgcaagccacgaagatgttcatattagtggtgctgaaacaatgtgtgaatttgaggatttagaaaattatttaaaaaaatattttaataaagcctttaatcatgaaaatggaaatatagatttcttaaatttgaaaattgaaaaggttaaggcaccgattcaaacgttagtagcattaccagtggttgaaaatctaaacgatactttaacacaattagcaaaacaaacaggtgtttctgaatatgcgctaaacaaagggttagaatttataaaaaatgatattacttatactggagccattattctatctgcacaaaccggacaacgacttgatagcactgaacaacgaggtatcagggtaacacaattagcatttaaaacatgcaaatgtaatggagaaatatcagaaagagtaaaagatgcacgtgcacttgcaacttgtatcaatgcatttgaaggtgtaaaagcagaactatgtgtatcagacgatttgcattacacgactggatattttgcgtcgcctaagttaggatatcgtagaatctttaatattaaagaaaaaggtacgcgtcacggaggaagaattatcttcgtagacgaaggaataaatttaaatgaatatgtttcctttttagaaacagtacctaaagaaattatagaaaaataa

SEQ ID NO: 767 - DNA, 171 bp, S.epidermidis
tcttattttgtcttgctcactcaatacagtcatttcacagtcctcctcatttttagtaatgattttcactttttaataaaaaataaaaatccttgtacacttaatattatcaaaaacttttatttattaaaaattatatgccaaaataaatggatttttaataaaaaataa

SEQ ID NO: 768 - DNA, 579 bp, S.epidermidis
agaatgaatgtagcagatatcaaagcacgcttattagatttagaaaatacttttaaagaaaaagaaagtgaactgactgatttagacagagctatcggtgatggagatcatggtgtaaatatggtcagaggtttcgaacacttaaaagaaaaaatagatgatcaaagtatgcaagcgctatttaaatcaacaggtatgacattaatgtctaacgtaggtggtgcttctggaccattatacggatttggttttatcaaaatggcgagtgcagtgaatgatgaaattgatcatgataatcttaaagaggtacttaaagcgtttgctgatggcattcaacaacgtggtaaagtcgaattaaatgaaaaaacgatgtatgatgttatcgaacgtgcgagagaagctgttgaaaaaaatgaaacagtagatctagataaactacaatcatttgctaatgaaaccaaagatatggtagctactaaaggccgtgcatcatattttaacgaagcttcaaaaggttatattgatcctggtgcacaaagtagtgtttatattcttaatgcaattataggaggagagtaa

SEQ ID NO: 769 - DNA, 228 bp, S.epidermidis
aatatttgcttcttatatttaatttatcataatattgttcagtttaacttaaaattcacgatgttcaatatatattcatcattctatattttgtataaaaagcatggactatatttaacagtttgctcatttacttttcggcccactatatgtttaagtaatcagtctaaaacttatttttatgtcacttttgtaaattgctcgagatttactactactaaatattaa

SEQ ID NO: 770 - DNA, 948 bp, S.epidermidis
aggagcgtcgtcatggttaaatttattatgaaacgtcttacgctcatgattccattattgattgtagtgacttttatgactttcatgatgacctatctcacgaacgaagatccagccgtaacaattttacatgcccaaggaacgcctaatataacgcaagatttaatagctgaaactaaagaaaaatatggattaaatcaaccgatattcacgcaatataaaaattggcttgttgatgccttgcagtttaaatttggaacgagttatatcacaggggatccagtatctgagcgtatggggccagcgtttatgaatacattaaaactcactttgatttccagtgttgtggtgatgataacgtctgttgtactaggcatagtgagtgctttgactagtggtagatttccagatcgtgctatacgttcaatagcttttctactaacagctctaccctcatattgggtagcttcaatattaattatttatgtatctgtaaaactcaatttattaccaacctcaggactcactggtccagaaagttatattcttccagtctttgttattacgattacctatgcaggaatttattttagaaatgtccgacgatctatgcttgaacaattaaatgaagattatgttttgtatttaaaagctagtggtgtacctcgtctgacaatgttgctgcatgtattacgtaatgcattacaggtagccatatctattttttgtatgtcgataccaatgattatgggaggtctagtcgttattgaaaatgtatttgcgtggccgggtttaggaccattaagtattaaagcgattactgaacatgattttccagtaattcaagcatacgtgctcattgtcgcggtgttgtttattctttttaatacacttgcagacatcattaatgcaatattaaatccgcgtttaagggaggcaatgaaatga

SEQ ID NO: 771 - DNA, 165 bp, S.epidermidis
agaccatcagtaaaagttgttcctgctgcgttagaagcaatgacgactgagaatgggttgattgttgagaatgtactgcccacagagcttgctaagaaaattgcaccgactgagacaatagaatcatatccgagcgcaataaatattggaacgagaacaggatag

SEQ ID NO: 772 - DNA, 774 bp, S.epidermidis
ttgacgatggtaaacattatggaaaaatttaaattaactggtaaggtggcaatggtcattggaggtgcaactggcattggtaaagctatggcagaggcattagcacaagcaggggcaaatatcgttatcgctgatttgcaatccaatattggtcaagaaacagccacaactatatctacacaatcaggtgttaaaaccacatcattaaaattagatataactcatctagatgaagtaaatcaaattgttgattatgtagtaagggaatatggaaaaatagatattcttgtcaataacgctagtatctcaattcaagatgatactgaaaatatttcgtatgaagaatggttaaaagaaatcaatttaagcttaaatggagcattctctgtagcgcaaacagtaggacgtcaaatgattgagaagggcagtggttcgatgattaatgtctcttcagtattaggattgattgctaataaaacgcaagaccagagctcttatgaaacgtctaaagccggtgtgacgatgctgactaaaagcttagctagagaatggtctagatatggaattaaagtaaatgcaattgcccctggttacatgagaacaatcgaaacggaaaagatactaaatgataatactgaaacaaatacaacgcctatggaacgagtaggtgagcctgaagaattagctggaataacagtttatcttgcttctgatgcatcatcgtttactcaaggtagtgtatttaatattgatggcggttattcagcattataa

SEQ ID NO: 773 - DNA, 585 bp, S.epidermidis
ttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttag

SEQ ID NO: 774 - DNA, 1422 bp, S.epidermidis
tgtgatatattttttttaacgaagatgataggggtgttagggatgaacttttttgatattcataaaatgccaaacaaagggataccattatctgtacaacgcaaattatggctcagaaactttatgcaagcgttttttgtcgtattctttgtttacatggcgatgtatttaattcgaaacaattttaaagcggcacaaccgttattaaaagaagaaatcggattaacaacattagaactaggttatataggattagcgtttagtattacttacggtttaggaaaaacaatactcggttatttcgttgatgggcgtaatacgaaacgtattatttccttcttattaatattatctgcgattacagtacttattatgggatttgtattaagttatttcggttctgtgatggggctattaattgtattgtgggggcttaacggtatatttcaatctgtgggtgggcctgcaagttactcaacgatttcaaggtgggcgcctcgaacaaagcgcggtcgttatttaggcttttggaatacatcacataacattggtggtgctattgctggtggtgtcgcactttggggcgcgaatacatttttccacggtaatgtggttggaatgtttatttttccttccgtcatagctttaatcattgggattgtgacattatttattggtaaagatgatccagaggaattaggttggaatcgtgccgaagaaatttgggaagagcctatcgaccaagaaaacattgattctcaaggtatgactaaatgggatatctttaaaaaatatatccttggaaatcctgtgatttggattttgtgtatctctaatgtttttgtatatatcgtgcgtattggtattgataactgggcaccgctatacgtatcagagcatttacattttaataaaggtgatgcggtgaatactattttttactttgaaataggtgcattagtagctagtttattgtggggctatatctcagatttattaaaaggtcgtcgtgcgattgtagcgattggatgtatgtttatgatcacctttgttgtactcttttataccaatgcaacaagcgtgacaatggtcaatatttctctatttgcattaggcgctttaatcttcggtccacagttactcattggtgtatctctgactggctttgttcctaaaaatgcaattagtgtcgctaacggtatgacaggttcatttgcatatctattcggggattcaatggctaaagtgggtctggctgcaatcgctgatccaacacgtaatggtttaaatatttttgggtatacgttgagtggttggacagatgtctttattgtattctatgtagctttattcttaggaatgatattattagccattgttgcttattacgaagaaaagaaaattagaaaattaaaaatttaa

SEQ ID NO: 775 - DNA, 135 bp, S.epidermidis
ttcatctctttcattctcatttttaagatgaaatcacattgttcacattttgtctttatgcctcactatcgcacatacttccttattcaattaaatcgcacctccttcctatttcctataaaaaacaccccgtaa

SEQ ID NO: 776 - DNA, 1632 bp, S.epidermidis
gtttacatattttcgaaaagaaagaggaaaacaatgaataaactcacaaaactaagtacagtcatttttgtatctgggattattttagccggttgtggaagtaacaaagaactaacagagaaaaaagagaataaagtattatcatatacaactgtcaaagatattggagatatgaatccccatgtttatggaggttcaatgtccgcagagagtatgatttatgagccgttagttcgcaataccaaggatggtattaagccattattagcgaaaaaatgggacatttcacctgatggtaaaacatatacgttttatttaagggacgatgtatcttttcatgatggtacgaaatttgatgcagacgcagtgaagaaaaacatcgatgcagtacaacaaaataagaaactacattcatggttaaaactttcaacactgattgatgatgtcaaagttaaggataagtatacggtacaactacatttgaaggaagcttatcaacctgcgttagcagaactagctatgccacgaccatacgtttttgtatcgcctaaagattttaaacacggtacaaccaaagatggtgtgaaatcatttgacggtacaggaccatttaaaatgggtgaacacaaaaaagatatatctgcagaatttaataaaaataatcaatattggggagaaaaggcaaagttaaataaagtagaagcaaaagttaaacctgctggagaaacagcatttttatcaatgaaaaaaggagaaaccaactttgcttatacagatgatagaggtacagacagcttagataaagatagtttaaaacaattaaaagaaaccggaagctatcaagtaaaacgtagccaagccatgaatacaaaaatgcttgttgttaattctggtaagaaagatagtgcagtcagtgataaagcagtcagacaagcattaggtcacatggtaaatagagataaaatagctcaagatattttaaacaagcaagaaaagccagccacacaactatttgctaaaaatgtgacagatataaactttaatttaccaacaagaacatatgataagaaaaaagcacaagcgttattagataaggccggatgggtgctttcaaaagatcgacaagttcgtcaaaaagagggcaaagatttgaatcttaagttgtattatgacaaaggctcttccagtcaaaaagaacaagctgaattcttagaggcagaatttaagaagttaggtgtacaactagatataaacggagaaacgtcagataaagtagctgaacgtcgtagttctggtgattacgatctaatgtttaatcaaacatgggggctattatatgatcctcagagtacattagcagcatttaagacgaaaacgggatatgaaagtgcaacattaggtattaagaataagtcacaactgtacaaagatattgatgaggcgttcaaaattcaagatgcaaaggcacgttcaaaagcgtatcagcaaattttgaaacaagttgacgatgaaggtgtctttattccaattactcacgggagaatgactgttgttgcacctaaagatttacaaaaattatcctttacacaatcacaatatgagcttccatttaatgaaatgcaatataaataa

SEQ ID NO: 777 - DNA, 516 bp, S.epidermidis
ttcatgatattatgcttcttctgcaagtattccatatgtcaaatctttattatgtatgaatcctacactcattcatcacaaataagaggtagctactctatgtcaaaaaagaaaatcttgatctttattagtgtcatattaatcatttttggaggtgtctacctcaaaatgaaatatgacgaaaaagcaaaacaaaaagaaatctactacaaagagcaacaagaacgtatcacgctttatcttaaatacaacacaaaaaaacctaatactatcaaatctgtccatttcacaagtttaaaacagggaccaatgggtgatgctattattgaaggctatatcaataacaataaagaaaatgaatttgttgcatttgcatcatctgaagataattttcaattccaaggtgatatgatagaaagcaaaaaagtatcaaatctaataaaatatcaaacaaaaacacctgatgaaatcaaaaaagatttagacaaaaagaaaaacgctaaagatttttactga

SEQ ID NO: 778 - DNA, 210 bp, S.epidermidis
tgtcctccattgtttgttatatatattcttttgctcgtacaatacaaagtattttatatagaaaatgtttcaaatgccattaactatttattaactttagcaccaactcataactcttctaacacctcacatattaagttcagtttttcggataatttaatacttttaaggatattaagcgcttacattgatgtgatatattttttttaa

SEQ ID NO: 779 - DNA, 1026 bp, S.epidermidis
accgttaaatttgaaaaagcgattggaacaggtgcatttgttgttgataaaactgttaaggaaaaaacgacattgaagcccaataaatattttgaccacggtcacccaatcaattatcatcttgcattccaaacgattgaagatggggactccagaaattctccagtacaaagtggttttgtagatatttctggtggtgctttaggtatgctctcagacgaacaaatcaaacaagataagaaaaataagaacttaacgattgaagatagacctagcacagtaagtcactttatggcatttaaccctaaaaatgatgtattaaatcaacgcacaattcgtgaagcgataagtaagagcatcgatgcgaaagacattgcgggcaaatctgtaaatggtctgttccagaagaacgtacaatttgtgactaaaaataatcaacagccacacgattatgatatgaaagcggctgaaaggttacttaaatcagaaggatatcataaaaacgatgacggcatctttgaaaagaatggcaaacctttatcatttaacttagtcattcaaactgcagagttcccaaattggaaagataaagctgaaaaagtgcaacgtcagcttaaacaagccggtattaagttaaatgtgaaaacgttagattcacaatcatactatgatacattatggacgaaaaaagactatgatttgattttctatagaacgtattcagatgcattaatgccttacaactttataagttcagtgtttaaaaataatgatggtcaaccaggggtgttagctgatgatgaaacattaacgaaacagctagacgatttcccatcaaccgtatcaaaagaagaccaacagtgttcatttgatgacatatttaaacactttaatcaacaatactatggtgtgccaattgcttatccaaatgagacgtttgtagtgagtgataaagtaaaacaattcaaattctctggacttacggatgcaccaattgattataaagcgttgaaagttaatgaatag

SEQ ID NO: 780 - DNA, 762 bp, S.epidermidis
ggggtgatttcaatgcttaaggttcaaaatgttattaaattttatggaaaaaaatcaatgtttcgtgataaacgtattcctgtagttaaaggcgtgtcatttgattgtcccactggtgcatcagtagcaattattggtgaaagtggaagtggaaagtctacgttgagtcgtatgattttaggactagaaaaaccagatcaaggacaagtgactttggacggtcagcctgttcatttaaaaaaagtgagacgtcatcgaattgctgcggtttttcaagactatacttcttctttgcatccttttcatactgtcaaagatattttgtttgaagtaatgaatcaatgtcgatgtacatcgaaggagaatatggaagagtatgtaacagtgttactacgtgaagtagggttaaaatctgattgtttgtattgttatccacatatgctttcaggtggagaagcacagcgtgtagctattgcacgtgcgatatgtatgcaaccagattatatattatttgatgaggcgattagttcattagatatgtctatgcaaacacaaatattagatttattgaaaaggttacgtcactcacaccagctgagttatatctttattactcatgatatacaagctgcgacatatatatgtgatgacttgcttatttttaaaaatggttgtatcgaagctaggacatctataagtgaattgcataggcaacaaaatggttatacaagagaactgattgataaacaactatcaatctaa

SEQ ID NO: 781 - DNA, 1221 bp, S.epidermidis
caaattgaattacctatagaaaggaatggacatatgttaagtattaaaaacttatcaaaggtctatgcaggtggtaaaaaagctgtagataatatgaccatagacattgaatcaggagactttattgcatttattgggacaagtggtagcggtaaaacaactgcccttagaatgattaatcgtatgattgaatctacagagggagaaattaccattgacggtaaaaatatcaaagagcttaatccggttgagcttcgtcgcagtatcggttatgtcatacaacaaatcggcttaatgccacatatgacagtgaaagagaatattgttctcgtaccaaagttattaaaatggtcacaagagaaaaaggatgagaaagcgaaagaacttatacgcttagtagatttaccagaagaatatttagatcgatatccttcagaattatcaggtggtcaacaacaacgtattggtgttgtaagagcactcgcagctgaacaagatattattttaatggatgaaccgtttggtgcactcgatccaataacaagagatacattacaagacttagtcaaaaaattacaacaacaattaggaaagacattcatttttgttacacatgatatggatgaagcaatcaaacttgcagataaaatatgtattatgacaaatggacaggtggttcaatatgacacgccagataatattttacgtagtccagcgaatgatttcgttagagactttattggtcagaatcgcttaattcaagatagacctaatatccgtacagttaaagatgcgatgattaaacccgtgacagtacatgttgaccgttctcttaatgatgcggtgaatattatgagagagaaaagagtcgatacgatatttgttgtcggcaatgatgagcatttattgggttatttagatattgaagatattaacgaaggattaagacatcataaagaacttatagatacgatgcaacgagatatttatagagtacgtattgatagtaagttacaagattctgttcgtacaattcttaaacgtaatgtacgtaatgtacccgttgttgacagtgataataaaacattattaggccttgtcactcgagctaaccttgtagacattgtttatgacagtatttggggagagttagaatcggataacaatgataatcattctgggattgttgaacccgaatccacaggagttgagacaccatga

SEQ ID NO: 782 - DNA, 861 bp, S.epidermidis
agccatgattcaatatggaacatatgcacgtctgcacattttctcaagaagccagcaagggacattaatgtgttaccaaataccacttgtctaggaggaataaagatgtttaaagtagttatttgtgatgatgaaaggattataagagaaggcttaaagcaaatggttccatgggaggactatcatttcaccactgtttatactgccaaagacggcgtggaagcattgtctttaattcgccaacatcaacctgaactcgtcattactgatatacgaatgcctcgaaaaaatggtgttgacctactagatgacatcaaagaccttgattgccagattatcattttatcgagttatgacgacttcgaatatatgaaagccggtatacaacatcatgttcttgattatttactaaagccagtagaccacactcagttagagcatattctagacatattagttcaaaggttattagaacgcccacattctaccaatgatgacgcggcatatcatactgcctttcaaccattattaaaaattgattacgatgactattatgtcaatcaaattttgtctcaaatcaagcaacattatcacaagaaagtgactgttcttgacttaattaatcctattgatgtaagtgagtcatacgccatgaggacgtttaaagaacatgtaggcattacgatagttgattatctaaatcgttatcgtattttaaaatcattacatcttttagaccagcactacaagcattatgaaattgctgaaaaagtaggtttttctgagtataaaatgttttgctatcattttaaaaaatatttacatatgtcaccaagtgattataataagcaatcaaaatag

SEQ ID NO: 783 - DNA, 261 bp, S.epidermidis
tgtgacgattctatcaatagtggcaaaacagtatacagcttcacactcgacaatgtcaaaaatgaaactaacacaagaagcaactgtacatggtatagatgttgcatttatttttactacagtattaatcattattggatttatcttagcgttattcataaaagaagaaaaaaatcattaattattcaaaaaaactgtataagagagaccgaattatgggatgaacctgggacacaaatcgatgttccaggttttttataa

SEQ ID NO: 784 - DNA, 168 bp, S.epidermidis
gcactttgttctgagctacctgaagcatatgatacgtttaccgtacttaaaacggatgctgctacgattgatgaagcaagcgtcgtcttacccattttgttcataaatttcataaataaattgcctcccaatatgtatgataaatcaagtatagaagacaaactttga

SEQ ID NO: 785 - DNA, 144 bp, S.epidermidis
attatcagttccacaatgacaacgtttttttatttctacattttttatattcctcatctaattatttcattagatatgcctaaaaaaatactttccttcacttcattatttatttatttaaaaataagccttgtacatatatga

SEQ ID NO: 786 - DNA, 126 bp, S.epidermidis
attaaaatctctttttatttaattatactttatcattttattgttgaaaattataagaatttttatgtcgtttgtgacaaagtacgtaaacatacattcaaatttaaaattaatctatttatttaa

SEQ ID NO: 787 - DNA, 156 bp, S.epidermidis
cttgttgtctcaggttttttagtgtgtaacattactgtgatagatttgtacgatgattgtttaaatataaaaattaagatatgtatctctaaaacgttgtgtaacaatatttataaattaaagtttataataatcttgaggagaggattaagatga

SEQ ID NO: 788 - DNA, 126 bp, S.epidermidis
gcaccatcctcggttaatatgcaaccatggagaattgctgttgatgaaagtgatgaaatgatagaaaaagttatgcactcatttggattcaattccagacagttaacaacatcctcagctatgtaa

SEQ ID NO: 789 - DNA, 366 bp, S.epidermidis
aatgcccactcaataacaccccaatataaaatatctgaaccaataccggcacagaataacatggctgcccatgtgaaattattaaattcaggtttgtcagtcgcttttcctaacgtgacattcccatacttaccaaatgctatgtataaaacaaaacaaaatatagccagtcccataaagagatataccgatccaattgaattagaaatggcactattgatatcggtaatgattatttcacttgctttcggaaaaaccatcataggtataacagcaaaaagtaacacaatgactacgcctatgaaggtcgtccagtccataactttttcctttttcaaatgtgatccccctaatattaatttatga

SEQ ID NO: 790 - DNA, 2217 bp, S.epidermidis
tattttagattggtgcataataaagataaattaatgaggtgtatgtatagtatgcaaactcgattgggagaaaaagatattaatttaccgcagtattacaacaatagggagttaagttggctagattttaactatagggtattacaagaatcatatgataaaaataatccgttgcttgaaaaacttaattttatttctatcttcagttcaaatttagatgaattctttatggttcgagtggctgggttaaaagaccaagtcaaaatgggatatgacaaacctgaaaataaagcacaaatgacgcctcaagaacaacttgatgctattaaaattaaaaatacagactatgtgaacactcaatatcaacgttataacgaattaattaaagaattagccaattacgatattgagatggtaaaacctgaagacttatcagatgcattgatagaaaaattagaacaagagttcaagttaagtgtcttgccgacactcactccgttaggtattgatgcgtatcatccatttccaaagttaaataataaaagtttaaatatttttgttgatatcgatacggaagatgccattaattcagctatcgttcaaattccttcattaattccacgctttttaactttaaatgagggtacaaaacaatacgttgtcatggtagaagatgtgattacgtatttcatcaattatttatttacaggatacgaagtactaaatacttttactttccgaatcacacgtaatgcagatttaaccattcatgaagatggcgctgaggacttgcttatagaaattgaacgtttcttaaaagaacgtaagagtggttcggctgtacgtttagaattagattgtcgcacttctgaaaaagagaatgtagaatggttaatcaatcaattagaaattgaagataatgatatttattatttagatggtccacttgatttaacattcttatttggattggttgatcatctatctcataagctcaaatatttaacgtatgagaaatatactcctcaaccacctagatcattaggcaacaagaatatctatcaattatcattagaaagagatatattcttccaccatccgtatgaatcatttgaaccaatagttgactttattcgacaagcagcagatgacccaaatacaatcgctatcaaacaaaccttgtatcgagtgagtaaggattcgccgattattaacagcttaaaagaagctgctgaaaacggcaagcaagtaacggtgctcgtagaattaaaagcacgctttgatgaagaaaataacgtacattgggcacgtatgctagaagatgctggctgtcacgttatttatggtatgacacatctaaaaacgcatagtaaaattgcgctagtcgttaaacgcatcaacaatgaacttacgtcatttgttcatttaggcacaggtaactataatgataaaactgctaaattatacacagatatgggtatcattacgacaaataaagatatcgctgaggatgcaattaacttctttaattacttgagtggttactcaacaaaaccagaatacaataaattgattgtagcaccatacgatattcgagacgtcttcattgatcgtatcgataaagagatacgtagtcatttacaacatggtaatggtaaaattatgatgaaaatgaactctttaaccgataaaacgattatcgaaaagctcttcgaagcatcccaagcaggcgttaaaatacaactcatcattcgtggtatatgttgtcttaaaccaggcattccaggtattagcgaaaatatagaggttgttagtatagtgggtcgtttgcttgaacattcacgtatttactacttccataataatagtgaggcgcatatttatttatcttcagctgacgttatgacacgtaatatgattaaacgtgtcgaaatattgttccctgttgaagataaatcaataggacaacgattagttaactatatgaatttacaattatctgacaaccaaaaaggtcgttaccaagatgcacaaggcctttatcattatgtcgaaaacaattcatctcctttaaactctcaatcttacttgatgcaagaagcaattaagtatggagaagaactaaaaaaacaatcggtacaaccttctggacaacctgttcattctagacgtggcggtagttggatgcgaaaattaaaaaacacatttaaaagataa

SEQ ID NO: 791 - DNA, 591 bp, S.epidermidis
acagcaatatctttcaaaaggggcaagctaattatgaatatatataataaagtgacattatctgtcattttagttataacaattatcatttcgttcctcttttatttttatacaacagagaaaaaagtggacaaagataaattgtatgaaaacaaaattacaaatcataaacaagcaggtaaacctaaaaattatggtgtcgcatctaataataaaatagctacgaaagtcggaaataagattattgaagatggtggaaatgcggttgatgcggcaataggtgtttcttatgcactagcagtgacagaacctcattcatcaggactaggaggtggcggtgcgacacttacatataatggtaaagagaatgaaacgcctaaagcttatgaatataaaacaatgtcctcatatgaatataaagaaggcgacaaaattggagttcctggcttcgtgagaggattacatgatatgcacgcgaaagaaggaaaaatggatgagaaaaagattttagattacgttattccgcttgctaaagatggttttgaggtagattcagaactagtaaagaagtttgaaattatatggtcgtga

SEQ ID NO: 792 - DNA, 192 bp, S.epidermidis
  unsure (182): Identity of nucleotide sequences at the above locations are unknown.
tatttagtatcaacttatttaataaagcctctagaaactgaatttaaacagtctctagaggctttattattaattatcgatatatatgcatttttttcctggggcattataactattttccaaagtgtgctttttaattttaatgaattgtttagagttaggaataatagatgggaaaatancaaattttga

SEQ ID NO: 793 - DNA, 231 bp, S.epidermidis
tttgaagtatcattttgtttatttttgcgattgtgttctatttttttatcattcttattagaattcgtatggtggttaatagctgcatataatgaaaagcccaatgcgcatataagaatgattactactattgtagctgaaaattttttcaaagcgtatatcctccatcctttttatcaactatattttattataatccttttttttattgtaagtagaattattctataa

SEQ ID NO: 794 - DNA, 747 bp, S.epidermidis
aagagggtatcgctcatgattgaattgtctcatatccataagtcttttaatgaaactgaagtgattaaaggtattgatttgaaaattaatcaaggtgaagttgtgacactaattggacgttcaggttcaggtaaaacaactttacttagaatgattaatgctttagagatacctactgaaggtacagtgtatgttaatggcatgacatataacactaaagataagaaatctcaaattaaagtaagacaacaatcaggaatggtttttcaaaattataatttatttccacataaatctgcattagaaaacgttatggaaggtcttataacagttaaaaagatgaataaagcaacggctaatgaagaagcaatgaatttattggctaaggttggattggtacatgttaaagatcaacggccgcatgctttatcaggagggcaacaacaacgtgtcgcaattgctcgtgcattagccatgaatcctaaagtgatgttatttgatgagccaacatctgcacttgatcctgaattggtcaatgatgtattaaaagtcattaaagaattggctgacgaaggtatgacaatggtcattgtgactcacgagatgcgttttgccaaagaagtttccaatcaaattgcttttattcatgagggcgtcattgcagaacaaggtacgcctgaagatatatttaatcaccccaaaacagaagagcttcagcgatttttaaatgtgattaatgaaaaatag

SEQ ID NO: 795 - DNA, 390 bp, S.epidermidis
atagctggatttgtactccactgcattaaattccacataaataagccaactaataataatcctgttcctggtaataataagttaagaattatcatcattattataaatattgaaatcgaaattattaaccaacgcttactagtaaacttatcagataaaacaccgcctaatgaagtaccaatcacacctgctacaccattaacaagtagtgctaaagacacaaaagacatttcatgtccattggataaaattaatggattaataaacacgaatgttacagaattagcaaccagcactaaaaatgtaatcatcagatatttaaaaacctcacgaggtcttatgacgcttgagccagtttgtgattcaatactagatgaacgaggtgtttga

SEQ ID NO: 796 - DNA, 150 bp, S.epidermidis
ttaaatggatttatttttctaatgttgattagtataatatttgtattaaggcgtaattcatttttgttgatacttgtcaactatataaaccataagataaattatatcaaattctcatttgttatgacaataactaaaaataatttttaa

SEQ ID NO: 797 - DNA, 1401 bp, S.epidermidis
atgaatacatcacaaaagtttaggggagataatcgcttattattagggattattttaggggttattacattttggttatttgcacaatcacttgtaaatctagtcgtgccattacaatcatcatacaatagtgatattggtactattaatatagcagttagcttatcggcactattttctggtctgtttattgtaggtgcaggagatattgcagataaaattggtagagtaaaagtgacatacataggcttagcacttaatattgttgggtcggttttaatcattattacgccattaccaagtctattgattattggacgtgctattcaaggattgtcagcggcatgtataatgccagcgacactcgcaatcattaatgaatattatatcgggacagcacgacaacgtgcattaagctactggtccatcggttcatggggaggtagtggtgtttgtactttgtttggtggtttaatggcaactaaccttggatggcgctcaatctttattgtttcaattattctgacaatattatccatgtttctcattaaacatacacccgaaacaaaagcagagcctataggagatcaaccgacagagacaaagaaatttgatgttgttggtttaatcatcttagtggttagtatgttaagtattaatgtgataataactcaaacctctcaatttggtttgttctcaccatttattttgggacttattgcaatttttgttatatcgttaattatattcgtgatttacgaaaataaaatcaaacaaccacttgtcgattttgatatctttaaaaacaaaggttatacaggtgcaacgatttcaaactttatgttgaatggtgtagctggtggtacattgattgtagtaaatactttttatcagcaaaaattagattttaactctcaggaaacaggatatatttcacttacatacctaattgcagtattaattatgatacgtgtgggtgaaatgatattacaatcgttaggacctaaaagacctttgttactcggaagtgccttgaccgtcataggattaatattattatctttgacgtttttacctaatgcttggtatatagcgtcaagtgtcattggttatttattatttggtaccggtttaggtgtttatgcaacaccatccacggatacagctgttgcacaagcaccagatgataaagtaggcgtcgcatccggtgtatataagatggcatcatccttaggaaatgcatttggtgtggccatctcaagtacagtttacagcgtacttgcagcccaacttaatctgactttaggtggttttactggagtaatgtttaatgcgcttatagcattattagcattcctttctattttgttcttaataccgaaaaaacagtctaatgtataa

SEQ ID NO: 798 - DNA, 129 bp, S.epidermidis
attcagacatcatcgtggcttaatataagaaaagtaacagctcaacgagctgaaaataatcaaaaaaattataaaaaagacaatttctatattatttcaatagaaattgtctttttttacttatcttga

SEQ ID NO: 799 - DNA, 174 bp, S.epidermidis
gttcagacatcctcgtggcttaatataagaaaagtaacagctcaacgagctgaaaatcatcaaaaaaattataaaaaagacaatttctatattatttcaatagaaattgtctttatttacttatcttggacctttttgtcccagcctctttcttacagtatgctcagtcaatga

SEQ ID NO: 800 - DNA, 165 bp, S.epidermidis
aattttcaatcaatcttatgtttaaaaacctcactaaagcccgttgatatctttagtgaggtcgatgttctttattctaaaatgattttcatagagcgttgtacactatcagcatacatacctccaaatttaagtaaatgtatcataagtaaatataatctataa

SEQ ID NO: 801 - DNA, 132 bp, S.epidermidis
aaatgtaaatcaaatttaaatataacgcttatggaaagcctaagacctcacagagtgtcttgggctttttctatgattagtggtcagggtagattgagtatagtattattccaagtcgctttaactttatag

SEQ ID NO: 802 - DNA, 825 bp, S.epidermidis
atagggggattaacgatgattaaagccattgcggtagatatggatggaacatttcttgacacaaataaacagtttgatcgaaatcgttttgaaactatttttaaagaattaatagataaaaatattaagtttatagctgcgagtgggaatcaatttgcaaagctaaaatcaatttttggagatagggaaatgttctttatatctgaaaatggagcagtcatctataaaggtaatcaactttacaattatcgaagttttgatcagtatatttttcaaaaagttgtaaattatttaaatttgaatcaaaagataaacaatttgattatttgtggtgtaaaaagtgcatatattttaaaagaaacaagcgaagcatttaagcaagatgcacgtacatattatcaccaactaatagaggttgactccttacaaacattacctgatgatgattatgtgaaaattgctttcaatataaatcgtcagactcatccagacttagatgagaaattagctcttaagtttaaagacgatattaaactagtatcaagtgggagagatagtatagatgttattatgccaaatatgactaagggtcaagctttgtctagattattaaaagaatggcaaatgcctgcttcacatttaatggcatttggagatgcaaataacgataaagatatgttggagcttgccgaacatagttatgttatggctaatagtgaagatcaatcattatttgatatagcgagtcatgtggcaccttccaatgatgaacaaggcgtactatcaacaatcgaaaatgttgttctcggttattccaataaataa

SEQ ID NO: 803 - DNA, 1566 bp, S.epidermidis
ttatcagaatcagccaattcattttatctacatgtagatgattttttaatacgtattgttaaggaatgtttgctgactcatgttaatagtaagttgatgttatggaggtttgttatgggaagtttttttaatcggatgactcgaaaagagaatcctactatttatcaaagtaaagatgggcatcttaaacgcacattacgtgtacgcgactttcttgcactaggtgttggtacaattgtttctacatctatcttcactttaccaggtgttgtcgcggctgagcatgccggacctgctgtttcattgtcattcttattagctgctattgtggcaggtcttgtagcctttacttatgcagaaatggcatctacaatgccttttgctggttcagcttattcatggattaatgttctttttggtgaattattcggatgggttgccggttgggcgcttttagcagaatactttattgctgttgctttcgttgcttcaggcttttctgctaacttaagaggtcttattgcaccattgggcatttctttacctaaatcattatctaatccatttggaagtaacggtggtgtcattgatatcattgctgctgtagtgattattttaactgcattactattatcacgcggaatgaacgaagccgctcgtatggaaaatgtattggttatattaaaggtgttggccatcattttatttgtgattgttgggctaactgcgattaatttcagtaactatataccttttattccagaacataaagttactgaaactggcgactttggaggttggcaaggtatttatgctggagtttcaatgatttttttagcttatattggttttgactctattgctgctaattcagctgaagcgattaatccacagaagacaatgcctagaggaatcttagggtcactcatagtagcaattgtattgtttgtggccgtagcacttgttcttgttggcatgttccattactctcaatacgctgataatgcagagccagtaggttgggcattacgagaaagtggtcatggtattattgctgcaattgttcaagcaatttctgtcatcggtatgttcactgcattaatcggtatgatgcttgcaggttcacgtctattatattcatttggacgagatggtttactcccttcttggttaagtcaattgaatcacaaacatttacctaatcgagcacttgccatacttacaatcattggcgtagttatcggatcaatgttcccgtttgctttcttagcacaattgatttccgcaggtacccttgttgcattcatgtttgtgtcactagcaatgtatcgattaagaaaacgtgaagggaaagatttacctaagccagagtttaaattacctttatatcctatattgcctgcaattacatttatattagtattgctagtattttggggattaagttttgaagctaagttgtatacactgatatggtttattgtaggtataattatttatttaatttatggaattagacattccaaaaagaatgatgaagaagcgtatcaagtacctagaaaataa

SEQ ID NO: 804 - DNA, 144 bp, S.epidermidis
gtccatttgtcatactcatttcctccttttcttcgctacattataagtataaaactgatcaataacttagttcgtgatgattatcacatgctaaatgtaaaaagtttcgcaacatttggttattcaatacataattgtgtttga

SEQ ID NO: 805 - DNA, 201 bp, S.epidermidis
attgctctgtcttctgctttctctttagcaaatatgattgttaaaattactgttatggtagccaatataccaccaatgagaattgcagatccacgtaaaagtgcttcttctggggctatcggtaagtttatagataagcaaaacgttactaaaaagaatgtcgatgatggaccagcgatttttagtgcattaaacgtataa

SEQ ID NO: 806 - DNA, 312 bp, S.epidermidis
tataacatgtcatttaatatttggatgtggattttacttgtattatttattgtggggacaatagctgtaattctcattttaacagttggctcagtgttagaagagcgctcatatgaccgtcgatcagaagatgaaaagcgcaaaaatttagaaaaaaatcttgagatgtcaaagggacatacagatgtatcgcaagagtcgagcaatggggaagaacaagtaacacaagagcattctcaacatgtcgttcaagatcatcaacaaacacatcaaaatataaatcaatcaacacaagataatagaaataattag

SEQ ID NO: 807 - DNA, 225 bp, S.epidermidis
ctatatgcgtctggcgttaaggtagcaatacctgttttaggatcatacgtcgcagatccagacagattcatatgttcattaaagttatctttgttcaccacaacagaattagatgtcagacttgaagttgttgtcgtggacgttgttgtcggtgctgccatcgtattcaaaacagtaaatctactaaatgttcttaaatttgcaaaggaagtaggactcgattga

SEQ ID NO: 808 - DNA, 126 bp, S.epidermidis
tatccaaagtcaacgttgtattcgccatctaaatgcctccatttcacatctaatgtaccccctataggtatacaagtcaactacttagcttatatattatgggatagtattatgtgttacctttaa

SEQ ID NO: 809 - DNA, 1458 bp, S.epidermidis
catctaactttaacatatatagagggtgaaacgatgtcagggaaactagaagaattacaattaaaagtagctcgattaagtcgacgtactcatgaattaggtattccaattatggtattatttgaggggattcctgcttcggggaagacacgtttatcaaatgaattactattgcacctagatgccaaatattcgcgatttatagctactaaatcgccagagtcaaacgatttacgttaccaatttttacaaaaatattggaatactttaccacaaaagggcaatataaatatttattttagaagttggtattcacactttttagattataaagaaaataaaattaagcatgatcaatataaaaattatgatgttttagtcaatcaaatttatcattttgaatcgatgttaaagaatgataactatgaaattataaaatttttcatagaaataaatgaagaaaaacgcaatgaacatattcaacagacaaaagataatccattaactagatggaaagttcaagaatatgaaaatgttatacctcaagaaagttatctaaatcaaatgcatcaattcatcaacaaagataaagattggaaagtgatcgattacacagagcgcgagcatgcttttgaaaaaatgtacttacatttaatagatagacttgagcaagctataaaaaaagttgaacaacaaacaactaaagtcaacggtaagttcacatcaagctttacgacttctttatttaataataatcttgagaaagtagacaaaaaaacgtataaaaatctcattgttgaattgcaacagagaatgagagaaatccaatttgctttatatgaaagaaagattccccttgttttggttttcgaaggtatggatgctgctggtaaaggtggcaatattaaacgtattagagaaaaattagatccaacaggatatgaagtgaatggtattagtgcacctacggatgtcgaacttaagcatcattatttgtggagatttgctaaaaagatgccaaaatcaggtcatataaaaatatttgatcggagttggtatggtcgtgtactagttgaacgtgtagaaggttttgcaagccagaatgaatggcaacgagcatctgatgaaatcaatcaatttgaaaagatgtggacagatgaaggtacaatcatattaaaattcttcttatgtttagataaagatgagcagcttaagcgttttaaagaccgtgaaaataatcctgataaacaatggaagattactgaagaagattggcgtaatagagaaaaatgggatgaatatttagaagcaagtcatgatatgattgaatctacaaacacttcatatgccccttggtatattgttccggcagatcataaaaaaacgagtcggattgaagtacttaaaacaattattagaaaatgtgaagaagtactatggggagttaagacgtattaa

SEQ ID NO: 810 - DNA, 1311 bp, S.epidermidis
ttcaaaacttttcacaatttttgtaaagcgcttacatatttattatatattcctggtcatgtctgttatatttcattgtataaaacgaattttctttggtatgatactagtgctacttcaaaaaatgaaaggatgtcacaccttatgaatataggtatagataaaataagtttctatgtacccaaatattatgtagacatggctaaacttgcagaagcgcgccaagtcgatcctaataaatttttaattggaattggtcaaactgaaatggctgtgagcccagtgaatcaagatatcgtatctatgggagccaatgctgctaaagatattataacagaagaagataaaaagaatattggtatggttatagtagcaactgagtctgcgattgataatgccaaagcagcagccgttcaaattcaccatcttttaggtattcaaccctttgcaagatgctttgaaatgaaagaggcttgttatgcagcaacacctgcaattcaacttgccaaagattatcttgctcaacgccctaacgaaaaggttcttgtcattgctagtgacacagctcgttatggtattcattctggtggtgagcctactcaaggtgccggtgcagttgcaatgatgatttcacataacccaagtattttaaaacttaatgatgatgccgtagcatatactgaagacgtttatgatttctggcgtccaacgggtcatcaatatcccttagttgctggtgcattgtcgaaagatgcctatatcaagtcattccaagaaagttggaatgaatatgcacgtcgccataataaaacactcgctgatttcgcttcactatgtttccatgtaccattcaccaaaatgggacaaaaagctttagattctattattaatcatgccgatgaaactacacaagaccgtcttaactctagttaccaagatgcagttgattataatcgttatgtcggtaatatttacacagggtccttatatttaagtctcatctctttattagaaacacgtgatttaaaaggcggacaaacgattggtctctttagttatggttctggttctgtaggcgagttctttagtggaacattagtagatggattcaaggagcaattagatgttgagcgccacaaatctttattaaataatagtatagaggtttctgttgatgaatatgaacattttttcaaacgctttgaccaattagaattgaatcatgaacttgaaaaatcaaatgcagatcgtgacattttctatttaaaatctattgataacaatattcgtgaatatcatatagcagaataa

SEQ ID NO: 811 - DNA, 2091 bp, S.epidermidis
tcttatttgttcatgctttttttgtggcacgtaaataagaagatagagaggaatgaattgattatgtttaaaaagctatttggtcaaatgcaacgtatcggtaaagctttaatgttaccagttgcgattttaccggctgcagggttgctattagcaattgggactgcgtttcaaggcgaagcgttacaacattatcttccatttataaaaaatgatattgttcaacaaatcgctaatatgcttacaggtgctggtggtattatatttgataatctacctattatctttgctttaggtgtagcaattggtcttgcaggtggagatggtgtagctgctattgctgcatttgttggttttatcattttaaataaaacaatgggggcattcttgcatgtaactccagataaattatctgatccaactaatggatatgcaaatgtattagggattcctacacttcaaacaggtgtgttcggaggtattattattggtgcactagcagcctggtgttataacaaattctataatattaccttaccatcatatttaggattctttgcaggtaaacgttttgtaccaattatgatggcaacaacatctttcattttagcctttccaatggcaattatttggccaacgattcaaaacggtttaaatgcatttagtgagggattattagattcaaatacaggtttagctgtatttttatttggatttattaagcgattattaataccatttggtttacatcacattttccatgcaccattctggtttgaatttggttcttggaaaaatgctgctggagagataattagaggcgaccaacgtatttttattgaacaaatccgtgaaggtgctcatttaacttctggtaaattcatgcaaggggaattcccagtcatgatgtttggattaccagctgcagcattggctatttatcaaacagcaaaacctgagaataagaaagtagttgcaggtttaatgatttctgctgcattaacatcatttttaactggtattactgaaccattagaattctcattcttatttgtagcaccattcttattcgtaattcacgcagtattagatggtttatcattcttgacactatacttgttaaatgtacatttaggatatactttctctggaggatttatagattatgtcttattaggtattctacctaataaaacagcatggtggcttgtcatcccagtaggtattatttatgcagtgatttactactttgtatttagattccttattgttaaatttaactataaaacaccaggtcgtgaagataaaaaatcatctgtaacaactacatcggctagtcaactgccattcgatgttttgaaagcaatgggtggtaaagaaaatattaaacatctacatgcttgtattactagactaagaatacaagtaaatgaaaaatcaaaagttgatgttgccggccttaaatcattaggtgcttcaggagtacttgaagtcggtaacaatatgcaagccattttcggtcctaaatctgatcaaatcaaacatgatatggctaagataataagtggagaaattacaaaaccaagtgaaacaacaattgatgaagaagtgtcagatgagtctgtacatgtggaagatattgtagaaacagaaatttacgcacctggacatggtgagataataccgttatctgaagtacctgataaagttttctctgaaaagatgatgggtgatggtatcggatttgtaccagattcaagaaaaattgtagcaccatttgatggtacagttaaaacaattttccctacaaaacatgcgataggattggaatctgatagtggcgttgaagtgttaattcacattggtatcgatacagttaaattaaatggtgaaggttttgaaagcttggtaaatactgatgaaccagtaacacaaggtcaaccattaatgaagattgatttagaatacttaaaggaacatgctccaagtattattacaccagtaatcataacaaaccaagaagacaaaacattaacaattgaagatgtaaaacaagtcgatcctggtaaagcgattatgacaattaaataa

SEQ ID NO: 812 - DNA, 231 bp, S.epidermidis
ggcataattccatatatatatgagagtacaacaatacctactaataacactgctaaaattgtacccatagtgactaaagttttgactgcattcttaggtgctggatttttaaaatttgttactgcattggatattgcctctacacctgtaagtgatgatgctccagatgaaaatgcttttaaaagtaaaaataacgtaacaccgggcacagtactacctacagtggaatga

SEQ ID NO: 813 - DNA, 1590 bp, S.epidermidis
ggggtattgtttatgtcagttttaactgtcatgcaattcatagtcaatattatcatcatgattgtgttattaacgattatgattcttgggggtatttggttatttaaagataaaggtcaaaatcaacacagtgtactaagaaattttcctgttttgggtcgaatccgttatatttctgaaaaaatcggtcccgaattaagacaatatttcttcgctaacgataatgaaggaaaacctttttcacgaagtgattataaaaacatcgttttagctggaaaatataaatcacgaatgaccagttttggtacagggaaagattacttagagggattttatattcaaaatacgatgttcccacttcaagcaactgaattacatatcgatcatactgaattcatttctacattcttatatcatattgagaatgagcgcctatttagtagagaagaatacagaaaaagcgctcaggttgatccgtttttcttaactgatgaacatgcagtagtattgggctctaaccttaagcatccctttaaaattaaacgcttagttggtcaatctgggatgagttatggcgctttaggtaaaaatgcaattactgcactgtcaatggggttagctaaagctggtacatggatgaatacaggtgaaggtggattatctgaatatcatttgaaaggtaatggtgacatcatctatcaaattggtccaggactctttggagtaagagatcatgatggcaattttaatagagacatgtttatcaatcttgccgaacacaataatgtacgcgcatttgaaattaagttagctcaaggtgctaaaacacgtggtgggcatatggaggggaacaaagtcacagaagagattgcacgcattagaaatgtgaaaccatatgaaactattaattcacctaatcgttttgattttattaaaaatccaacagatttactgaatttcgttaatcatttacaatcgataggtcaaaaacctgtcggcttcaaaattgttgtcagtaaagttgaagaaatagaggcgttagttaaaacaatgatagagatagacacctatccaagctttattactgttgatggtggtgaaggtggtacaggcgctaccttccaagagcttgaagatggtgttggtttaccgttatttacagcacttcctatcgtttcaagtatgttagaaaagtatggcataagaaacaaggttaaaatttttgcgtccggtaaattagtgactccagataaaatcgctattgcattaggattaggtgcggatctcgtcaatattgctagaggtatgatgataagtgtaggatgcatcatgagccaacaatgtcatttaaatacatgtccagttggagtagcaacaaccgatcctaaaaaggaaaagggacttattgttgatgaaaaacaataccgtgttacaaattatgttacaagtttgcatgaaggtttatttaacatcgctgcagctgtaggcgttcatagtccaacggagattacttccgaccatattatctatagacaattagatggcactacaacgtccattcaggattataaacttaaattaatttcttaa

SEQ ID NO: 814 - DNA, 1164 bp, S.epidermidis
agcagattgttactcattatagcgtgtgttgcgcttattctctggctaggaattaaagagaagaagcgtcatgcaaatcgacttgaaaaaattccattacgtattaacataaatggaattcgtgggaaatctacgattactcggatggcttacagtgttctacgtgaggaccagtatagagttgttggtaagacaacaggaacagatgcacgaatgctctattggtttactgaaaaggaatatccagtaatcagaaaaccacaaggcgccaacattggagaacaacgagatattattcgtaaggtggttaaacaaaaagcaaatgccctagttaatgagtgtatggctgtaaatccagattatcaaattacctttcaaaatgatttagtaaaagcaaatatcggtgtaattgttaatgtgatggaagaccatatggatgtcttaggaccgacacttaaagatgtagcgcaagcttttactgcaacaattccatataacgggaaattagttgtaatgaaagataactatactagtttctttgtaaaggaagctaaaaagcgtaattcagaactcattgttgtagataaagacgtcataccagaatcatatttacggaagttcgattatttagtatttcctgataatgtagctattgtgttaggaatagcgcaagcagttggtgtagatgaagaaactgcattacaaggtatgttaaatgcaccagccgatccaggtgctgttagaattaaatatttccatgcaaatcgcacaaaaaatgtatttgttaatgcattcgctgctaatgaaccgcagtctacaaaagcgattttaaataaagtggaatcatataattatccatacgataagaaaataatcattctcaattgtcgttcagatagggttgatagaacacaactctttgttgataactttttaggtgaagtcgattacgatgttctcatttgtacaggaaaaagtacacaaatggtgacacagtttatggaaactatgccagaaaaaacatatatcaattatgaaggacgagactttgtagagattgaaaaaggtattctacatgaagctgagaatgcacttgtattttgtgtaggaaacatccacggcccgggtggtagaatagcggaattcatagaagggatagaataa

SEQ ID NO: 815 - DNA, 747 bp, S.epidermidis
gagggggctccgctaatgtctatagaaagaattatttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtccaattctagtaagactgaatgcggattacatgtagctgataaaccataa

SEQ ID NO: 816 - DNA, 132 bp, S.epidermidis
tctgtatatcccggatcaggtaaaagtacaatttcaccaggattaacaacacaagtaggtaatgcaacaagaccatttttagtcccatataaaatacaaacttcatcttctttgtctaattcaacatcgtaa

SEQ ID NO: 817 - DNA, 654 bp, S.epidermidis
aggaggtatcctcgtgagatgaataaacttatagacttttctaaaggattagtaccagtaattttgcaacatgcacaaacggatagcgtattaatgttgggatatatgaatgaagaagcttatcaaaaaactctgaaagaaaagaaagtaaccttcttctctagatctaaacaacgtttgtggactaaaggtgaaacttctggtcatttccaacacgttgagagtattcatctagattgtgatcaagatgcgatcttaatcaaagtgatgccacaaggtcctacatgtcacactggaagtctgagttgttttaatagtgaaattgaatcacgttttaaaattcaagctttagcacaaacgattcatcaaagtgctaaagccaatcaatctaactcttacactcaatatttgttaaaggaaggcatcgagaaaatatccaagaaatttggtgaagaggcatttgaagttgtgataggtgcgataaaacataatcgtgaagaagttattaatgaaacagcagatgtcatgtatcacctttttgtgttactacatagtttagatattccattttcagaagtagaacaggtactagcgcatcgccatcaaaaaagaaataattttaaaggcgagcgcaaagaggttcgagaatggtaa

SEQ ID NO: 818 - DNA, 144 bp, S.epidermidis
attcgttgtcccactcccgtttatctatgttttaaaataatattctcgttttttaatttgctatatataatcatttatgacaatgtagcacttgtgacatacccatctttaacgtggaaaacgatgtttccttttccgacttga

SEQ ID NO: 819 - DNA, 1389 bp, S.epidermidis
gctacgactttatatgtaaaggtgtgttcaaacatggttcaagtcaagataggtaactgtaccatcaatggcatacacaaaaagaatattgatgtattcttaggtatcccgtatgccaaatcgttcaataagatatctcgattccaacattcaaagcttatggaactaagcaaaccaatgattgatgcaactcatattcaatccatcccaccacaaccctacaattcacttgaagactttttttcgatgacagattcatcgtttaattcttttaaacaaaatgattattgcctgtttttaaatatttggaaaccatcatccaatcaaaatcatttacctgtagtgatttacttttatggtggtagttttcttcaaggacatggcacagctgaactatattgtcctgaacacatagtagaacaagaaaatataatagtagttacttttaattatcgcttaggtgcactcggctacctagattggtcttattttaatcaacatttgaactataataatgggatttctgatcaaattaacgttttaagatgggtacatcaatatatcgaacattttggcggtgatccaaataacgtgacactaatgggtcaatctgcaggtagtatgagtatcatgacattaatgcaaatgcccgaacttgatgattattatcataaagtgatgttactaagtggaacgttaactactgatacaccactcaatgcacatactaaagtacaacatttttcacaactcatgaggcattattttcctaataaaacacttaagacacttaacagtgatgacattttatatctaatggagtctcaaaaaatagagcgtggaagatctcgtggacttgatttgatttatcaacctattaaagatcatcatatgtcacgatccattaaaaaatttcccaaaccgacattcatgagttatacacacgatgaaggtgatatttatattgaagacgcaacacgcaccttaccttctgaacgttttattcacttgatgtctcaatatggtacacacgtcgaaaaaaatgatgccctcacaatgaaacaacaaagaaatgtaataacagagtattgttttgttcgtccgatttatctatttttaaatcaaatgaatagttgcgacacttggctagcacgttttgattggcaccaaccccatacctcctactttaaaagtgcatatcatatattggatttagtattttggtttggtcatctctctattttgactaaaaatcattattctgtaacccaacatgatatgaatttaagtcgtaacatgatatctgacttagcttattttgcccgaaaaggtaagatgccatggaaatgttatgaacctcaacatcaagcgttacatatctatagataa

SEQ ID NO: 820 - DNA, 621 bp, S.epidermidis
aacgccatgttacgagttgcattagcaaagggtcgtttattaaagagttttatcgaatatttacaacaagttaatcagatagatattgcaactgtacttttaaatagacagcgacagttattgcttacagtcgacaacattgaaatgattttagttaaaggaagcgatgtgcctacttatgtagaacaaggtattgctgatgtaggaatagtgggaagtgatattctgaatggtcaaaaatataatattaataaattactcgatttgccatttggtaaatgtcattttgcgttggcggcaaagccagaaacatctcgctataaaaaagtagcaacaagctatgtacatacagctactcaattctttaataaagaaggtatggatgtagaagtgattcaccttaacggttcagttgaattgtcatgtgtagtggatatggttgatgctattgtagatattgtacaaactggttctacgcttacagctaacgggctcgttgagaaaaagcatatcagtgaaattaacgctaagttaattacaaataaagaatcatattttaagcaatcatctgaaatagagagactaatcaagcagttaggagtgtctattaactatgcttag

SEQ ID NO: 821 - DNA, 828 bp, S.epidermidis
gaagacatgttcaagaacaacaaaagtattgaagatacttatgcaacaaaacctattattcagaatatcgttggtcaggcacaaatcaaacaagtgatggcgaaacaaacacccatgagatatacgttgaaagctatcatggctggttttctattatcaatagttacagtttttatgttagcaattaaaacacaattcgcttcaacgcataatgacgggttaatcaatttgatgggagctattgcgtttagtttaggtctcgtattagttgtgttaaccaattctgaattattaactagtaattttatgtatctgactgttggttggtattataaagcaattagtgtaagtaaaatgatatggatttttattttctgttttataggtaatatcttaggtggatttattttatttttcctcatgaaatatgcacatgttatgacgccagaaatgacagatagtttaacagcattagtacataaaaaaacagtagaatcgacttggttaaatattttgattaaaggtatattttgtaatttctttattaatatcggtatttttatttcaatgcagtttaaagagggactagccaaagcattctttatagcttgtggagtgattgtctttgtatttatgggttacgaacacgttgtttttaacgctggattatatgcaggtatgatgttctttaatatggatggattatcttggttgggtgtgctaaaaaatattgtttttgcattccttggaaactatatcggtggaggtatctttattggattagtgtatgcatatttgaacggtaaacgtgacagcctccaaccatag

SEQ ID NO: 822 - DNA, 408 bp, S.epidermidis
aaaggggtgttgttgatggaaaaagcaaaatttgtcattaagttaatacttcaacttgcccttatcatgcttattacttttataggcacagaagttcaaaaattacttcatatacctctagcaggtagtatcgtagggcttatgctttttttcctattgttacaatttaaaattgtacctgaatcatggattaatgtaggagcagactttttacttaaaacaatggttttcttctttatcccatcagtggtaggaattatggatgttgcatctaatatcacgatgaattatatattattctttattgttattataattggtacatgccttgtagcactatcatcaggttatatcgctgaaaaaatgctagaaaaaagcaatacacgtaaaggaactgatcactcatga

SEQ ID NO: 823 - DNA, 285 bp, S.epidermidis
tcaataccaccagtggcttgtaacgtaccacctgctataccaatagataatatgattaacactgccgtcactggtgctgaacctggaggtaactggaatccaaatatcatgataagctgcgctactatagcaaagatgccacatcccagtgcaccagcagttcttaatcctaataatatcgctagaatcatgattatgatttctatgataaacaataacatggaagaatctcctaacttatgccgaacaattttcacttcaatattttatcactttaatatgtaa

SEQ ID NO: 824 - DNA, 231 bp, S.epidermidis
ccgttcaaaccaactaggggagaaatgaggcctcctaaaataaattggaataggccaagtaaacttgaagcattgccacttccacctgtgcgttcagccattgccatagaaaaacaaagtggtgctatagaagtgactggacatatattaataaaaaagccaataagtaaaacatacaatggaagatgtaatgttaaagtaaatattaaaattacaacacctaacatttga

SEQ ID NO: 825 - DNA, 873 bp, S.epidermidis
catatgaaacctttcaaattaatctttattagcgcattgatgatattaataatgacgaatgcaacaccaatatcacacctgaatgctcaagctaatgaagaaaacaagaagttaaagtacgaaaaaaatagcgcactcgcgttaaactatcacagagtaagaaaaaaggatcctttgaatgactttatatcattactatctgggagtaaggaaattaaaaattatagtgtcactgatcaagaatttaaatcacaaattcaatggcttaaagcacacgacgcaaagtttttaactttgaaagaatttattaaatataaagaaaaaggtaaatttcctaaaagaagtgtttggattaactttgatgatatggatcaaacgatttatgacaatgcctttcctgttttgaaaaaatatcatattccagcaacaggttttcttattacgaaccacattggttctaccaattttcataatttaaatttactttcaaaaaagcaattagatgaaatgtatgaaacaggcttatgggactttgaatctcatactcatgatttacacgctcttaagaaaggcaataaatcgaagtttttagattcgtctcaatctgttgctagtaaagatattaaaaaaagcgaacactatttaaataaaaactacccaaaaaatgaacgcgcacttgcttacccatacggattaattaatgacgacaaaataaaagctatgaaaaaaaatggaattcaatatgggtttacacttcaggaaaaagctgtcacaccagatgccgataactatagaattccacgtattttagtaagtaatgatgcatttgaaacgctaataaaggaatgggacggattcgatgaagaaaaataa

SEQ ID NO: 826 - DNA, 150 bp, S.epidermidis
tacaagaaaccccaacatagagagtttcattcagaaattctctatgtcggggttcgttaccgagataagacaatatattcaatacatattttatcttatcctcatctatttagtatacaaatcattgtagtctataatgtttggagttaa

SEQ ID NO: 827 - DNA, 162 bp, S.epidermidis
attcgtgctttttgtgcagttttcgctatgataggttcaagtgaaagagctatatttgcagtaccaattccaaaaacaaagacaaagacaatcattggcgctataaatataattgattttggaaagcgttcaatcacacgtgatgcaatgtatactaaatag

SEQ ID NO: 828 - DNA, 1293 bp, S.epidermidis
attgttacgtttgaattcaaccactttacacaaaggatgggatatcaattggataaacgtcaatttgaaattttagatatgctagtgagatttaatactgaaagtccacctggacgtaatacagatccattgcaagatgaaatcgaaacgttacttaaacaactggatttttcaatacagagagaacagttatatgacaatgatagtgtgatagtagccaccttaaaagggcacaatcctaaagcgccaaaactgatattgaatggacatgttgatgtagcttctgtagatgacgatcaatattggcagtatccaccttttaaacttaccaacaaagatgaatggttatacggtcgtggcgttagcgatatgaaaggtggtatgtcttcattattctacgtcttggagcaattacatcaagcggggcaacgtccagaaggtgatattattgttcaatcagtagtcggtgaagaagtaggtgaagcaggaactaaacgtgcatgtgaaataggacctaaaggtgacttagcccttgtcttagatacgagtgagaatcaagcacttgggcaaggtggcgtgattaccggatggattacagttaaaagtaaaaatacaatacatgatggtgcgcgtagtcaaacgatacatgctggtgggggcttgtttggtgcaagtgccattgaaaaaatgacaaaggtgattcaatcgcttaatgaacttgaaaggcattggggtgtcatgaagaagagtcctggaatgcctccaggtgcgaatacaattaacccagctgtcatagaaggtggacgtcaccctgcatttattgcagatgaatgtcgattatggattactgttcattacttaccgaacgaaagttatgaatctgtagttaatgaaatagagcgatatttaaataaggttgcagaagcagatgtatggctcagagagaatccacttgaatttgaatggggtggtacatccatgattgaggataaaggagaaattttcccaagtttcactgttccgacacatcatccaggttttaagcaattagaagaagcacatgaacatattcataataaaaagcttgaacatggtatgagtacaactgtaactgatggaggttggacagcacattttggcattcccacgatattatatgggccaggtagtttagaagaggcacatagtgtagatgagaaaataaaagcaaaggaattagctcaatatagtgatgttttatatacatttttaaaagaatggtatgaacacccacaatcctataaatcatcatag

SEQ ID NO: 829 - DNA, 1416 bp, S.epidermidis
gtaaacgctttcatattcgtatccctaaggaggaagttgatggcaaaacaactacaaagagagttgaataataggcatattcaattaattgctataggtggcgttataggtactggtttatttttaggttcaggacaaacaatttctctaaccggaccttcattactctttacttacatgttgataggtatagtgttatttgcttttatgagagctcttggtgaattattattaagtaactctaaatttaattcattcgtagatattgcaaatgaataccttggtccatttggtggatttgtaattgggtggacctattgggtttgttggattgtctctagcatgtcggacctcactgcgatgggacaatattttgcttattggtatccacaagtcccacactggttgacagtactatttattgtactcctacttatatcatttaatttgcttggcgccagattatttggagaacttgaattttggttttctataattaaagtcgttacaattattacgatggttattgtaggtttagttctgatttttttatcatttaaaacagaatatggacatgcttcttttggtaatttgatacatcatggcgggatgtttccacatggtgcagctggatttttaatgtccttccaaattgctgtatattcatttatcggtatagaacttataggagtcacagctggcgaaacaaaaaatccagaaaaaacaattcctaaagcaataaataacgttcctatacgaattttattattttatataggtggtttacttgtaatcatgtctgtcattccatggtttaaagttgatcctgatagtagtccgtttgttaaattattcacactaattggtgttccctttgctgctggcatagttaattttgttgttttaacagcagcagcatctgcaacaaatagcggaatatattctaatagtagaattttatttggtttagcgaaacaaggtttaggtcctaaagtattgacaaaaactaattctaatggtgtaccttatctctcaatgttagtatcttcaataacattgttaatcgcagctttattaaattttattttcccagatgctattaaattatttatttatgtaacgacactatctaccgtcctattccttgtagtgtggggaatgattatcgtttcttacatcgcatacgtaaagaagaatcctgaacaacatcaatcaagtgcatttaaattatggggcggaaaaattattgcctatattgtgttatcttttttcatatttatctttattttgctattctttagcaaagatactagagtagctatttttatttcaccattatggtttatcttcttgttcttttattataagaaatacaagaataatgctgaatctttagccgatagacagcgacattaa

SEQ ID NO: 830 - DNA, 1986 bp, S.epidermidis
atgtatgcgtttacaattattgttaggaaaaggagcgtgcatactatgaaaatacttgcaattacatcatgtccaaatggaattgctcatacatatatggctcaagaaaaattagaacaagcagcaaaagatatgggcgttgatattaaggttgaaactcaaggaggcgtcggagcagaaaatgtgctcacttctaaagaaatcaaagaagctgatggaatcatcattgctgccgatagacaggtagatttatcaaggtttaatggtaaacctctcatcaatgaaagtgtacgtgaaggtattcatagacccaaggaattaatacaacgtgtgattgaccaagatgcacaaatttaccatgatcaaaatatttcttcaaatatatctagagaccaggaagaacctcataaaagtaatattcaaatggtatatcagcatttaatgaatggtgtttccttcatggttccatttatcgtcgttggcggtttactcatagctattgccttaactcttggaggacacaccactccaaaaggattagttatcaccgaagattcattttggaaatctattgaaaatattggtagtttatcgtttaaattcatggttcccatccttgctggttatatcgcggtgagtattgctgataagcctggtcttgttccaggtatgattggtggtgccattgctgctgatggtagtttatatggaagtgaagcaggagccggtttcgttggtggtatcgtcgcaggtttcttagcgggctatattgcaaaatggattaaacagattaaagttcctaaagctatggctcctattatgcctattattattatacctattctatcttctttaatagttggtctcatttttatatttgtaataggcacaccaatttcaaatatatttggtgcattaacatcatggttaaaaggaatgcaaggtgctaacatcattattcttgctcttattattggcgcgatgattgcttttgatatgggaggtccagtaaacaaagtagcattcttattcggttctgcattaattactgaaggcaactacactgtgatgggaatggttgctgtagcagtatgtacaccaccgattggtttaggtttagctacatttgttcgtaaacaccaattcaataaagcagaacaagaaatgggtaaggcatcatttacgatgggattatttggtattactgaaggggcaatcccttttgctgcacaagatcctctaagaatcattccagccaatatgattggcgcgatgattgcttcagtaatagcggcggttggaggtgtcggtgataaagttgctcatggaggtcctattgtcgctgtactaggtggaataagtaatattttatggttctttatagctgttgtcgttggaagcttagtaaccatgttcacagtcttgttatttaagcgtcacacccctgctatagcaaaaagcaataatggaaatgatacttctgttggaactgaaaatgtattttctgatgaccaatctattaatcacagcaaacaactctcacatcatatggtgttcgataaatcactcattgaaattaccaaggaaccaatgacaagagatcaagctattgatagattacttactaagttatgccatcgtcattacattacgaatatagaagaggtaagaaccgcaatccttaaacgagaggctgagtcaacaactgctatcggaatgaacgttgcaataccacatgctaaatctcatgcagttaaacgtcctatcgtcgctgtattaaatcataaagcaggtgtagagtgggaaagtctagatgaatcaaatcctcagctcatttttcttattgcagttcccaatgataataacgatacacatttaaaactgctacaacggttatcacgaacgctcatgaaagataatacgcgtgatgagttaattcatgctcaaagtcgtgatgaaatatttaatattttaaaagagatataa

SEQ ID NO: 831 - DNA, 126 bp, S.epidermidis
ataaagaagccagtaaatgaatttataaaaactcatttactggctattttgttaggaattatgtcccagcttcccgtatcaattattattcttttttacttaatttataatcaattaaatagatag

SEQ ID NO: 832 - DNA, 915 bp, S.epidermidis
ctattacagtttattttcgcaatcagttcttacacaggtttgaaaaaaggtattcaaaaattaagtgatgttaacgtttggttatcatttttattattagcatttgtattcatcgtaggtccaactgtgtttattatggaaactacagttacagggttcggtaatatgataaaagatttcttccatatggcgacatggatggaaccatttggtggcataaaaggtcgtaaagaaacgaatttccctcaagattggacaatattctactggtcatggtggctcgtttatgcaccgtttattggattgtttatcgcgcgtatctcaaaaggacgtacacttaaagaagttgtattaggaacaatatgctatggaacattaggttgtgtgttatttttcggtatttttggtaactatgctgtatatctacaaattactgagcaatttaatgtaataagctatttaaacaattatggtacagaggcaacaatcatagaaataatgcatcaactaccattctcgacaattactattatcttattcttaatatcagctttcttattcttagcaacaacattcgattctggttcatatattttagcagcagcgtcacagaaaaaagtgataggagaaccgttacgtgctaatcgtttgttctgggcgtttgcgttatgtttactaccgttctctttaatgctagttggaggagaacgtgcattagaagtattgaaaacagcatcattacttgctagtgtacctttaattgttatatttacgctaatgatgatttcgttcttaattatactcggacgagatcgtatcaagttagaaagacgtgcagataagcataaagaaattgaaagacgttctctaagaatagttcaggtcaaagacaaacctgaagacgataacttataa

SEQ ID NO: 833 - DNA, 906 bp, S.epidermidis
aaagaacagttaactgaagacaatgtccaatctattgaaggatttgatggactatcattgtctcaaacattaccattatcagaaacaatttataataaattaaatcaacttggaattcggcagatcgctcaacgaagtgctggatttgatggttataatttagagttagcatctaaatatggtcttattatatctaatgtgccttcctattcacctcgaagcattgctgagtttaccgtgactcaagccatcaatattgtacgtcactttaatcatattcaaagaaaaatgagattgcacgattttaggtgggaagcatcaattttatctcaatcaatcaaagatttaaaggtagcggttattggcacgggacatattggtggcattgttgcacaaatattctcagaaggatatctatgtgacgttgtagcgtatgatccttttccaagtgaacatgtgaaaccttacgttacctataaacaaagtataaatgaggcaattaaagaggcagatattgtcacaatacatatgccgtcaacacaatataacaattacctgtttaatgaaaacatgtttcaaatgtttaaaaagggtgctgtgtttgtaaattgtgctagaggatccttagtagataccaaggctttgttatctgcaatagagcaaggtcaaattaaaggtgcagcacttgatacttatgaatatgaaattggagtatatacgacagatagaagtgaagaaggtttgaatgacccacttttagaggaattaattactagagaagatattattgttacaccgcatatagcattttatactgaagaggcaatcaaacatcttatttttgatgctttagatgcaacaatggaagtattaaatactggcacgacggagttaagagtaaattaa

SEQ ID NO: 834 - DNA, 471 bp, S.epidermidis
tatattaagttaagtgtaattcaaaaacaaggagtttttataatggcaaattctatttactcaactacaatgatttcaaatggtggacgtgatggtcgcgtttttagtccagataatacatttgttcaaaaccttgcaacacctaaggaaatgggtggtcaaggaggcaacgatactaatcctgaacaattatttgctgctggatatagtgcatgctttaatagcgcgctatcattaatcttatctcaaaataaaataagtgatgccaacccagaagttgaaatcactattgaattacttaaagatgatactgacaatggttttaaactcggcgcagatattaaagtcacacttgaaaatatgtcccaacaagatgctgagaaatttgtggagcaagcacatcaattctgtccatactcaaaagcgacacgtggtaacattgacgttcagttagatgttacagcgcaataa

SEQ ID NO: 835 - DNA, 213 bp, S.epidermidis
aatgtaaagttgctcatcaccgaaggaggactatttatgtttaccatatcaatcatcgctatgattattggtgttgtgcttattgttttaagtcaaattatctatcattcaaaaccgatagatgctaaggaaaaaatgtttatacccggtgtatgcctttttttagtaggactcttaagtttaatcggtcactttgttaatggctacgtataa

SEQ ID NO: 836 - DNA, 165 bp, S.epidermidis
ttactatttacaaataacttaatttctttcataatagtgttatacaaggaggaagataaaatgaaacagaatttacaaacagcaagacgcaacctcaatagtcctaacatcaaaacacgaaaacgtgctttaaaaataataaaacagcatcaacgttcgaaataa

SEQ ID NO: 837 - DNA, 285 bp, S.epidermidis
gagagaattacgctacctgcacctattgcaagaacgaccaaagctacattaacatctgaatgctctaaaagtggtaacacaatgcctgttgttgatacagcagcaactgtagctgatcctaatgaaatccttaagactgcagctacaatccatgctaataaaatgggcgacatgcttgttccttcaaacatcttagcgattgtatcacctacgccaccatcgatgagcacttgtttaaatgtaccaccaccaccgatgatgagtaacatcatgccgattggataa

SEQ ID NO: 838 - DNA, 849 bp, S.epidermidis
ctatgtgagttcgaaagtgagggaaaaattagcatgaatacgttggatagtaaatatgaattaaaatcaaaaaaacatcgtcagcgaataattaaaaattgggttatagtcactgtagttgcagctgtaattatatgggcgtttgcaggaattccaggtcttgaacttaaaagtaagtctattgaaatattaaagtctatcttttacggactatttcatccagatttaagttacatatatatacctgatggtgaagacttacttagaggtttgctggaaacttttgctattgcagtgattggcacgttcattgcttcaattatatgtattccttttgcatttttaggagctaaaaatatgatgaaattacgaccggttacgggcataagtaaattcatattaagcattatacgtgtgtttcctgaaattgtaatggcgttaatatttattaaagctgttggaccaggttcgttttcaggtgtacttgcactggggattcattcagtcggcatgttagggaagctttttgttgaagatattgaaagtttagattttagcgctgtagaatctttaaaggcgagtggagcaaataaaatgaagacgttaatgtttgctgtaataccacaaattttaccatcgtttatttcacttattttgtatcgatttgaattgaatttacgttcggcctccattttaggattaatcggcgcaggtggcataggtacaccattaatttttgctttacaaacacgatcttgggaccgagttggcatgattctaattggtttgattgcgatggtcgctttagttgatttaatatctggcgcggttcgtaaacgtatcgtttag

SEQ ID NO: 839 - DNA, 180 bp, S.epidermidis
ctttttgctacattcatttatcttatattatttgaacaagtcaaatatacttttacgtgtgtacaattcattaaaagcatccacaaaattttattcttaataaattcaatggcatattatacttttttatattttatcattcatatattcaacacaaatttagttattaagactttctaa

SEQ ID NO: 840 - DNA, 1449 bp, S.epidermidis
aaggcatatacgttttcaatccctccttctaaaggagaaatgaatatgaatgacacaggagataaaagattaagtcgaacatcattaatcggtcttgttataggttcgatgattggtggcggtgctttcaatattcaatctgatatgggaggccacgctggaggattagcaattataattggatggttgattactgctataggaatgatttcattagcacttgtctttcaaaacctaactaatgaacgatctgatttagatggtggtatttatagttatgctcaagcaggttttggtgattttatagggtttgcaagtgcttggggatattggttctcagcttttttaggtaatgtcgcatatgcaacgttattaatgtcttctatagggaacttctttccaatatttaaagggggcaacacatttcctagtatcatagtggcatcaatattattgtggagtgtgcactttttaatattaaaaggagttgagacggctgctttaatcaatagtattgtcactattacaaaattaattcctatcttattagtgattatatgtatgattgtagcctttaattttaatacattcaggataggtttctttggaatggatggatatggatcattatcatttcatttcgctaatacgatgtcacaagttaaaagtacgatgttagtgacagtttgggtatttattggtattgaaggtgctgttgtattctccggaagagctaaaaataaaaaagatgttggaactgccactgttatcggacttatttcagtattgctcatttacttcttgctgactgtattagcacaaggtattgtgattcaaaatcatatttctaaacttgaggcaccatcaatggcacaaattttagcttatatagttggtgattggggagcaacatttgtcaatattggtcttattatttcagtattaggtgcatggctaggttggacattactcgccggagagttgccttttattgtagctaaagatggtttgtttcctaagtggtttgcaaaagaaaataaaaatggggcacctatgaacgccttattcattactaatgtattagttcaaatattccttattagtatgctgtttaccaaaagtgcttatcattttgcattttctctcgcggcaagtgctatactttatccatacatgttcagtgcgttttatcaggtgaaatatacaatagaatacaagttaactgcaacgcctaaacaatggattataggaattctagcatctatttatgcaatttggctggtttacgcgtcaggtatagattatttgttacttaccatgttgctctatatcccggggattatcgtctatgttgttgttcaaaaaaataatcaaaagcgacttacacaatttgactatattttcttcggtcttatcgttattttagcattgatagggttattacgatga

SEQ ID NO: 841 - DNA, 216 bp, S.epidermidis
taccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataaaaaagagaaagctattcgtatataa

SEQ ID NO: 842 - DNA, 138 bp, S.epidermidis
gcaccaaatactatgaatgcagaaggaacaagcaagattaacacaataatcgttcttgaaaatcttgttaaatttttcggtatcaccgtgaatgctttaaatccattttttctaataggtgtttcgataaatttataa

SEQ ID NO: 843 - DNA, 2385 bp, S.epidermidis
atggcgaatacaacgttgactttggatattattggtatgacatgtgctgcgtgctcaaatcgtattgaaaagaaattgaatcgtatgaatcatgttcaagctaaagtgaatctgactactgaaaaagcaactatcgactatgagtctgacgattatcatctcgaagattttgtagagcaaattcaaagtctcggctatgatgttgcagttgagcaagtagaattaaatataaatggtatgacatgtgctgcatgttctaatcgtatagaaaaggttctaaatcaaacgcaaggtgtacaacaggcaacagtaaacttaactaccgaacaagcactcatcaaatattaccctagtgctacgaacacggaagcattaattaagcgtattcaaaatattggatacgatgctgaaactaaaacttcatcaaaagcgcaatcaaatcgtaaaaaacaagagttaaaacataaacgcaataaattaatcatttcagctattttatcgttgccactattattagtaatggtggtgcatatctcaccaatttccattccatccattttggtcaatccttgggtacaattaattctttcaacacctgtccaatttattattgggtggcaattttacgttggcgcgtataaaaatttgcgaaatggttcagctaacatggatgtattggttgctgttggtaccagtgccgcatatttttatagcatttatgaaatgatgatgtggctcacacatcaaacacatcacccgcatttatattttgaaacaagtgctattttaattacgttaattcttcttggtaaatatttagaagcacgtgccaaatcacagactaccaatgcattaagcgaattgttaaatttacaagcgaaagaagcacgagtaattaaagaaaataaagaaattatgcttccacttgataaagttaaagtcggagatactttactaataaaacccggcgaaaagatacctgtagatggcaaagtcactaaaggtgatacttctattgacgaatccatgctaactggtgagtctatacctgttgaaaaaagtagtggcgattcagtgattggttctaccatgaataaaaatggttcaatcatgattgaagcaactcaagtaggtggtgatactgcattatcacatataattaaagtggttgaggatgctcaaagttctaaagcaccgattcaacgcttagctgatattatttctggatattttgttccgattgtagttagcattgcggttattacttttatcatatggattatattcgttcaccccgggcaatttgaacctgcacttgtttcagcaatatctgttttagttattgcttgtccctgtgcacttggtttagcaacgcctacatctattatggtaggtacaggacgtgctgcagaaaatggcatattattcaaaggaggccaatttgtagaacgtgcacattatgttgatacaatcgtgctagataaaacaggcacaattactaatggtcaacctgtagtaactgattatgttggtgacaatgatacattacaacttttagcaagtgctgaaaatgcttcagaacatcctcttgctgatgctattgttacttatgctaaagataaaggtcttaatttacttgataatgacacttttaaatcaattccgggacatggtattaaagctacgattcatcaacaacaaatccttgtgggcaatcgaaaattaatgaacgattacaatatatctattagtaataaattaaatgaccaattaaatcactatgaacatttaagtcaaacggcaatgatgattgccgtggataatcaaattaatggaatcattgctgttgctgatacagtaaaaaatgatgctaaacaagcgataaaagaactaagaaatatgaatatcgacgtggttatgctgactggtgataacaatcgaacagctcaaaccatcgccaaacaagttggcattgaacatgtaattgcagaagtgttgcccgaagaaaaggcacatcaaatctctttattacaagacaaaggtaaacaggttgccatggtcggtgatggaattaatgatgcgcctgcacttgtaaaagccgatattggaatggctataggcactggagctgaggtagcgattgaagctgcagatattacgattcttggtggtgacttgctattagttccaaaagctatcaaagcaagtaaagctacgattaaaaatattcgacaaaatttattttgggcatttggatataacgtagctggcatcccaatagctgcttgtggtttattagcaccttggattgccggtgctgctatggcattaagttctgttagcgtagttatgaatgcattaagactgaaaaaaatgaaactatag

SEQ ID NO: 844 - DNA, 165 bp, S.epidermidis
gacagtggtacactccaaacatgtactaaacgagtaaatggccaacacgcaaacactgtaaaccctaataatatgtgcagtttaaacgaccaaggcacgtttaacattaagtcagcatttggagaaaacatgaataaatgtctaaaccatatcgcaatggtttga

SEQ ID NO: 845 - DNA, 126 bp, S.epidermidis
ccatacgtcacgttctatccacctcaattcaatgcacttctacttgtatacaagtatgttaatatacaaaaatttgttttgcaagcgctttcttttaggtgttttgacattttaaacacaatttaa

SEQ ID NO: 846 - DNA, 138 bp, S.epidermidis
agagcctacacatatgatatggcagactctttaataatttcttttacattcgtttatagtggcttcattcaaaatattacaaatgaaacaagattattttattctttaatccaagaagtagacaggcatttattttaa

SEQ ID NO: 847 - DNA, 339 bp, S.epidermidis
tgtatcaggttccatattatcaacttgattactctgttcattctgtcttactatatcatcaataatttgatacccttcacaatattaataataaataatacaagcgaagcgataagtagaatacctccaataattactcctatcactagtacagcgactccatttgtcgaatcaatcaaggatagtccagcagcaaatgatataagtcctaataccaaacacacccaactcaaaatatggttaaataatgcatttcttgaatacgtagatgctggtggttgtccaacaatccatacgattaatggaaacaatacaggtgcgaaaaatacacttagataa

SEQ ID NO: 848 - DNA, 144 bp, S.epidermidis
ggttatttaactatctttaaaatttacaatttaatattaaaaagatttataagtatcatgatttacatacataagaaaagagaggtaaagcagattgttactcattatagcgtgtgttgcgcttattctctggctaggaattaa

SEQ ID NO: 849 - DNA, 177 bp, S.epidermidis
actaaattaacgaggtgtcttatgtataaaaattataaaatgactaaacatactctactaatggaaacttcagttcttatccccacaaatgatatttcacgacatgtaaatgttattgcagaaacaattcccgagactgaattcgataaattcagacattatcgttgcttaatataa

SEQ ID NO: 850 - DNA, 177 bp, S.epidermidis
actaaattaacgaggtgccttatgtataaagaatataacttgactcaacatactctaccaatggaaacttcagttcttatccccacaaatgatatttcacgacatgtaaatgatattgtagaaacaattcccgatactgaattcgatgaattcagacatcatcgtggcttaatataa

SEQ ID NO: 851 - DNA, 210 bp, S.epidermidis
actaaattaacgaggtgccttatgtataaagattataatgtgactcaacttacgctaccaatgaaaacttcattttttatccccgcaaatgatatttcacgacatgcaaatgatattgtagaaacaattcccgagactgaattcgatgaattaagacatcatcggggtgcaacatcataccattcaaaaatgattttaaaagaactatga

SEQ ID NO: 852 - DNA, 177 bp, S.epidermidis
actaaattaacgaggtgccttatgtataaagactataacatgactcaacatactctactaatggaaacttcagttcttatccctacgaatgatatttcacgacatgtaaatgatattgcagaaacaattcccgatactgaattcgatgaattcagacattatcgtggcttaatataa

SEQ ID NO: 853 - DNA, 177 bp, S.epidermidis
acaaaattaacgaggtgccttatgtataaagattataacatgattcaacatactctactaatgggaacttcagttcttatccccacaaataatatttcacgacatgtaaatgatattgtagaaacaattcccgatactgaattcgatgaattcagacatcctcgtggcttaatataa

SEQ ID NO: 854 - DNA, 177 bp, S.epidermidis
acaaaattaacgaggtgccttatgtataaagactataacatgactcaacatactctactaatggaaacttcagttcttatctccacaaatgatatttcacgacatgtaaatgatattgcagaaacaattcactatactgaattcgatgagttcagacatcctcgtggcttaatataa

SEQ ID NO: 855 - DNA, 177 bp, S.epidermidis
acaaaattaacgaggtgccttatgtataaagactataacatgactcaacatactctactaatggaaacttcagttcttatctccacaaatgatatttcacgacatgtaaatgatattgcagaaacaattcccgatactgaattcgatgaattcagacattatcgtggcttaatataa

SEQ ID NO: 856 - DNA, 1308 bp, S.epidermidis
aaaaggctaacgcataggaggtgtatcacaatgagtgaaaatattattatgccaaagcttggaatgacaatgaaagagggaactgttgaagagtggtttaaatcagagggtgacaccgtaaaacaaggagagagtattgttacaataagctctgaaaaattaaccaacgatgttgaagcgccggcgagtgggacattgttagaaattaaagtgcaagccggagaagatgcagaggttaaagcggtattaggtataattggagaagaaggggaagctattgataaagatgaagatgatttagcatcagaaaaagtaaaagaagacaacgagcatgagaaggaaacgcaagaagttaaagatacatcacaaccgtcttccgataataaagataattcgcctaaaagcgcagcacgagaaagaatctttatctcacccctcgcacgtaatatggctgaggataaaggattagacattaacaagataaaaggcacaggcggtaatcatcgtattacaaaactagatattcaacgtgttgaagcaaatgggtacgactatgctagtgatacgacatctaatgaagatacaagtcatgttccaacacagactgtggatacaagtgcgattggtgaaggattgaatcctatgcgtcaacgtattgctcaaaacatgagacaaagtcttaatagtactgctcaattaacattacatcgtaaggttgatgcggatcgcttgctagatttcaaagacagattagctacggaacttaaacaagcagatcaagatgttaaattaactgttactacattattagctaaagcagtagtgcttgcacttaaagaatatggggcaatgaatgctcgctatgaacaaggcgagttaactgagtatgaagatgttcatttaggaatcgcaacgtctctagatgaaggccttatggtgccagtgattaatcatgcagatacaaaaagtatcggcactttagcccatgaaattaaatcatcggctgaggctgttcgggaaggaaacacaggagcagtacaattagagggagcaacatttacaattactaatatgggtgctagtggtatagaatactttacaccaattttaaatttaggtgaaacaggtattctaggcgttggtgctttaactaaagaagtcgtgctagaagcggataacattaaacaagtttcaaaaattcctttaagcttgacatttgatcatcaaattttagatggtgcaggtgcggccgattttcttaaagtactagctaaatatatcgaaaacccttatttattaatgttatag

SEQ ID NO: 857 - DNA, 177 bp, S.epidermidis
cctctaataacactatgcaaactcctttctacccttctactacatcataaaataaaaagaatgccaataacattcatgaaatcttacaaatatcattggcaaacttacaattttgaaagtttattatttttctttagtaaaatgtataaaaaatactgtcccatgattcaactctga

SEQ ID NO: 858 - DNA, 141 bp, S.epidermidis
tttaaaataactaatcacacgattccgtcacaatttattttttataaacaccgtttctatataaaaaacaaacttgcctctctttatataaaaacaaactcaaatatcatctcattatacatttttaaaaacgtagtttaa

SEQ ID NO: 859 - DNA, 297 bp, S.epidermidis
aagtggataacacccatactatttatagatattgttatttttacaccaatcattgaagaacttttatttcgtcatttaatcattcatgaactaggtaaaaaattaacttatggtttgatgtatattgtgtcaatagtgggatttacatattttcattgtactgatgcagtttcaccatttgaagcaggaccttactttattgcagcagtcgtatttgttataggttaccattttagccaccgtaatttagcagtacccattgctttgcatatgattacaaatttaatagcattttaa

SEQ ID NO: 860 - DNA, 225 bp, S.epidermidis
aatttctcaactccatttacatatatctatgtgtatgttagaaataattatgtaagcgtatcacaaacaacaacaagggaggattatattatgtcaggtatcgttgaatcattacataacgctgtaaacgctggtttacacgtaaaacaagattgggtagacatgggattcggtattgcagatacagttgcaaaaatcgttgaccaagttttaaaatttgtttaa

SEQ ID NO: 861 - DNA, 192 bp, S.epidermidis
tggagcccaactggcatttttaataagatgcctaagatgactattaaggtaatgattgttaaaaatataaaaatcattttccaacttgcaatagataaagcgaggccacctaacagtggagcaatgatggtgattataccgtttatgaccataagagaagttaaaaattttgctaatttgtttccgtcatag

SEQ ID NO: 862 - DNA, 141 bp, S.epidermidis
tatattacaacatttatgttaaattgtgcatttaatttttattttagggaaaagagatgtctagaaggaattcatatttacagatatataggaggaatctttaatggttttacgttatgctacaaatttaaaactagctaa

SEQ ID NO: 863 - DNA, 132 bp, S.epidermidis
aatttcacaacatttttctggaagatatatttactgttgattgccaaatatcatcattctcttatgtatacttcatttctttttaacgaatatagtaatatagacacactaaaaaagtttaaaaagccgtaa

SEQ ID NO: 864 - DNA, 2421 bp, S.epidermidis
acacatcaaactatcacaggagtgatacgaatggctaaaggtgttaaccaaattattaataatattaggttaagaaaattgcgcaaaatattaaatcaaattaatgcgcttagtgaggagttctcaaattttagtgatgaagcacttcaagcgaagacaaaagaatttaaagtttatttaaatgataataaagcttcactcaatcacattctgccacaagcttatgcaacagttagagaggcttctaagcgcgttttaggtatgtatccaaaagatgtgcagattttaggagcaatcgctatgcatcaggggaatattgcagaaatgcaaacaggagaaggtaagacgcttacagctaccatgcttctgtacttaaatgcacttacaggtaagggtgcttatctaatcacaacaaatgattacttagcaaaacgcgattttttagaaatgaaaccactatatgaatggctaggcttgtctgtatcattaggatttgtggacattccagaatatgaatacgctgaaaatgaaaaatatgaactgtaccaccatgacattgtttacacgactaatgggcgactagggtttgattatttaattgataatttagctgatgatattcgtgccaaatttttaccgaaattaaactttgctattattgatgaagtcgattctattatattagacgctgcccaaacgcctttagttatttctggtgcaccacgtgtacaatctaatttatttcacatcgttaaaacgtttgttgaaacacttgagaaagataaagacttcatagttaattttaataaaaaagaagtgtggctcactgatgagggctcggaaaaagcaagccattatttcaaagtgaatagtatataccaacagcaatattttgatttagttaggatgattcatttatcgcttagagctaagtatttattcaaatataatttagactattttatttttgatggtgagattgtgcttatagatagaataactggtcgtatgctacctggaacaaagcttcagtctggtttacatcaagctatagaggctctggaaaatgttgaaatttctcaagatatgagtgtgatggcaaccataacattccaaaacttatttaagcaatttgatgaattttcaggtatgactggaacaggtaaattaggggaaaaagaattctttgatttatattcaaaagttgttatagagattccgactcacagtccgattgaacgagatgatagacctgatagagtatttgctaatggtgacaaaaagaacgatgcaattttaaagacagtgattggtatacatgaaactcaacaacctgtgttactaattacacgtactgcagaagcggcagaatatttttcagctgagttatttaaacgtgatatacccaacaatttattaatcgctcaaaatgtagctaaagaggcacaaatgattgctgaggcgggacaattatctgcagttactgttgctacaagtatggcagggcgtggaactgatataaagttatcaaaagaggttcatgatatcggtggcttagcagtgattattaatgaacatatggataatagccgtgttgatcgtcaattaagaggacgctcaggtcgccaaggagatcctggatattcacagatttttgtatcacttgatgatgatttagtaaaacgttggagtaactctaacttggcagaaaataaaaacctccaaacgatggatgcatctaaactagaaagtagtgcactctttaaaaaacgtgtaaagtcaattgttaataaagcgcaacgtgtatctgaagagactgctatgaaaaatagagaaatggcaaatgaattcgaaaaaagtattagtgttcaacgagataaaatttatgctgaacgtaatcacatacttgaagcaagcgattttgatgattttaattttgaacagcttgcacgagatgtgtttacaaaagacgttaaaaatcttgacttaagtagtgaacgtgcacttgtgaattatatatacgaaaacttaagttttgtcttcgatgaagatgtatcaaatattaatatgcaaaatgatgaagaaatcatacaattcttaatacaacaatttactcaacaatttaacaatcgtttagaagttgctgctgattcatatttaaaacttcgtttcattcaaaaatcaattttgaaagcgatagatagcgaatggattgaacaagtagataacttacaacaacttaaagccagtgtaaacaatcgacaaaatggacagcgtaatgtcatttttgaatatcataaagtggctcttgaaacgtatgaatatatgtctgaagatataaaaaggaagatggttagaaatttatgtttaagtattctagcctttgataaggacggagatatggtcattcatttcccataa

SEQ ID NO: 865 - DNA, 1575 bp, S.epidermidis
aacatcaaaacacattctaggggggagtgcatgtctaaaattttactaactggtgcatcaggttatattggtaaccatctcaagaataaattaaaaaaagatcatgaagtgatagctatatccagaaatactcataataaaacggatgaagaaaatgtcacgtggaagtcagcagacttatttgatttggacgaagttacaaaagtaatgaaagatgtagatacagcgatatatttagtacactctatgatgccatcagcaaaattaacgcaggctagctttgaagatatggatgcattgttagcagataattttgcgcgtgcggctcaaaagcagggtgttaagcatattgtctacatgagtggtttaataccagaaaatgatgagctatctgcacatttaagaagtcgacttgaatgtgaaaaaattcttggtgattacggtataccagttagcacattacgtgcaggtttaattattggtgcaaaaggtagttcttatccaattcttaaacgactagttgagagattgccagcaatggttttgcctagttgggcttacaataaaattgcacctgttgccattgacgatgtgatagatggtttagcagcattggtgaatcgaacacccaaagataacgaagcaattgatatcacaggtcctgaagtgatgaattataaaacgctgatacagcgcacagctaacgtacttgataagcgactgcctatgcttgatttacctattatacccattatcgtaagtcgatattgggtacaactgatttcaaatgtaccgaaagaaatggtatatccattaatgaatagtttaactcacgatatggtaccacatcgaaaacgcgttgtgtctaacttgtccgtaggaaatatcacctttgaagatagtgtgaaaagagcactaagagaagaacaaaagacttctaagaaaaagtcagattcgaaaaattctcaatcatttgggcttatgcatcaagaaattaaagatgtacgagccattacacggtttaaaattccggaaggttattcgattaaagatgtgactaaagaatatgcaaaattcatcaataatatcacactacatatcgttaaaggtacgataaatgaacgagaatttaatatgaatttgcccttcattaataaatttattttaaaaatggaacgtgatgaagctgactctacagaagatatggtggtatataatattgtgggtggcgatttagcacattcaaatgatggtggaaatgcacgctttgaattccgaagaataagaaacaccaatgagggtattattgctttacaagaatatgaacctacattaccttgggtagtatataaactaactcaagctaaagcacacaagactgttatgaatatttttaaaaacaaaatggcacgtttagcgcaacaaaaaaatgtaaaagatgaaacatatatgtctaatcgtgtaactattggagtaacagtagcatcagcgttcgttattggaagcgcagtagggttccaactttttaaaaagcatcaaatcaaaaagaacacaatgtcgaatgcagaattataa

SEQ ID NO: 866 - DNA, 1170 bp, S.epidermidis
aaaatgaaaacagtatctaaatattttgtatatatgatgatattagttacgtttttcatagttgttagtgggtgttcgattaatcaatcttttagcgataaacaaaatacaaataaaacaatacgtgtggttgctgtaggtgataatttaattcacccagttgtatataaagatgcacaaattacggggaatagttttgattttaaacctatgtatcaaccagtaaaaaaagacattcaaaacgcagatatttcttttgttaatcaagaatcaccattaggtggggatgataggccttattcaggatttaaaaactttaatacaccgagtagtattgctcaggatttagtagatactggctttaattttgtaaacggtgcaaacaatcatgccttagatcaaggagagcaaggtgtaagaaatcatattcatacttggaacaaatttaaatatcaagttttgttcacgggtgtatatgaatcagaacaagcacaccgtcaaattcctattaaaacaattaaaggtgtgaaagttgctttattaagttacacatttggtacaaacgatcatcaaccaactcatgattatacggtagatacgtttgatgaaaataaaattaagcaagatgttaagaaagccaaacaacaaagtgatgtagtacttgtttcagcacattggggtaatgaaggtaagcatcagcctaacgccactcaaaaaaaatatgcacaaattttcgctgatgcaggtgttgatgtagttttaggtacacatcctcatgtgattcaaccagtaaaatgggttgacggtagagaagggaatcgtacactcgtagcatattcattagggaatttcttgaacggtcagtcaacagggaatgaaagtaatgatttattaggacggatagattttaaaattagtaagaaagataaacagtttcaagttcaagatgtgaagtggagaagtatggtgaattattacgaattaactcaacaccaaaaccagttccttaagtcgaactttaaagtgatgatgctagatgactataatgacaaagatgccactcatcatggtcgcaatcaaatggatagttcttcgatgagccctgcacacttacgagatatcacacgttcagttattgataaacaatatttagacaatcggagtttatag

SEQ ID NO: 867 - DNA, 537 bp, S.epidermidis
atgttagaaacacatagattaaagctagtgaagcctaatttgagttatacagatgaactttatcaattgcatacaaataaggtagctacaaagtatacacctaaaggtattcatcagaataaagtagcaacccaagattttattaaaggatggatgaggcattgggatgaatatcaatttggttacttcattttaattatgagagataatcacgaagtagtggggatagcgggatttgagtatcgtacaattcatcaacaacagtttcttaatgcgtattatagaatctttccatcgtatactggtgttggtttagcttttgagtcaatggaggagattgcccgtcatttaaaaaagcatgataccataacaccaaaattaattcgaacaaatcaatataatacaaattctattaaattagcacaaaaactcggatataattatgatgctaactgggacgatgtaattaataaaggagatcgttgttttttaacctacaagcgttggataataactaaaagcatgatgaattcgtag

SEQ ID NO: 868 - DNA, 726 bp, S.epidermidis
gttgatagaacgattaacgataggagtggatataaaatgaattattcaccaaaacaaggtgttaaaagtcatggattgccacatgatccgttcaaaagtagcacagtacctagacctataggttggatttctacagtatctaaagaaggtaaagataacttggcgccgtacagtcaatatcaaaatcttacatgggatcccccaatggtaatgtttgcggctaatcagtcagtgcttggcgatcatgaaagaaaagatacagttaaaaatgcggaagaaactggttggtttgtatggaatatggcaacatatgatttgcgtgaagcagtgaatttatcatccaaagcattacctccagaagatgatgaatttgactttgctggtgtgacgaaagaatcgtgtatcgaagctcctggaagtagggtaaaggaatcacctgttcattttgaatgtgaatatgttcaaacagtaagaattcccactggagaccctgtttcaactgtggatgtagtcatcggtcgtgtagcacaagtgcatattgacgataaagtaattatggacaacggaaaattagacattaagtcaatcagacctatagcacgtctcggttattatgattacacggttgtcgatgaaatatttgaaatgaaagcacctgcagcttcgaaagaagaattggctggacttgaaggtcgaaattttgacaacactaataatgaatcatga

SEQ ID NO: 869 - DNA, 183 bp, S.epidermidis
aatacaagaacacatattataaatgcctgggacacattaaatgtctcaggcatatttatttatggcaatcgttgcattaatagaaaatacaatgagttgtatcaaattttcaaattaagctatacgagtgaggaacataaagttttattcaacctttgttctacttcttttatttatacataa

SEQ ID NO: 870 - DNA, 2031 bp, S.epidermidis
atgaagagaacagataaaattggtgtctacctcaagctgtcatgttctgcgttgttacttagtggttcgctggttggttatggcttcacaaaagatgcttttgcagattcagaaagtacatcatcaaatgttgaaaatacttctaatagtaactccatcgctgacaaaatccaacaagctaaagatgatattaaagatttgaaagaactttctgacgcagatatcaaaagttttgaagaacgtttagataaagtcgataatcaatcaagtattgaccgtattataaatgatgcaaaagataaaaataatcatttaaaatcgacagactctagtgccacatcatcaaaaactgaagatgacgatacatctgaaaaagataatgatgatatgactaaagacttagataaaatactgtcggatttagattcaattgctaaaaatgttgataaccgtcaacaaggtgaaaatagtgcttctaaacctagtgactcaacaaccgatgaaaaagatgattcaaataataaagtacacgatacaaatgctagtacacgcaatgcaactactgatgattctgaagagtcggttattgataaattagataaaatccaacaagattttaagtctgactctaataataagctttctgaacaaagcgatcagcaagcatcaccatctaataaaaacgaaaataacaaagaagaatctagtacgacaacaaatcaatccgatagtgatagtaaagacgataaaagtaatgatggtcgtcgctcaacattagaacgtatagcatcagatactgatcaaattagggattcaaaagatcaacatgtcacagatgaaaaacaagatatacaagcaattacacgttcactacaaggtagtgataagattgaaaaagcacttgctaaggtacaatctgacaatcaaccactagattctaattatataaataataaattaatgaatttaagatcactagatacaaaagtagaggataataacactttatctgatgataagaaacaagcgcttaaacaagaaattgataaaactaagcaaagtattgaccgacaaagaaatattattatagatcaactcaatggtgctagtaataaaaaacaagcaaccgaagatatcttaaatagtgttttcagcaaaaatgaagtagaagacataatgaaacgtattaaaacaaatggccgaagtaatgaagatatcgctaatcaaattgccaagcaaattgatggtcttgcattaacttctagtgatgatattttaaaatcaatgttagatcaatctaaagataaagaaagtttaattaaacaattgttgacgacacgacttggtaatgatgaagcagatcgtattgctaaaaaattgttaagccaaaacttgtcgaattctcaaatcgtagaacaattaaaacgtcatttcaatagtcaaggaacagctacagctgatgatatattgaatggtgtgattaatgatgctaaagacaaaagacaagcgattgaaacaatattacaaacccgtatcaataaagacaaagctaaaattatcgccgatgttattgcgcgtgtacaaaaggacaaatcagatatcatggatctcattcactctgcgattgaaggcaaggcaaatgatttattagatatagaaaaacgagcaaaacaagctaagaaagatttagaatatattttagatcctataaagaatagaccatccttgttagatcgtattaacaaaggtgtcggtgattctaattcaatatttgatagaccaagtttacttgataaacttcactcaagaggatctattcttgataaattagatcattcggcaccggagaatggattatctttagataataaaggtggccttttaagtgatttatttgacgacgatggtaatatctcattaccagcgacaggtgaagtcatcaaacaacattggataccagtggctgttgtactcatgtcattaggtggagcgctcatctttatggcgcgtagaaaaaaacaccaaaattaa

SEQ ID NO: 871 - DNA, 606 bp, S.epidermidis
aatggaggaacaagaatgatacaacgtaaaggtgaattaatactttcatggattggcaatggattacatctgttgtatgtatttttagtaggcatatttttcataatgacacaaacaagtgaatttaaaaatgggatgattcaaggatttatagaagaaaatccgggggaatatgatttagcataccaaacttataatttgatgttaggtttaggtgttgttttcattattatacttctcattttattaattgtatcaatagttgccgctattttaattggcaaaaatgcaaaagtatcaggaatattacttgttattacaggaatcattggtctctttttaagttttattgctggtgccttatggttaatagcaggtatcatgcttttagtacgtaaaccacaaacacaaaatgaccaaatcaattctcaatatagtaatgacatacattcacatgttgtgccagaagaaaagaaacgtgaacaacaacaatataatatgaatgaaccacatattggtcaatcatcaacatctcatcatgatcacgcattgaatgatcaaaataaacgagaaaatcataatcatgataatcaaccatacaaatag

SEQ ID NO: 872 - DNA, 1203 bp, S.epidermidis
aaaggaggaacaacgacgatgctaacagtcggaattataccttcgccaggtatagcgcatcaacatgtaaaaaaaataattccaaatgttaaacagttattgtcaaagcggactaaacatagtcaatggaatttcgacatcaaagtcgatctcatgataggatctgcagaagatgtacatgaaagtgttgaaaaagcagcacaaattaaagaggaacatcagtgggattacgttgtttgcctgacagatttgcctagtatttcagataataaagtggttgtcagcgactttaatagtgacaaacatgttgcaatgctatcattaccgtcactaggttttattgatttgaaacgcaagctagttaaaacgatgacttcattgattgaacaattatattataatcaaccgaaagacaaaaatgcgccacatccttttgtacgcgtgaaggctgtagaacctgacgaagacgccacatcaaagcaacgatatattaatattttatttatcataagttggattcagttaattggtggactgacacgagcaaatcagccttggaaaaacatctttaattttaagaaaatcatttcagttgcctttgcaacaggaacttatgtctccatattttcaatgccatgggaattaagcgtgatttattcgccgcttcgacttatcatattgatggtgattgctatacttgggatggccggatggctattctatgcgcatcaattgattgaaaagaaaactgctaaatctcagcgagtatatcgatatatttataattcaaccacacttgttacattaagtttgattaccctcataaattatgtcattttatatttattgttaatcatcagtattacactctttgtccctgtggaattatttaatagttggacgagtgcccaatcacaatttacattctcaaattatatgagattgatttggtttgtatcatcattagggcttttagctggagctatgggatcaacagttgaaaatgaagagaaaatacgtcgtattacttattcttatagacaatatcatcgttataaagaagctgagcaagaacaaaaagaacaagaaacttctcgtgatgtatcacaacaaaatgtcgaacaacaaacttcaagtaaagatgaaaataatgaacaatatgaaggtaaaaaacaaggacatagagaggaggatgacgcatga

SEQ ID NO: 873 - DNA, 141 bp, S.epidermidis
aattttttgactatctcttatggtttatcagctacatgtaatccgcattcagtcttactagaattggaccaacgaccagcacgtgaatcattagaatcaaatacgggtgatgtacatggaatgcaaccaatacttggataa

SEQ ID NO: 874 - DNA, 993 bp, S.epidermidis
ctaaaattgactaaagaggagcacagatttatggattatagagtactactttattataaatatgtaactatagatgaccctgaaacttttgcagccgaacatttgaaattttgtaaggaacatcatttaaaaggaagaatactagtttcaacggaaggcattaatggaacattatctggaacaaaagaagatactgataaatatatagagcatatgcatgcagatagtcgttttgctgatttaacttttaaaattgatgaagctgaaagtcatgcgtttaaaaagatgcacgtgcgtccaagacgtgaaattgttgcacttgacttagaagaagatattaatccacgtgaaattaccggtaaatactattctcctaaagaatttaaagccgcactagaagatgaaaatactgttatattagatgctcgaaatgattatgaatacgatttaggacatttccgtggagctattcgtcctgatataacacgattccgtgacttacctgaatgggtgcgtaataataaagaacaactcgacggaaaaaatattgtcacatattgtacaggtggcattcgttgtgaaaaattttctggttggttagtaaaagaaggatttgaaaacgtaggtcagttgcatggtggtattgctacatacggtaaagaccctgaaactaaagggctatattgggatggtaagatgtatgtatttgatgaacgttttagtgtcgatgtgaatcaaattgataaaacagtcatcggcaaagagcattttgatggtacaccttgtgaacgttatattaattgtgcaaaccctgaatgtaataaacaaattcttgtttctgaagaaaatgaagaaaaatatttaggtgcatgttcgtatgattgtgcaaaacatgagcgcaatcgctacgttgcccgtcatcatattagcaatgaagaatggcaacgtcgtttaaataatttcaaagatgtgcctgaacacacacatgcataa

SEQ ID NO: 875 - DNA, 966 bp, S.epidermidis
gaggaattgacaatgaaaatggaaaaagaacaagcacattggatttataaaacgatgaacgaaattcgattttttgaagaaaaggtacacaaaatttttagtgatggtagaattccaggattcgtacacttatatgtaggtgaagaagctgttgcaacaggtgttatgtctcaattaaatgatgatgactatattacaagtacacaccgtggtcatggtcatgcgattgcaaaaggatgcgatttaaatggtatgatggcagaaattatgggtaaacgtgacggattaggtcacggtaaaggtggctcaatgcatgttgcagaaattgacaaaggaatgctcggtgcgaatggtattgtcagtggtggttttgggttagcaattggtgcaagtatttctatcattaatcaaggtaaagataatgttgccgtatgtttctttggtgatggtgctgcaaatgaatgtaatttccatgaaggtcttaattttgcttcaattttagatttacctgttctttttatatgtgaaaataaccaatttgctgaaggaacaacacatgactacgcaagtgcttctgaaacaattgcagagcgtgctgcggcttataatatgccgggtgtacgtgttgatggcatggatgttatggaagtatataaagcaacacaagaggctgtagaacgcgctaaaaaaggtgaaggaccaacgttaattgaatgtgatacgtatcgtaaatatggacattttgaaggtgatgagcaaaaagtaaaatcaccagatgatcgtaacgcagataaaaatgcgacagtagaatttagaaaaagagcaattgaagaaaattggctcactgaaaaagaagcagatgaaatagaaaaagcagctgaacaagctgtagaagatgctgtgaaatttgctgaagaaagcgaattaccagatgaggattcattatacaaggatgtttttgcttaa

SEQ ID NO: 876 - DNA, 867 bp, S.epidermidis
agcaacatgactaaagttattacaacaatcaatgaaatgcaatctattgttaaacaacatcaacgtgaaggtaaaacaataggattcgttccgactatgggagctttacatgatggtcatttaaccatgatgaagcaatctgtaagcgaaaatgatctcacggttattagtatatttgtgaatcccttgcagtttggacctaatgaggattttgatgcttatccacgtcaactcgatgatgatgtggctgcagtaaaaaagttacaagtggattatgttttccatccgagtgtagatgaaatgtatccagaagaattaggtattcatctgaaagttggacacttggcacaagtattagagggagcacaaagacctggacacttcgaaggtgttgtgaccgtggtcaacaaactatttaatattgtgcaaccagattatgcctattttgggaaaaaggatgcacaacaattagctattgttgaaaagatggttaaagactttaatcttcctgtacatgttatcggtattgatatcgtaagagaaaaagatggtttagccaaaagctctagaaatatttacttgacctctgaagaacgaaaagaggcaaaacatttatatcaaagtctacgcttagcaaagaatttgtatgaagcgggtgaacgagatagcaatgagattataggtcaaatcgctgcgtatttaaacaaaaatattagtggacatattgatgatttgggtatttatagttatccaaatcttatacaacaatcaaagattcatggacgaatattcatatcattggcagttaaattttctaaagcaagattgatagataatataattattggagatgactatattgattag

SEQ ID NO: 877 - DNA, 1971 bp, S.epidermidis
ctatgcatgacccatattacagaaagtgaaatgaaacaaaaatatctagatttactctcacaaaaatttgacagtgcagaaaaacttgctactgaaattattaacttagagtcaatcttagaattacctaaagggactgaacattttgttagtgaccttcatggtgaatacgaatctttccaacatgttttaagaaacggatctggaaatgtgcgtgctaaaattaatgatatcttcaaagataaattatcccagcaagaaatcaacgacttagcagcattagtatactatccggaagaaaaactaaaattagttaaaaataatttcgattcaatcggaacattaaatatttggtatattacaaccattcaacgattaattgatttaattacatattgctcatcaaaatatacacgttcaaaattacgcaaagcattacctgaacaatacgtttatattattgaagagctactttacaagagcaatgaatttcataataaaaagccttattatgaaacattagttaaccaaattattgaattagaacaatcagatgatttgatcattggcctttcctatactgtacaacgtctagtcgtagaccatcttcatgtcgtgggcgatatctatgaccgtggtcctaaacctgataaaattatggatacattaataaattatcattctgtagatatccaatggggaaatcatgatgtattatggattggcgcctatgctggttcaaaagtatgtcttgctaacctactacgaatctgtgcacgttatgataatttagatattatcgaagatgcatatggcatcaatctacgtcctttacttacgcttgctgaaaagtattacgatgctgaaaacccagcgtttaaacctaagaaacgaccagataaagacgtcagtcttacaaaacgcgaagaaagtcaaatcacaaaaattcatcaagcaattgcgatgattcaatttaaacttgaaatgcctattattaagcgccgtccttcttttgagatggaagaacgtttagttttagaaaaaatagattatgataataatgaaatcactatatataataaaacatatccgcttaaagatacttgtttccaaactgtaaaccctaacaatcccgctgagttactagcagaggaaaaagaagttatggataagctattactttcattccaacaatctgaaaaattaagacgtcatatgtctttccttatgcgaaaaggaaaattatatcttccatataatggcaaccttttaattcacggttgtattcccgtcgatgaaaatggagaaatggaatcatttgaaattgaaggtgaacgtttaagtggtcgtgaactactcgatgtttttgaatatcatgtaagaagagcttttgaccataaagaatctaccgaagacatttctacagatttagtatggtatctttggacaggtaaatattcatctttatttggtaaacgtgccatgacaacgtttgaacgttattttatagaagataaagcatctcataaagaggagaaaaatccttattattacttacgtgaagatgttgatatgatacgtaaaatgttaaaggattttggtcttaatccagatgaaggacgtatcataaatggtcatacgcctgttaaagaaattgatggtgaagatccaattaaagctaatggtaaaatgttagtcatagatggaggattttcaaaagcttatcaatcaacaactggtattgccggatacacacttttatataattcatttggtatgcaattggttgcacataaagagttcaatagaaaagaaaaagtgttatcaatgggggcagatgaattgtcagtgaaacgcgttgtagatgaagaattgcaacgtaaaaaaattagagataccaatatcggtaagcaactgcaagaccaaattgatatcctcaaaattttaatgcacgaccgatatttaacataa

SEQ ID NO: 878 - DNA, 999 bp, S.epidermidis
tttttaatgacaaaaattatgtttttcggcacaagagcatatgagaaggacatggcattacgttggggaaagaaaaataatatcgatgtcactacatcaacagaacttttaagtgtagatactgtcgatcaattaaaagattatgacggtgttacaacaatgcagttcggtaaattagaacctgaagtttaccctaaattagagtcctatggtattaaacaaattgcacaacgtacggctggatttgatatgtatgacttagaacttgcaaaaaaacatgaaattattatctcgaatatacctagttattcacctgaaacaattgctgaatattcggtatctatcgctctgcaactcgtacgaaaattcccaacaattgaaaaacgtgtgcaagcacataatttcacatgggcgtcccctattatgtctcgtccagtaaaaaatatgactgtagcaatcatcggtacagggcgtattggtgctgcaactggtaaaatctatgctggttttggtgcgagagtagttggttatgatgcatatcctaatcattctttatctttcttagaatataaagaaacagtagaggatgcaattaaagatgctgatattatctcattacatgtacccgctaataaagatagtttccatttatttgataacaatatgtttaaaaatgttaaaaaaggtgccgttttagtcaatgccgcaagaggagctgtgataaacacgcctgatttaattgaagcagtaaataatggtacattatcaggtgctgccattgacacatatgaaaatgaagctaattatttcacatttgattgttcaaatcaaacgattgacgacccaatattattagacctaattagaaatgaaaatattttagttacacctcatattgcctttttctccgatgaagcagtacaaaatttagtagagggtggtttgaatgcagcattatcagtaattaatactggcacatgtgatacgcgattaaactaa

SEQ ID NO: 879 - DNA, 213 bp, S.epidermidis
gcctcaatgacatatatttctttatcacaaaagattcggaacgcaaatattctaaattatcagaaaatatttacaaatttgaaaattattagtatattgattactatcctattaatattgatttattttaaaacgatagcagttgatagttttatagcttcatatgtagatagctatattaaaaagagtcactattgggagggaactcaatga

SEQ ID NO: 880 - DNA, 888 bp, S.epidermidis
gtgaaggtgactcaaaatgaaaatttgaagttagcgcaacgaggtgcatttcttagtttagtcatctatattatactttctattgcgaaatatatgactggatatgtttatgattcggcggcagttagagcggatgctttaaataacatgacagacattttagtttcagtagcagttatcgtcggacttaaaatctctattaaacctgctgatcaaaaccacccatatgggcacttaaaatctgaaaatatttccacattgctagtatcattcattatcatgtttgtgggaatacaagttattatagaaaactttccgagattatttacacatgattcacatattcctaactttattactattattataagtatgatcagtggacttgtgatgttatgtgtctttgctattaattatcgattatctaaaagaacgaaaagtagctcattaaaatcagcagctaaagataatttatctgatagtttagtcagtattggcactgccattggtctaatgttcacacaaattggatttccaattatcgatattatattggcaaatattttaggtttattaatcgtgtatacaggttttggaatttttaaagagtcgattttcaccctaagtgatggtttcaatgaacaagatttagaagaatacagactagacatattagaagttgaagatgtaattgatgttaataatattaaaggtagatatcatggaagtagtatctttattgatgtgaccattgtagtagatccttatctttcactttatgaagcacatcagatttgtgataaagttgaaattcatttgcataataaaggaatttcgtctgtatatgtacatccagaaccctatactacaaaagacgaagtaaaataa

SEQ ID NO: 881 - DNA, 1062 bp, S.epidermidis
cttatgtcgacgataaaaaatatcgatggaccaaaggattttgtttttagagtgttatcaggggtagcaattggaatagtagccggactcgttccaaatgcaattttgggagaaatttttaaatactttatgcaatatcatcctattttcaaaactttattaggggtcgttcaagccatccaatttacagtgccagcgcttattggagcattgatagctatgaagttcaatatgacacctttagcaatagctgtagtagcaagtgcctcatatgttggtagtggtgcagctcaatttaaacaaggtacatgggtaattgcgggaattggggatttaattaatacgatgttaactgcatccatcgccgtgttacttattttattaataaaaaaacgtgttggtagtatggctttaattgtttttccgacagttgttggtggtttagcagctacaatcggcgtatttactttaccatatgtaaggttaattacaacgggaattggtaacatggttaatagctttactgaattacaaccagtgtttatgagtatgttaatctctatggtgtttagttttataatcatatcaccattgtcaactgtagccatagctattgctattggattatcaggtattgctgcgggatctgcttcaataggtatagcagcgacagaagctgtattattgattggtaccagcaaagttaatcatgtaggtattcctttatcaatatttttcggtggggtgaaaatgatgatgccaaatatggttaaataccctgtcattatgattccgattttcttgacagcggcaatatctggtattgcttcagggattattggtatttcaggaacaaaagaatcagcaggatttggttttatcggaatggttgggcctattaatgcctttaaatttatgcatgttgattctgcatggttaagtttattacttattgtcatcgccttttttgttgtgccgtttctagttgcatggattttagatttaatacttagaagattaattcatttgtatgagaatgatatttttaaatttatgggataa

SEQ ID NO: 882 - DNA, 483 bp, S.epidermidis
gagaaggcgactactatgaaaaaagtcatatcgcttttagtagtattagttataagtgctgtatctctttcggcatgtgggaaagaacgcacaaaaacttatgaaggcgaagtcaacggaaagcaagtgattacatctttgacatacaaagatgatgaagttctcaaacaatctactatagcaacaattaaatatgatgatttaggcatcgataaagatgaagctaaacaaatgtttaaaaatgatgaacaagcattcaaagggatagacggggttacatataaagctgattttaaagatcgaaaagccatcgaacatatcgatattgattataaagatgcggatatagatcagcttaagaaaaatttaggtttcatatcatcagatgccaaaaaaggtgaccatgtgagtgtggatagggttgttaaacaactcaaacgtaatggtttaaaagataaaagtaaaatgaatgaagataattaa

SEQ ID NO: 883 - DNA, 123 bp, S.epidermidis
aaaagcgagaccgattcttttcagattcgtcgtctcgctcccttacaactgactatgattcgaaacagtcagcaacaagcatttttcaattcatttatttataataaaagtttaaaacattaa

SEQ ID NO: 884 - DNA, 141 bp, S.epidermidis
gaaagcgagacaacaatacgaggtattataaataaaaagccagtaaatgaatttataaaaaacccatttactggctattttgctaggaattatgtcccagcctctccttttaatttcaatatttgtaaaataaatatctaa

SEQ ID NO: 885 - DNA, 1086 bp, S.epidermidis
aggaatgggacggattcgatgaagaaaaataaacttgaattagtgtatttacgtgcgtttatttgtgtcataatcatcgtgacacacttactaacgcaaatcactttagaaaatgaacagatgtctgatagttcactcatattgcaatattatatacgcaatatttttattttcggcacccctagttttataatattgtctcaattattaacaacattaaattacgaatcagtaactataaattatcttttttcaagatttaagtatatttttattccatatcttttaatcggcttgttctatagttatagtgaatcacttatcaccgcttcttcttttaaaaagcagtttatcgaaaatgttgttttaggacaatggtatggctatttcattatcataattatgcagttctttgttctatcttatatcatttacaaaattaattttagattgttcaatagtaaaattttgctgcttttagcatttatagtccaacaatcttatctacattattttttgaataatgacacttttcatcaattcatgactcattattatccattaagcgaaaatacaatgatattaggatggatattctactttttcttaggtggttacattggctataattatgaaaaaatattatctttcttagaaaaatatttaattatagttattatgttaactttaggcgcatatgttttatttatcgctgtttccggtagtgattattggaatgtcacaagctttacttatacgttaacattatataatagtgtcatgttcttcttattactaggagtctgtatgcactttaaaactatgttattaaatactattaaagctattagtgcattttcctttttcatttatttgttgcacccaattatcttagattctctttttgcttacaccaacatatttgaagataatacaattgttttcttggcgatttcacttttaatgattctaggaatttgtataggcgtcggaatgatgttaagagagttttatatattcagatttgtaattggaaaacaaccgtacaagttacaatttgaccaataccagcctaactggaattaa

SEQ ID NO: 886 - DNA, 153 bp, S.epidermidis
aacaattttttaaaaaatggaggagtactaaaattgacacgtataaatgattttaacgaagtgcttaacagtagaaaatcactaaaggtatttgatgagaattataaaattcctcgagaagaaatggatgaaatcattactaaagcaacttaa

SEQ ID NO: 887 - DNA, 138 bp, S.epidermidis
aatctttatttaatcatgaaaaatcgattcacgtacgccgataaagataggttattacgatatctgttaataaaaatgaaagcgtatgttcgttactctattgctacagaagaacaacttcttctactggaaaaatag

SEQ ID NO: 888 - DNA, 138 bp, S.epidermidis
ttatttgttgcgtttattaagccaatgagtaaaaaacgcaatggcacagccactgatgactggcgctatgatgtgaacgaaaataagcatcactttatacacctcctctctgcgtcgaaattgacgcctgagagatag

SEQ ID NO: 889 - DNA, 147 bp, S.epidermidis
gggccttatttttcaaagtattttaatgtaaaattacatatgaatataaagtattttggcgagactcttgagggaacaggacaagctgaagactacaggctgaagctgtcccctaagaaagcgagccaacaatacgtagtattgtaa

SEQ ID NO: 890 - DNA, 201 bp, S.epidermidis
acgcgatctgcgtcatataataaaacacctaaatatctcatacgtcctgtacaagtttcggaacaaacagttggcataccagcttcgattcgtgggaaacaaaatgtacatttttcagctttattcgttttccagttaaaatatacttttttatacggacatccagtcatacagtatctccaacctcgacaggcttcttga

SEQ ID NO: 891 - DNA, 156 bp, S.epidermidis
gattattattttcgtaaaattcctttgtatatcacaggaatcaataagataaaaccaaaaagtcccatgatagggaacactttaccaatgagagaaatgaatcccacaaaagtacaagcaaatgttattatcgccatcataactataagaatataa

SEQ ID NO: 892 - DNA, 162 bp, S.epidermidis
aaaagtgctgctatagcatcatgttttatactaataattaattcgggtttaaatagtaatgtatatattaaaacaaccgtgacaacaaacatcattgctggtattaatcgtttaaatcttctaagccaaaaattaactaaattaatagaattatttctataa

SEQ ID NO: 893 - DNA, 1584 bp, S.epidermidis
acaaattatttatgcttatccaaaaggtggggagcgtatattgtttctaaaacaaatcttggtgagaaatggggattgctagctggagggtctttattagtcgactatatattaacggtggcagtgagtatttcttcaggagcagatgcttttgttgctgcatttccccacttatatcattttaaagtgcttattgcatgtttattagtactctttattttaatgatgaatttaagaggtttgactgaatcagcaactgtattatcatatccagtctacttatttattataggtttaattgttttgatagtcgttgggacatttcgcgtagctactggacaaatcgcaccacatattcattccactgtaggtagtactgtgcccggtgttacgttatttttacttttaaaagcattttcatctggagcatcatcacttacaggtgtagaggcaatatccaatgcagtaacaaattttaaaaatccagcacctaagaatgcagtcaaaactttagtcactatgggtacaattttagcagtgttattagtaggtattgttgtactctcatatatatatggaattatgcctcaaactgaaacgaccgtgctttcacaacttgcgtcccaaatatttggtgaaaatgtagcgttttattttatacaagctactacagttatgattttggtattggctgctaatactggttttacagcatttcctatgctagctgcatcaatgtctaaagacaaatatatgccacgtatgtttactgttcgtggtgatcgtctcggttattcaaactcgattattatattaggtgtattagccatcattttaattatcctatttgaaggaatgacagagaacctcattccattatatgcagtaggtgtttttattccatttacgcttgctcagtttggtatggttttaaaatggcttcgggaacgtcctgaacgatggggaataaagcttactatcaatttaattggtggtacgattacgtttatcgtattcatgattttactcattactaaacttaatcaagtatggccaattcttttatttttaccttttattgtatttatttttattagaattcatgtacattatgagaatatagcatgtgaattacgatctgaaattgatatacacgatattcctgttgtagatcgcaatttagctattgtacctattcaaagtattacaactgtagttgataaatctatttattatgccaaattattagctaatgatgatgttattgcagtgcatgtgacatttggtgatgaagatgagcaggcttttatgactaaatggaaaaaacattttcctgatgtaagacttgtgattttacattcagagtatagaagtattattcatccgatttcacgatttatagataaaattcgtaaaaaagcgaatgataaaaattatttaattacagtagtcgttccagaatttatccctaaaaaggcttggcagcacttattgcacaatcaaacgagtttacgtttaaaattgcatttaatttatcaaaaaaacgttactctgtgtactattccattcaaattaataaaataa

SEQ ID NO: 894 - DNA, 153 bp, S.epidermidis
cttaataatgcattactatttgtaaaaataattaaaccaccgacacaaattgcaagaatgttaatgggtaacactttaactaaatacgctgaaataggtgctgctaccattccaccgagacttaaagcaattacagcaaaccaattaatttga

SEQ ID NO: 895 - DNA, 993 bp, S.epidermidis
cacagttatttgtgtaactttattatgaaggagttcgttaaaatgaaaaaatttgggaaaaaagttgttttagtaggagacggttccgtaggttcaagttatgcatttgctatggtgactcaaggaattgcagatgaatttgtaattattgatattgcaaaagataaagtggaagcagacgttaaagatttaaaccatggtgcactttacagttcttcaccagtgactgtaaaagctggagaatatgaagattgtaaagatgcagatttagttgttattacagcaggtgcacctcaaaaaccgggtgaaactcgtttacaacttgttgagaaaaatactaaaatcatgaaaagtatcgtaactagtgtcatggatagtggctttgatggtttcttcctaattgctgcaaacccagttgatatcttaacacgttatgttaaagaagttacaggtttaccagctgaacgtgttattggttctggtacagtgcttgatagtgcaagattcagatatttaataagtaaagaattaggtgttacatcaagtagtgttcacgctagcattataggtgaacatggtgactctgaacttgcagtttggtctcaagcaaacgttggaggtatttcagtgtatgatacattgaaagaagaaactggtagcgatgctaaagcgaatgaaatttatattaatacaagagatgctgcttacgatatcattcaagctaaaggatctacgtattatggtatagctctagcactattacgtatttctaaagctttactaaataatgaaaatagtattttgacagtttctagtcaacttaatggtcaatatggatttaacgatgtttatcttggcttaccaacacttatcaatcaaaatggtgcagttaaaatttatgaaacaccattaaatgataacgaactacaattactagaaaaatcagtgaaaactttagaagacacttatgattctataaaacatttagtttaa

SEQ ID NO: 896 - DNA, 267 bp, S.epidermidis
atccccagtgcaagtacacctgaaaacgaacctggtccaacagctttaataaatattaacgccattacaatttcaggaaacacacgtataatgcttaatatgaatttacttatgcccgtaaccggtcgtaatttcatcatatttttagctcctaaaaatgcaaaaggaatacatataattgaagcaatgaacgtgccaatcactgcaatagcaaaagtttccagcaaacctctaagtaagtcttcaccatcaggtatatatatgtaa

SEQ ID NO: 897 - DNA, 579 bp, S.epidermidis
aatggaggtgcaatgatggattataataacaatgacagtcaatatatcgaagaagctaaagatttagttatcaactcaatcggtgaaaccatggatttgtatggtatcaaccgtagtgtaggtaacttgtatggcattatggtttttgaaggaagtatgacacttgatgaaatgcgacaacaactgcaaatgagtaaacctagtatgagtacaggtgtaaaaaaactacaagaatacgatatcgtcaaacaacaattcacgcgtggtagccgaaagcaacattttattgcagagaaagatttcttcactttcttccgcaacttttttactaaaaaatgggaacgtgaaattgacactaatatggaagcaattgaagatgcagaaaatatcattcacccacttcttgaaaagaatgatatagatgaggaagttaaaaaacaagcaataaatgtaaaagcgcagttagaccactctaaaatatattacaagtggctcgctcaattaagtgaagctctagagtcaggagaaatttttaactatttcccaattccagatgaacaacatcatcatgatcaataa

SEQ ID NO: 898 - DNA, 261 bp, S.epidermidis
gtgtgtatcgcatgtcttaaatgtggctttttaatgcttaggtgttattttaatgttttttctttttatcagaacggtaagttatacttattaaagataaccaaaccagtaacatggttatggctagatagacacttacaactaaatatttcgaatgtaaaggtaaccatgataaaacaaacccccaagttgcatctcctaatattatcaagggaagtagataaaaaagaatattcattgctacaaatcccaacaaaatga

SEQ ID NO: 899 - DNA, 951 bp, S.epidermidis
tggagatatttacttatgtctataacttatcctggcacagtttatctaatcggtgcaggaccaggcaatccaaacttattaactaaaaaagctgaacggttaattagatcagctgacgtgattttatttgatcgtctcgtaaatcctttcatcttacagtatgcttcttctcaaacaaaagtgatcaatgtgggaaagaaaccttattgtaaacacattcaacaagaggagattaatcaaaaaattgttgaagcagccaatcaatatcaatgtgtggtgagactgaagggtggagatcctgcgatttttggtagaattacagaagaagtacaaacattagaagatcatcatattcattacgagattgtccctggtgtgacatcagcaagtgctgccgtagcaactatgaatatgggattaacaatgcgttctatcgcaccgagtgtgactttctcaactggtcattttaaagattcggttaatcacgatatggatattaggaacttgattaatggaggcactttagctatttatatgggtgtgaaaagattaggtcaaattattaaacaaattgaatcgtatacgaatgaagactaccccattgcaatagtgtttaatgcttcctgctacaatgaaaagattgttataggtcatttaagtacgattgaagaacaattggtttctcaacaactagaaggtcatccaggcatatgcattttaggtaatatacttgatgacattaatcgtacgttattgaataataataagaatgacaaggggaatctatatttaattaagggagataaagaacgtgcaattgcaaaggctgaaactttatatgatgaaggaatccaatgtctgattgattttgaccatagctaccacatttctcaacaaaacgtgtataacgaaatgattaaacataagagtattaaaacaatatatgtataa

SEQ ID NO: 900 - DNA, 132 bp, S.epidermidis
aaattaaaagcgcccgtacatacactcatgtacaggcgcttaatttatgtgctgaagtatactttgttttattttgaattaattaatggtcacgtcattgattatcttttcataaaacaaattaatctttga

SEQ ID NO: 901 - DNA, 597 bp, S.epidermidis
agaaatggagcgtatgttatgaactatcaaatcaaaagaaacactgaagaaactcagcttaatatttcactggctaataacggaacacaatctcatattaatactggtgtaggatttttagatcatatgttaacgctatttacttttcatagtggattaactttatctattgaggccactggagatacgtatgttgatgatcatcatataactgaagatataggtatagttattggacaattacttcttgaattaataaagactcaacaaagttttacaagatatggttgctcatatgtacccatggatgaggcgcttgctcgaacagtagtggacattagtggtcgtccatatttctcatttaatagcaagttgagcgctcaaaaggtaggaacttttgacactgaactagttgaagaattttttagagcattgataattaatgcgcgattaaccgttcacattgacttattaagaggtggaaatacacatcatgagattgaggcaatatttaaatcttttgcaagagcattaaagatttctcttgcacaaaatgaagatggacgtattccatcgtctaaaggagtaattgaatga

SEQ ID NO: 902 - DNA, 441 bp, S.epidermidis
ttttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactgacttaggtcgtaatttctctggaactgtgtcaggttggatgaacttatggggaaatgttggcgcacttattagtcctttacttgcaggaattgttgtagatcatttaggatggtcaatgacattacaactcttaatcgttccggctattatagcagcaattctatggttcttcgttaaaccagacaaacctcttattgttagtgaagaacacgttaataaataa

SEQ ID NO: 903 - DNA, 138 bp, S.epidermidis
aaaggcttggcagcacttattgcacaatcaaacgagtttacgtttaaaattgcatttaatttatcaaaaaaacgttactctgtgtactattccattcaaattaataaaataacaaaaggaccaaatacacttgattaa

SEQ ID NO: 904 - DNA, 147 bp, S.epidermidis
attttaatggcagttctttgggcaattattgctaaagacttagcagaacaacataaaatggtaaacgatgccgagaaaagattattaatcaaaatcgtgatattgtcgcaactgagaaatctttaccaccgtggaaacgttttttaa

SEQ ID NO: 905 - DNA, 288 bp, S.epidermidis
acgtcgatggctgcagaaattaaacaaggcgatcataaattctatgtaggtaatgacgaaaataacccaaaagctgttattacatttaaagaggttgataacaatgaaatagacattgatcatactggagtttctgatgaactcggtggacaaggtctaggtaaaaaattagttaatcgtgttgttgaacatgcacgagaaaacaatctaaaaattatcgcttcttgtccattcgcaaaaaacgtattagaaaaagatgatcatgcacaagatgtttatctaggatag

SEQ ID NO: 906 - DNA, 864 bp, S.epidermidis
atgaaggaggccaaaatgaagaagcaacagaataaagtccatatgattaatatatctttatgccttatagggacattacttattgcaatcgcagtaaatagttttgttataccgggcaatttaggtgagggtggttctataggcctttcattaattctgaattatactctaggtatttcacccgcactcagttccttcatcattaacgcaatattaattattgtaggttggaaatttctcagtagaacgacagcgatttacactgctataacaatcaccgcaagttcaatttttcttgatttaactcacacattcggattaggtattcatgataattttattaattcaatttttgcaggtttaatgttgggaatcggttctgggttagtaattactgctcatagtacattgggtggtacatctgtcattgcacgtatcatttcaaaatatagtgagatgaagacgtcacaagcactacttatattagatgcaatcatcgtgttatcatttatcgttgttttacctataacgaatgtattatatactattgtgatgctatttattgttgaaaaatcaatgtcttttgttgttgaaggatttaatcctaaaaaagctgtgacagttatttcaaaatataataaagaaatcagtgctgatatatatgaaatgactggaagaggggcaaccttattaagtggtaaaggtgcttaccaaaaaagtgatacagaagttctatatgccgtggtatcccaaaatcaagttggagcaataaaaaagattgttaatcaatatgatgaaaatgcctttttagtgattcatgatgtgcgtgatgtcttaggtaatggatttattaatattaaataa

SEQ ID NO: 907 - DNA, 546 bp, S.epidermidis
tatacacatttaaggagttggagaaatatgtatcaatcaatgtatgactcgcccgttggcttattgcaattaattacaaacgatggcatctcgttgtcacatgtcttataccctaatcaacatttgaaaggaattaaaacaaatgatacgttagatgtttttaaagatactaaagcgtggttaagagagtattttaaagggaattatcctgagataaaagtaccgttagcaccaaaaggcactgattttcaacagaaggtatggaatgaacttcagacaattcgttatagagaacttaaaacatatggagagattgctaaaacagtaggacgagcaatgaataagccagcaatgtctgctcaggctgtaggaggtgctgttgggagtaatcctatttctatacttataccatgtcatcgagtggttggtaaagatggaaatttaacaggatacggaggtactttagacaacaaaataaaattattaaaattggaagaaatagatatgacacatttatacagacctaaaaaaacaacgaaaccttga

SEQ ID NO: 908 - DNA, 132 bp, S.epidermidis
tattcgcatttatattttgtatggtacaatcattttaaatatgaaaatgttgtgagagattttatgaatctagaaaaaagttatattgaacaacaagtaacaaatcgtggaaaatctactgctgtatcttaa

SEQ ID NO: 909 - DNA, 165 bp, S.epidermidis
gttataaatttgatcgatggctcgatttatcattttatcaatatgatttatctgattcataaaaaaagtgtagagttattattaaataagttaatcgaaaaagatactctttattttttatttcttcagtcttcttttttattttcaataacaaaacgaatgtaa

SEQ ID NO: 910 - DNA, 1365 bp, S.epidermidis
caacttttttatagagataacttgaaagtagggattaaattgatttgttctaattgtggggcacatttagagaaggatgataaattttgtgttaattgtgggcagagtgtgttcgataatccaaagacaaaaactgaacataattttaatagtcaagatagacaatgtccaaagtgtcacaaagtagtaaatgtcgatgataagttttgtatcaattgtggtcattctcttcagcaaacattatcaaattcaaatgacaacatagcatcacatacatattcaaatacaaaacctgaaattgaaaatgaaactgcagatcatattcgattgacagaagaagccaagcatctatttaataacacaacgaaatcaataggtaggctagcaggaaatgatgaaagtttaaaactaaatttgcgtgacatgttttctgaggtgtttaaatctcacaccaaagatgaagcggatgatgtatttattgctggaacaaagcgtacgacgccacatattaatgaagtttcggaggagtggggaagaccttgggtgttctcgcgtgtatttttagctttaggtatcactttcctagcgttatggatattaacaaatatatttgataatgccaatgccataccaggtatgatatttattggcgcactattagttcctatttcaggattaatcttcttcttcgaatctaatgcatttaaaaatattagtatctttgatgtaatgaggatgttctttattggtggtgtattgtcactcattagtacaatgattttatatcaatttgttacatttagtactgaatcgcaatactatggaattatgactataacagatgcattcatagtaggatttgttgaagagcttggaaaagcaactgttgttattttatttattaattatttaaaaacaaataaaatactcaatggattacttatcggtgctgctgttggtgcagggttcgcggtgtttgaatcagccggttatatctttaggtttggatttaatttatttgatggagctaataatattactgaaatcactatacaaagaggttggacagctttaggcagtcacctcgtttgggcagctattgttggtgctgcggcagtaatagtgaaagaaacaaagcatttcgaatgggcgaatatcatcgataaacgttttatatttttcttttttgtagcagtgacattacacggaatatgggatacggaaataacacttttaagtagtggttatttaaaatatatcttattaattatgattgcatggctatttatatttatacttatgaaagcagggctaactcaggtgaatcagttgcgtgatgaatacaatcgtttagaggaaaggtga

SEQ ID NO: 911 - DNA, 213 bp, S.epidermidis
tcaattatttatataaaggatgaattcgtcatgtttattttagtcaatacaatattgttcatagcgatttttggttatacagcaatgacattagtaaaattctttaaacgttcaaaagaaggtgattgtggtgggtgtaaatctaattgcaaatgcgatacgaatacttcatctcataaaaataaattaaatattccacatattaagtcatag

SEQ ID NO: 912 - DNA, 477 bp, S.epidermidis
atgagtatttatgatattgaggtagagaattatgatggctctacctatttactaaaaagatataaagggaaagtgctcattatcgtaaatactgcaacgaattgtactttgaatgatcaatttaataaattagaaatgctttataaaaaatatcataagtatggtcttgagattttgagcttcccttgcaatgattttaataatcaggagccaggattaatcaaagatatttatcgagtatataaatataagtttggtattactttccccatccatgctaagattaatgttaatggagagcatgaacaccctttgtacacattattaaaatgtaaacaaccaggattatttggttcgcaaattaaatggaatttcactaaatttgtagtagatcaacagggaaatattgttaaacgatttttaccttgtgataatcctaaccaaatggaaaaattaataaggcaattattaaaataa

SEQ ID NO: 913 - DNA, 1212 bp, S.epidermidis
attaaagtttataataatcttgaggagaggattaagatgaatcaaactttagttcaacatctacgtgaaaaagagcaaagaatgaaagaaataagacgttacttacatgaaaatcctgaattatcattcgaagaaaatgaaacatctaaatatattgcaaacttttataaagataaggattgtttagttgagacgaatgtgggtcctaatggaattaaagttaccatcgcaggtaaacatccaggaaaaactatcgctattcgtgctgactttgatgcgctaccgataaaagaagaaacagaattaccttatgcttctaaaaatgagggagtcatgcatgcttgtggtcatgatgcacatactgcgtacatgctaatacttggagaaacattaattgaaatgaaagatcaattgagaggtaatgtcgtgattatacatcaacctgcagaagaaatgccaccgggcggtgcgaaaggtatgatagatgacggcgtattagaaggggtggaccatgttttaggtgcacatgtgatgagtatgatggaaacaggtaaaatatactatcgtgaaggttttgttcaaacgggacgcgcttattttagacttgttgtgaaaggtcagggtggtcacggctcatccccacatacatcgaatgacgctattgtagcaggtgcgcattttgtaacgaccgcacagaccattgtttcaagacgcttaaatccgtttgaaacgggtgtagtcacaataggttccttcgacgggaaaggacaattcaatgtgattaaagatacaataacaatcgaaggtgatgtacgtgcactgactgatgatacaagagacaatattcagaatgaaatgacacgactagtcagaggattagaagagatgttcggagtgatttgtgattttgaatttaaaaaggattatccagctctttacaatgatcctgaatttacttcttatgtagcaacaactttaaaaaatgctaagctggatgacataaaagcaatagatatttgtgagccgcagccaccctcagaagatttcgcgttttatgcgttagaaagaccttcaacatttatttattcgggtgcagcaccagaagatggacctatgtaccctcaccatcatcctaagtttaatatcaatgaaacatctatgcttgtagttgcagaggcagtgggtacaattgtattagattatttgaaataa

SEQ ID NO: 914 - DNA, 147 bp, S.epidermidis
ttaatatattacatcgatgttcacaatttgtcaacaattacatgcaatttaattatttatcatactaatattaaatctaaagaaatgatggtaatctatatatactataaaataaaaaatatcgatttatataaaaacaaaggatga

SEQ ID NO: 915 - DNA, 183 bp, S.epidermidis
tggctgaatttaaaatgtgccgaagtaaatctttatattataaattctttaaaaaggtatacgacggtagatattttaatcaattactatttttttgatgttttgacgttatatttattgataaatatttggaattcactgtatttaattgttagtttatacatagaggtgggtatggcctag

SEQ ID NO: 916 - DNA, 147 bp, S.epidermidis
aatatacattatactatatttttagtttacgtttattttcgaaaagataaaaagttcttaacttattttaaaacaacttataaaatacttcttaaatcacattataaaatttctggcttcaaaatgcatcaatatttttataattaa

SEQ ID NO: 917 - DNA, 1296 bp, S.epidermidis
agttgtaattacattgataaagttaaagttttacaatttatgaaaggcggtatcatgatgagcgtattatctaatgaagaaagagttgaaattttatccgatatagtctcaataaaaactgtaaatagtaatgaattagaggttgcacagtattttgaaagactatttagtcagtatggaattcgttcatatatagatattgttgcagacgggcgagcgaatttaatagcaacggttggttccagtcatccagttattgggatatctggacatatggatgttgtatctgaaggaaatcatgatgattggacgtatgatccttttacactaacagaggaccaaggctatttatacggtaggggagctgcggatatgaagtctggattagcagctttagccattgctcttattgaaattaaagaaagtggtaagttaacacagggaactattaaattcatggcaacagtgggtgaagaaatggaacaatcaggttcgcaacagttgtttgaaaaaggatatgctgatgatttagatgccttactcatagcagaaccatcatttcctagtttggtgtatgcacataaaggttcaatggactttagaataaaatctaaaggacgtgcttcacatagttcaataccatttttaggacaaaatgctattaaaccattattagagtttattcaaaatataaatcaagaatatgaaaaaataatgcaaacagtaaaaggtgagtccttagatttttcaaatatgattaataaattagagaatcaattacctaaccatataacaaaagaaaaagcacaagagcttatacaggggcttgttatgacaaatagtatcgttcaaggtggtacacaagtaaattcagtaccagattttgctacagctgaatttaatgtacgcacaataccagaatataataataacaaagtaaaagcgttatttaataaatatgtagagcaagcaaatcacaatggtgctagtttgactcaagaactttatcttgatttagaacctgtagtaacaacaggtcaaaatcgcttggtagagctaggatttgatattgcaaaaagccatttttctaacgaaagagatttaatcattactcctactgtagcagttactgatgcttcaaacttattaaaaggaaaagatgaaaattttccatttttaatgtttggcccaggaaatggacctcatcaaattaatgaatgcgttgaaaaagtaaattatttagaatttgttgaatattatatagagtttatcacttcatatttaaatgaaaagtaa

SEQ ID NO: 918 - DNA, 873 bp, S.epidermidis
aaagtgaatttattaaaatttcacaacaaaatcaaaggatatactcaaaatagacaaccaggtattgaagcggatatggaacctaaacccattgcagaattagaagaatataaagcagcaggaaagttagagaataaagttgctctaataacaggaggagattcaggtattggacgtgcgatagcaatactatatgctaaagaaggggcaaatgttgctattggttattatgacgaacatcaagatgccgaagacacagttaatcgacttcaagaaatgggtgtaaaagctaaagcttatgctcatgacttaaaagatgaaaagcaatctcaaaagttaatcaaagatgtcataaatgacttcggtagtttaaatatattagtaaataatgggggcgtgcaatttccacgcgatcattttgaagatatcactccacaacaagtgaaagaaacttttatgacgaatatttttggtatgatgtttttatcccaggcagcagtaccttacctatctgaaggagatacaattataaacactacaagtgtcacagcatataaaggatcggggcatctcattgattattcagctacaaaaggtgccatagtatcgtttacccgttctcttgctactactttaatggaaaagggaattcgcgttaacgccgttgcgcccggcccaatctattcacctttaattcctgcgacatttgatgaagaaaaagtagaacatcaaggtgacgaaacgccgatgggtcgtcgtggacaaccagcagaacttgcaccatcttatgtcttcttagcaacacatgcagatagttcctatattactggtcaagttattcatgtcaatggtggcgattttatcacatcttaa

SEQ ID NO: 919 - DNA, 123 bp, S.epidermidis
tcatttcgttatacacgttttgttgagaaatgtggtagctatggtcaaaatcaatcagacattggattccttcatcatataaagtttcagcctttgcaattgcacgttctttatctcccttaa

SEQ ID NO: 920 - DNA, 156 bp, S.epidermidis
gacatacgttattttacttcagtattaaatgaaatatttttagtttataattcaataatcctcactatgagcaacctcaaatcaacaatcacatgttcttttttatatttatgtgaaatttcacaacatttttctggaagatatatttactgttga

SEQ ID NO: 921 - DNA, 198 bp, S.epidermidis
cagcaattctatggttcttcgttaaaccagacaaacctcttattgttagtgaagaacacgttaataaataatatttttcaaacacatgcaatgacattcatatcattgcgtgtgtttattcttttattatgtggtatagaacatggaagcgataagcgaattgttttttttatcagttataaactgctaaacttataa

SEQ ID NO: 922 - DNA, 123 bp, S.epidermidis
gacatctactataaatggcttaatcttttgctagtagtagactatcacttcgatattgattcagttttaaaaactttaaatcaatgttatgttaacgtaaatttatgtaaattcataccataa

SEQ ID NO: 923 - DNA, 156 bp, S.epidermidis
caaaagtgctatggcaataaagatattgcagaaaagttgtttgtatcggtgaaaacggtagaggcacataaaacgcatattatgacgaaactaaatttaaagagtaaacctgaattagttgaatatgccttaaagaaaaaattattagaattttaa

SEQ ID NO: 924 - DNA, 2088 bp, S.epidermidis
agaaacctttttaatcatgcatatctagttaaaaaattaaatagcaagattaagattgttggtgaaatacatggtccattggaatatattaatgagaatatagatttagcattagactgtattgattgtgttcgagtgagtacagctagaattaaaaatgaatttatagctaaatatgactatcatcgggtttttaatcaatacgtaaatgcacaacatatcgatttaaaatcagagccgataaatactaaacgaaattttttaattaaagcacgttttgaggatgaagttaaagatatttcatatattattaaattgtttaattacatcattaaaaaccaaattgttgatgatgctcaactttatttaataggatatggtccttcagaaatgctttacaaaaatttgataaattactatcatcttaatgagtatatccatattaatgaaaaagaaccacagagttatatttatgtatctagttcgccatatgaaacgctcggctattctatattagaaacgattgcacagggtaataaagctctagtttactatggtgatgataacgtgttaaaggatatctatgcaccatatgaagcgatacgttttttaaccaaagatatgattaaagatagtaaaataattaaagactttctaaattataaatatagtcactttgatcgacaaaaatattatcgacagttggaaagtacgtttaaatgcattaattatggacaggaatttttaaataatgttgaaactttctcttcatctcaacatgtaaaagtgaagaaaattcatcgacatctcggtagtgaaaaacaaatagatatagcaagtcgtttaaaagagagtcgttggatgaatttaattagaaaaaataaatatttatttaataaatgtaaaacgtactatgaaaaaagaacgcatatgagctatatcaaaaatttaaatcaaatacctgtagacgacgattcaatatttatagagtctttccatggcaagaattttagtggagatcctaaatatattgctcttgctattaagagacagtatgatcataaaaaaatatatgtgagttcaaccaattcacttgttgatatggaaatcaaacgttacggttttacacctgttcgatttggaagcgagaaatatattaaaacgtttagaaagtgtaagtatgtttttatcaatggtaactcgtgggataaagtgtacaagtcttcagatcagatatttgttcaaacatggcacggttttccattaaagaaaatggttaatgatttaaatgaacaacatgaaagacaacaacaactagaggcattcataccacgcatgaaaaaatgggattacattttgacatcatcagatattaatacgacgttgttggaatctgcttttatgctaaataaaaatccaaatcttaaagttctagaatacggcgcacctaagaatgaatatttaataaataataataatttacaagagcgccagcagttacagcttaaatatatgtataagatagatgatgataaaaaatatatattatattgtcccacttggaggggaaatcaaagaaaagaagtcactcagattaatttaaaagatttacttaaatatttaccagagaattatgagattattgtgaaacttcatcctaatgaaagtcatttaagaaccagatataatcaaatagataatcgaattcactgttatttcaatgaacttgttgatattcaagaactgtatattctgagtgaatgtatgattacagattactcgtcgaccatttttgactatatacatttaaacaagccagtctttattcttcaagaagacgagcaacaatataaacaaagtgttggtttttattttgatttgtttgaagtgggtgattttcttaaagcctctttaaatgaacacatgttagctaaacaaatttgtagcactgattatataaattattcaaaagtggttcatcgtttgatgaaacaagatagttcgaaaagcagtgaaaagttaatggccgaaattcttggggaaccagaatatccaagttcatcaaactgcaaacaacagatttcttaa

SEQ ID NO: 925 - DNA, 141 bp, S.epidermidis
gtcaagttatattctttatacataaggcacctcgttaatttagtttattggtatttattaaattatacgaaagggcttatttttttaagtattttggcgagactcttgagggaacaggacaagctgaagactacaggctga

SEQ ID NO: 926 - DNA, 1881 bp, S.epidermidis
tatacactatatatagcgaagggtgacgaaatgactactctagaaacatcattaactcgattaatcacaaaagatccaactatattaaatgaaaatgcaaataaagatagtaatacattctcaacaatgcgagatttaacagctggaacggtatcaaagtcttatgcactcgatcatttacttccaaagcatgttgctcatgcacatcaatcgggagatattcattttcacgacttagattaccatccatttcaaccattaaccaattgttgtctcatagatgcaaaagatatgttagagaatggctttgagataggcaatgctaatgttacaacacttcaatcaatacaaaccgcttcagcacaacttgtacaaatcattgcaaacgtttcaagcagtcaatatggaggttgtactgtcgatcgtgttgacgaattactaagtaaatatgcacaaatgaacgcacaacatcacagggaagtagcgaatgatttcgttcaacctgacaaaattgagaattatgtggatacacaagtaactaaggatattggtgatgcaattgaaagtttagagtatgagattaacacactctatacttccaatggacaaacgccattcgttactttgggatttggtttaggaacagatcaattaagtcgaaaaattcaacaagcaattttacatacccgtattaaaggtctcggtaaagatagggtcactgcaattttccctaaacttgtattttcaataaaaaaggggattaactttggtccagaagatcctaactatgatattaaacaacttgcattggaatgttcaacaaagcgcatgtatcccgatattttaaattacgataaacttgtggaactgcttggtgattttaaagcaccgatgggatgtcgttcatttttaccaagttggaagaatgatgaaggtcaattggaaaataatggacgatgtaacttaggtgtagtgacgttgaacgtaccgagaattgcaatcgaagcagatggcaacatgcagcagttttgggatatctttgaaaaacgcatgcaattattacatgatgcacttgtgtatcggattgaaagactacaagatgctattccagataacgcgcctattttatataaaagtggtgcatttaaaaataaactcacttcagaagatactgtcgattcattatttacaaaacaacgcgcaacgatttcaatggggtatatcggtttatacgaagcggcaacattattttatggaccgaattgggaacacaatcctgaagctaaaacattcacactagacatattaagagaaatgaaacgttatcaagtagagtggacgaaacaatatgatatttggttcagtatatacagtacacctagtgaatcactaacagatagattttgccgattggacaaagaaaaatttggatctattccagatgttactgataaaggatattaccaaaattcattccactatgatgtgcgtaaagatgtaacgccgtttgaaaaattagattttgaaaaagactatccttactatgcaagtggtggattcattcattattgtgaatatccaaagttaaatcataatctgaaagctttagaagcagtatgggattatgcttatgataaggtaggttatttaggtacgaatattcctattgatcactgttatcgttgtggctatgatggagattttgaaactactgctaacggatatagatgcccacattgtggtaacactgatcctaaaacggttgacgttgtaaaaagaacatgtggttatttaggaaatccagttcaaagacctgttattgaaggtcgacaaaaagagatatgtgcaagagtgaaacacatgaaggcacttcgttcatga

SEQ ID NO: 927 - DNA, 1683 bp, S.epidermidis
tataatgtatattttaattttaataaagaggaatttgtaaatatgaaaaataattggatagatgtattagatgaaagtttagtcaaagatttttataataatcaaacttccgaagagcaacaagaaggacttaatactacactgtcttttggcacggctggtattagagggaaattcggtttaggtgaaggacgattaaataagttcacagtatctaaagtagcgttaggctttgcccattatttaacatcaagtatcgcgcatcctgttgtcgtcatacattatgacacaagacacttatcacctgaatttgctcaaattatcgctaatattctagcaagtcttgatattaaagtttatcttgctgatacatacagaacaacacctgatttgtcatttgcagtcagatacttacaggctgatgcgggtgttatgattacagctagtcataatcctaaagattacaatggaattaaagtttatggagaagatggtgctcaattatcaaccgacgattccgcacgactaagcacatatatcgataagttaggtcatccgcttcatattaatttacctagtttaactactgaacaacaatcattaattcattcagtcccgagcgaagtcagagaagattatttcaaaaacgtacaagacttagttggaacgattccacagtctgatttaaaagttgtctttacaagcttgcatggtacgagtgtgccagttgtacctgacatcttatcttctcttaactttaatcaatttgagttagtcgcatcacaatgtgaacctgattcagatttcagctctgtagccagtgcaaatccagaggatcataaagcctttgatcaatcgatagaactcgctaatcacattgatgctgatttacttattggcacagatcccgatgcagaccgtttaggaatagttgaacgtgatgctgaaggtaacatccactattacaacggaaatcagattggtgcacttttgttaaattatcgtatcaaacaaacagaaggattatctaacagaattatgttccaatcaattgtaagtggtggcttagctaaatctcttgctcaatatcataatgtcaatttcaaagaagttttgacaggttttaaatatatcgcagctgaaataagacatctgtctcctgaacaaaactttatttttggctacgaggaaagttatggcttcttagcccgtcctttcgtgagagataaagatgcgattcaaattgtgccattaatgattaagtatgcagctgaattaaaaaacaaaggacgcatgcttaaagatgaattagaagacattactcgaaatgtcggtaactttaatgacaagcttttctcacatacatttgaaggtactcaaggcaaggcaaaaatcgaaaatattatgactcaattcagaagtgaaacaccttcggaaatgtgtggtcttaaagtcattgcaatcgaagattttgaaacaggtaaaaagactgacttacaaaatgatgaagtcagcgatataactttacctaaagcgaatgtaataaagatatactttaatgaaggatttattgctttgcgtccttctggtacagagcctaaaattaaactttatgtatcactttcttgtgaccattttgacgtagttgcacaaaaaatgaacgatgctatatttaactcttaa

SEQ ID NO: 928 - DNA, 126 bp, S.epidermidis
acaaccccatatttgaaatgcatttactttataaattctaatcaccataaacatataacaaagcctagaacacaaattcatgtcctaggctttgttaaccatatagataatttatacttgaattga

SEQ ID NO: 929 - DNA, 1152 bp, S.epidermidis
atgtcaccatataaagttatcattgcacctgattcttttaaagaaagtatgtcggcaaaggaagctgctttagctattaaagatggattccaagaggtgttcgattccagtactatatatgacattattcctatggctgatggtggcgagggaacaaccgaagtattgaaagaagccttaaatgctacctcttattgcgtagaagtaaaagatccacttaatagaaatatcatggctagttatgcgagaagcgacgaacaccaaacagctatcattgaaatggcagctgcttcaggactagcattattgagtaaagatgaaagagatccatctattacaacttcgtacggtaccggccaactcattaatgatgcacttaatcacgatgttaataaaattattttaggaataggtggaagtgccacgaatgatggtggtgtaggaatgttaaaggctttaggtgtctcttttaaagataaaaacaatcaagagattcgcgatggaggtttagccctatctcaaatagaatacattgatattactcgtataaacccacgattgaaagatgtgaatattaaagtagcctgtgatgtaactaatccattattaggagacaatggagcaacaatagtttatggtccacaaaaaggcgctcaacaaaagatgataccaaagttggattccgcattacgtcactatcatgataaaattgaaagagaattaaatatgaatgtaaaagatatcccgggcgctggtgctgcaggaggcatgggaacagcgttaattgcgtttctaaacgctgaattacgtcctggaattgatgtagttcttgaagagactcaatttaaacaaagaataaaagatgcgaatttagttgttactggcgaaggtaaaatggataaacaaacaatctatggcaaaacacccattggcgtagctaaagttgcaaaatcatatgatatacccgtcattgctatttgtggtagtttaggaaaagattacgaagtaatttatcaccacggtatcgatagcgtgtttagtatcatggaacgtccatgccaccttgacgaagctttgaaagaaggcgcacttcatgttaaacatacaacaacaaatttcgcacgacttttacaattaaaaattgaaaactga

SEQ ID NO: 930 - DNA, 801 bp, S.epidermidis
tattggacatatcattttaaagagaaaggaaagatggtaatcatggatgacttgaaacaaaatcaatcttctaacgaaaaacctaaaggtaataaaataattaatattttgatattcatcggaatgattttattaattcaaatacctattggcgtgtcactaatagctttacctttttcagtgaaattcagtaagttaacatccatcgcattaagtatgctaataactggtacagcactattaatcatatggttagttaggaattattatttgagtcatacatatgaaagacaatatcaatcaatgaggggaaaagatatctttattaatattggttttctggtattatcaatggtttttagtattctaagtagtgtattaatggtcatatttactggcaacgatactacagcgaatgagaaagaaatcaatgaaagtttagatttacttttacaaaaagaccatttaccacatatttcaattgttgcaactgttgttttaatgatatgtattataggtccgtatttagaggaattactcttccgaggaatttttaaagaaacattatttatgaaatatcgattttggctaccattcattatatcttctattatttttagttcacaacatttatcaacaaatatattttcatatgcaatttattttctaatgggttgtgtattataccttgcctataacagaagacgtaatatcaaagatagtatgatggttcacatgttgaataattctgtttcaacattaccggtatttgttggttatttatggatatattttagatag

SEQ ID NO: 931 - DNA, 129 bp, S.epidermidis
cattttcaatatttaaacaatataactgaaaactttatgacatttcatcaaagtgtaatgatttactcaaattttttcacgtttctttggttaggtatacgatcgaggtttatatcacttttgatttag

SEQ ID NO: 932 - DNA, 1011 bp, S.epidermidis
tttcaaaaatatacatattacaccaatattgatatgaaggggacagtaagtagaatgaaaaatcttaagtttttagtggtgcttgttttatcggtggttatttttgcagcagcctgtgggaattcaagttctttggataataataaaagttcggatagtggatcagattcaaaatcgggtagttatacacctaaagaattaacagtacaatttgtaccttctcaaaacgctgatacactcgaagctaaggcaaaaccgttagaaaaattgttgtcagataaattagggattccggttaaagtatcagtttcaacaaactacaacacgatagttgaagcgatgaaatctaagaaagtggatgttggtttcttgccaccaactgcatatacattagcacacgatcaaaaggcagcggatttattattaaaggcagaacgttacgacgttaatgaagatgggtctccaagtaaaaagttagttgatgattataaatcagaaatccttgttaaaaaggactctggtattaataatctcaaagatttaaaaggtaaaaaaattgcattacaagatgtaacttctacagcaggatatacattccctctagtaacattaaaaaaagaagctggtattgatgcaacaaaagatatgaaaatagtcaatgttaaaggacacgatcaagcagttatttcattgttaaatggagatgtggatgcagcagctgtatttaatgatgcacgtacagttgtaaaaaaagatcaaccaaatgtatttaaagatactaaaatattaaaactcactaaacctattcctaatgatacgatttcagtacgtcctgatatggataaaaaattccaagataaattgaaaaaagcttttaaagaaatttctaaaactaaaaaaggtcataaaatcattagcgaggtatattctcatgaaggttatgttgatactaaagattcagactttgatatcgttagacaatatgaaaaagctgttcatgatatgaaataa

SEQ ID NO: 933 - DNA, 1335 bp, S.epidermidis
aatatgaaatattgcagtaattgtggtcaacctcttcgagaaggtgtaaaggtgtgtacaaattgtggtacgcctgtgagaaatgatggacctaattataaacattcagaacaacgttattctcatcaacaaccacgttccaataagagtaataaaaaaacttggttgattgttactatagtgttagccattatcattgctttggtagtaatctttactatagctaaaaatcaaatgtctccagaaaaacaagcgactcacattgcacatgctatcaaaaaagacgatgctaaatcattatctaagcaattaacatcaaacgatcatcgtttaaatgaagaagaagcacgtgcgtacttaaagtatattaaagcagaaagtgatttaaagcatgttgctgacaaagttgaagaaaacaccaaagatattaaaaataatcactataacaatttatctgtagatgcaaatgataataatattttaaatatatctaaagacgggaaaaaatatgttttttttgataactatcaatttaatgttcctcaaaaaacaattacgatcgtttcaagtgatagtggtgaaattacttatgaatttaacggggataaacatcatatttctgtagaagaagatgacgataaagaattaggaacatttcctatcggtgattataatttaaaagcatcaaaagacatggaaggtaaaaattttaaaggcgctattacaattgatatgagtgaaagtgatagtattgcatatgaatcgtttaaacaaaaacgttttaatgttgatactgaaggcggatatatattagataatgtaaaaatatatgctaatggtaaagaaataggcgatggtttttcatcagaaacatatggtccttatgatccagatgaagaagttatcgttcacgctgaaggttcatacgaaggaaaaacttttaaatcaaattcggtcaatgtagcaagtgcaagcgaaaaagatggtggtgtgacagatgtcacagtcaaattcgatgaagaagctattgatcagtatgtcgataaaaaattagatgaaaaatacgatgattcagatgacgagtcagataacgattcaagtagtggcgaagtaacgcgtgaaaatgtaattgataaagtagagtcatatgaaggacatacactagatactgatacgtatacgtataaagaacctgaaaaaaccggtgatggtaaatggggtttttcattcttagataaagatggagatttagctggatcgtacacggtagacattgacgacggttatgttacagaatatgacgaagatggtgaagaagttggatctggttattaa

SEQ ID NO: 934 - DNA, 1545 bp, S.epidermidis
aatatgaaatatatgattggtgtagatatggggacaacgagtacgaaggctgtgctatatgatgaaaatggcaagtttataatgaaacataatattggctatgacttacatacaccaaacgtagatgtgtctgaagaaaatccggatgaaatatttgatgctgtgcttatgacggttaaatatattgtaagagaatctggcatcgcaaaagaagatattaagtttatttccttgagtgcacaaatgcatagtttgattgctatgaacgaggataatcaacgtttaactgaaaatatcacttgggctgacaatcgtgcgaatgattatgctgatttaatagaaaaatcatatggcggttttgaattgtatcaacgaactggtacaccgattcatcctatgtcaccattatctaaaatcttttggatgagacatgaggaaccgaaaatatttaaacaaacagctatgtttgcagatttaaaaacatacgtactgtttcaattatatgaaaggttcgtcattgattattctttaggatcagctacaggtatgatgaacttagaacaattagattgggataataaggctttagaattgttaggtattgaaagaaatcagttaccacaacttgttccaactacacatgttttaactggaatgaaaaaacgctacgcaacgttgatggggattgatgagcaaacgcctgtgattgtcggagcgagcgatggcgtattatctaacttaggtgtaaatagctatcaaaaaggtgaagttgctgtaactattggcacatcgggtgcaattcgcacggtaattaatcagccaaaaacagacgagaaagggcgtattttctgttatattctcgacaaagatcaatatgtgattggcggtccagtcaataatggtggtgtcgtcttgagatggttgcgagatgaaattttagcgagtgaagttgaaacggctaaaaggttgggggtcgatccttatgatgtgttaactcagattgcaagcagagtaaaaccaggtgcagaaggattgatttttcatccctatttagctggagagcgcgcaccattgtggaatgctgacgcaagggggtcattcttcggattgacattatctcacaagaaagagcatatgattcgtgcggccttggaaggtgtactgtataacttatatacggtttatcttgctttaattgaagtgatgaatgaaacaccaacaacgattaaagcaacgggtggttttgctaaaagtgaaatttggcgacaaatgatggcagatatttttgatacagacttaatcgtacctgaaagctacgaaagttcatgtctaggtgcatgtgtacttggaatgaaagctctgggagaaatagatgatttttcagtcattaaagatatggttggtactacacatgcccatgaacctaaccaagaaacagttgccatctaccaacaacttgttaccatttttattaacattagtcgttctatgactgagaactacagtgatattgcgaatttccaacgagaacatttaagtgattaa

SEQ ID NO: 935 - DNA, 141 bp, S.epidermidis
ggttttgaatatatagttatctatacatatttttatttattaattttaaaaaatgaattttcattaattatctatcaattaaagaaaagatatgaaatatactttgtattgaatttttcgctgccttatcaaaggatatga

SEQ ID NO: 936 - DNA, 639 bp, S.epidermidis
agaagagaatatgtattaatcgttttaggaaaaggagaaacgatgaaaaaattaatcggattattgatgattttatgtatggttttgctatacagttgctcaggtccaatggactctccaaagcattctaataatagcaaacctgtagtggtaatatacggtgattataagtgtccttattgtaaaaaaacagaagatcgcgtgatgccaaagcttaagaagaagtatattgatacaaacaaaattaaatatcaatatgtgaatttggcattcttaggaaaagattcaattgtaggttcaagagcgcagcatgcggtaaatcattatgctcccaagaagtcacttgaatttcagaaattaatgtttaatcaacaaaaagatgaacataagcaatggattacaacacgtcttgttgataagcaaattgataaattaagtatcagtgatgacaaaaagaaaaaaataaagactgattataaaactaaaggttccatctcgtggaaaaaagccaaggaagatcaacaaattgcgaagaaaaatcacatcaagcaaacacctacagcgtttgttaatgataacaaggttgaagatccatatgacttttctagctacgagatgttgctagaaaacgaaaagtga

SEQ ID NO: 937 - DNA, 1557 bp, S.epidermidis
ggacggagatatggtcattcatttcccataaacaaagaggtgttagacatgacgatttataatatcaattttggaatcggttgggccagtagtggtgttgaatatgcacaagtgtatcgagcaaaactattaaggcaattaccttatccaacaaaatttatatttttagattttattcaatcagaaaatattcaaacactcacaagcaacatagggtttaaagatgatgaagttatttggctatatcaatacttcacagacgtaaaaatcgctcctacaacgtacacagttgatgatttaatttcagagttaggtaatgaggttactcgaaaagaacaaaacggtaaagtattacgactctatttaaataatcagcaaacattcgtaacctgctatttaaaaaatgctaacgaacattacgttgatcgtgcagagtttgtggtgaatggaatgttaattaggaaagatttttatagctatgtaagaacattctcggagtattatgctccttttgacaataaagctaaaatatatatgcgtcaattttataatgaaaatggatcaattgcatatcgcgaatatatagatgaagatgaacatgtttttgtgtttgatgatgcacgtttatacagtaaacaagcactcgtcgcatactttatacgtcaattgcgattgaattcagaggatatcattattattgatcgagcaactgatgtgggacaagccatattagaaaacaagggatccagtaaagttggcgtagtcgttcacgctgaacatttcagtgaaggtgcgactgatgggactcacattttatggaataattattatgagtatcaattcgaaaatgcacagcatattgatttctttatcacagcgacagatttgcaaaggcagacactaagtgaacaatttaaacaatataagaatgattgtccacgtatacgtacaattccagtaggtagtatagaatcgttacaatatcctgaaaaagaaagaaaaccatattccatcatgaccgcatcacgtcttgctaacgaaaaacatgttgattggatagtggaagctgtgattaaagctaaacatcagttacctcaattgagttttgatatctacggacaaggagaagaacaagaaaaaattaaaaatattattaccaaacatcgtgctgaggattacatacaaattaaaggacatagaaatcttcgtacaatatatcagcaatatgaattattcatagcggcctcacaaagtgaagggttcggactgacattaatggaagcggttggctctggtttaggtatgattggatttgatgtgaattatggcagtccgacatttattcgacatcatcaaaatggctatttgataccgatagattttgaacaagcgtctactgatgatatcacaacgcaaatcgctcatatgattattcgatattttgaagatggtcccataagggcacatgaggtatcgtatgacattgcagaatcatttaaaacatcgcatattgttgatctatggagacaactcattgaagaggtgctatatgattaa

SEQ ID NO: 938 - DNA, 1539 bp, S.epidermidis
aaactaactctcagtcaaagtttgtcttctatacttgatttatcatacatattgggaggcaatttatttatgaaatttatgaacaaaatgggtaagacgacgcttgcttcatcaatcgtagcagcatccgttttaagtacggtaaacgtatcatatgcttcaggtagctcagaacaaagtgctcaaactaagcaaacacaaaacgatgccattgctttcggcaacacaaaaaatccaaaaaatgtcatctttatggttggcgatggtatgggaccttcttttaacactgcatatcgctattataaaaataagcctggtgctaagaaaatgactccaactgcatttgataaatatctaaaaggaacaaatcgtacttattctaatgatcctaaagaaaatgttacagactctgctgctggaggaacagcttttagtaccggtcacaaaacatataacggtgcgattagtgttgatacaaataaaaaaccaattaaatctgtgctagaacaagctaaagaacaaggaaaatcaactggtttagtaactactgctgaacttactgatgcaacacctgctgtatatgctgctcatatagattcacgcgacaaaaaagatgaaattgcacagcaattttataatgataaaataaatggcaaacataaagtcgatgtgatgttaggtggcggtgcaaaatacttcggtaaagaaaataaaaatttagcgaaaaaattcaaaaaagatggttatgatatcgtttctaataaagatgaattaaatcaatcacaaagcaagcaagttttaggtactttctcagaaaaagatatgccattacaaatagatgcacctcaatctaatccgttgctagtagacatgcaaaacagtgcactaaataaattaagtaaaaataataaaggattctttttaatggttgagggtgcttcaattgataaagctgcacaccctaatgatatcactggtgtgatgtctgaaatgtctggtttcgaaacagcttttgataatgctattaattatgcaaagacacataaagatacacttgttgtagcaactgcagaccactcaactggtggtctatcaaccgcaaaaggtaaagattataaatggaatccagaggctattcacaagatgaaacattctggaatgtatatgacaaaacaaatcgctgatggaaaagatcctgaaaaagtaattaaagatggatacggcattgatttcccaaataaacaactcgataaagtcaaaaaagcagcagacgagcttcacaaattacaaaaagaaggtaaagatgacaaagacgaaaaagttgtagaacaaacaacaaaattacaaaatgcaattcaaaaaccaattaacgatgcttcacacacaggttggacaaccaatggccatacaggtgtagatgttaacacatatgcatatgggccaggttctaacaaattcaaagggaatatggaaaatacccaaagcgctaaaaacttatttgactttttcggagacaatgtaacatcaaatcaaaattag

SEQ ID NO: 939 - DNA, 684 bp, S.epidermidis
aacgtgacgtatggttatccgaaaaagtggaaggaaaacatgacttcaggacaagtaatagctgctgagttacgtttaggaatagtgagtggtgaaattgaatcccatatacaactaagtgaaaatcaagttgcacaacaatttaatgtgagtcgttcaccagtcagagatgcatttaagttacttcaaacagatcaactgattcaattagaacgtatgggcgcacaggtacttccttttggtgatcaagagaaaaaggaaatgtatgatttgcgtttgatgctcgaatcattcgccttttcaaaattaagtggaacagatacacaacatattgttaaggaaatgaaaaagcaattagaaatgatgaaggttgcagtccaattcgaggatgctgaagcatttacacaacatgattttgagtttcatgaggtgatgattcaagcaacaaaccatcagtatcttaaagtgttttggaatcaccttaagcctgttatggaatcactcatactcatttcaatgagacaaagaatgacaaatgaccccaaagatttcgagagaattcatagtaatcatcaagtttttatagatgctgttgagaacgatgatgcctccatattgagaaaagcattccatttaaattttgatgatgtaggagaaaatattgaagcattctggttacgttaa

SEQ ID NO: 940 - DNA, 156 bp, S.epidermidis
ttggataagtacatgacaactaaatccaactttagattatccttagcctctttagatatgattcaagtgattaattatttaataattagggtgaaaaaatgtttaagaaattcgaatataaaatcttatataaaagaatattttttacatgcttaa

SEQ ID NO: 941 - DNA, 222 bp, S.epidermidis
tataaagatttacttcggcacattttaaattcagccattaacttccaatatacaaaacacctgagacaaatatcgatgtctcaggctcagttatttaagtataaacacctacttgaaaagcacacttcaatttatgtactagtcattttaatatttaaattgtggagtgagaactattggtgtaccttaatgaaatttacgtgcatatgtacaatacattaa

SEQ ID NO: 942 - DNA, 126 bp, S.epidermidis
ttttttcatcttaataacactcctttcaaagatgcggttcttgaacaaacaaaatgttcaatagttagttactattatacacgttttatagttgtttttaaaaacttgaatttcaaattatcgtaa

SEQ ID NO: 943 - DNA, 1197 bp, S.epidermidis
aaggggcatctagttgttatgactgtcgcacgcacaacaacatttatattaagtgttttcatcgtaggtatggttgagatgatggttgcaggtattatgaatttaatgagtcaagatcttcatgtttctgaagcggtggttgggcaactggtaacgttgtacgcgcttacctttgcgatatgtggtccgttattagtgaagttgactcatcggttttcttcgcgatcagtattattatggacgttaattgtctttatcttcgggaatggtatgattgccattgcgccacattttggaataatagttgtaggacgtattttatcttctgccgcagcttcactcattattgtgaaagttttagcactcacagcgatgctcacatcagcaaaaaacagaggtaaaatgattggtattgtttatacaggttttagtggagcgaatgtctttggtgttcccatcggtacagtgattggcgactgggtaggatggcgatttacatttttattcattattattgtaagtgtatttgttggtgttttaatgttaatatatctaccaaaagaagatgaattgtcacatccaaatcaaacacctcgttcatctagtattgaatcacaaactggctcaagcgtcataagacctcgtgaggtttttaaatatctgatgattacatttttagtgctggttgctaattctgtaacattcgtgtttattaatccattaattttatccaatggacatgaaatgtcttttgtgtctttagcactacttgttaatggtgtagcaggtgtgattggtacttcattaggcggtgttttatctgataagtttactagtaagcgttggttaataatttcgatttcaatatttataataatgatgataattcttaacttattattaccaggaacaggattattattagttggcttatttatgtggaatttaatgcagtggagtacaaatccagctattcaaagcggtattattgaacacgtcgaaggagatacaagccaagtgatgagttggaatatgtcgagtctcaatgccggtattggcgttggcggaatcgtaggtggactcgttatgacacatttatcagtggaatatgttacttatactagtgcattgataggtttaattagtcttatcattgtattcactttaaaaaatagacattatgctaaaaatttatga

SEQ ID NO: 944 - DNA, 129 bp, S.epidermidis
ctcaaggatttttacatatgggtagtcgatagtggattgaaatacgattttatcaagtttgtttcaatatttatgttattggtaagaggggataatgtgttcaaaatgttttacgaaactgtagtttag

SEQ ID NO: 945 - DNA, 123 bp, S.epidermidis
gtaaaaaatctcttaatggtttttatcggtgctctatcaatctttattttgaaattgaatgagagcgaagctgggacaaaaaggttcaagataagtaaaaaaagacaatttctattgaaataa

SEQ ID NO: 946 - DNA, 129 bp, S.epidermidis
atgttgtttcacgggaaacgtcattttttaagtttcaacttctataaagatatatttaacacccgtataactagagaattatacgggtgtttgaattgcttatattatagaattttaaaaagatattaa

SEQ ID NO: 947 - DNA, 198 bp, S.epidermidis
acgtttattcatatcgttaatattgatgaaaatattaacgatatgaataaacgttcttctatcaattgcaataattatttcctttccaaactaaaaagtcgttgtaaagtggctataagtcatctccctcattcacgcacattacaacgacatgttatatataaattaaaacatttcagaaacaactttttgttctaa

SEQ ID NO: 948 - DNA, 411 bp, S.epidermidis
aatcatattcattatcaagaagccccaaatcttacaaaggttgaatatggtgaccattatgaacgcagatttatgaagcctaagaaattgaaggccaacatcgaatatacaacaccgcatggacacgtgtatcgaacggatcacaaaggccgtattaaagaagtatatgcggatgacctatcacttctagatggcggacgtaattcatatgcgcaacgaacagtaggaagagaataccgattaccagatgatgacggcggtcatttaattgcgcgcggattcggaggttctaaagatatagataatctcgtcccccaaagtaaatacatcaaccgctcatttaaagagaacggagaatggtataacatgaagaaagaatggcaaaaagcaattaaaaagggagagaagtaa

SEQ ID NO: 949 - DNA, 171 bp, S.epidermidis
attaaaattcataatcattatatagctgttggatttggtattgaagcaatatcaaatatagtgaaaacatattcatatattgaaattgttttcaacataaaaaataattacctttgtcattcacactatcgcttaatatataagataaatctcttattttcatttatataa

SEQ ID NO: 950 - DNA, 237 bp, S.epidermidis
ctttattctcattttataaaaatttatattaaatgtcattatagctacacgactacacttttattcatatatgaaaaccaccacatcttatatcggtcaaatgacggatttataggctatcttattgaaagcaattctcattttgatacaatattaaaatgtctaatttttaaacttcaatcactatcatttttttatataaattcaaatacttttaaattaactaaaattgactaa

SEQ ID NO: 951 - DNA, 123 bp, S.epidermidis
caacatcctcagctatgtaaaattatttttggagatttacaaaactccgaaaaacctgaacatgatcatggccatgctgccgaacatcatttgatgacggaagagctcactgcacacctgtga

SEQ ID NO: 952 - DNA, 2028 bp, S.epidermidis
tgcacgactcataacattagaggagtagttataatgactcaaagctactgtattcttggaaaccctaatgtaggcaaaacatcattatttaatgcgttaaccggttcttacgaatatataggtaactggagtggcgtaaccgttgaaaagaaagtaggaaaattgaaagataatgtaggtgatttagttgatttaccgggcatttatgatttatcacctatttctaaagatgagacggttgtcacagattatttaatgtcaacgtcattcacaggaatgattaacattattgacgcatgtcagcttaaaagaaatcttaatcttacaatacagttgatggaactcaacaaacctatgattattggtttaaatatgatagatgttgcaacacaaagaggtattaaaattaactatcaagctttgatgagaaaattaaaagtaccggtatttccaattgttgctagaaaggcaaaggggacacatagtcttttaggagagcttaattatttagaaccacatcaacgtcgtgcatttaagattaattatggaactgaaattgaaactgcaattcaacaaatttgttcaattatcaaacaggataatatgtatccaacagaacgtttacgttttatagccatacagtatttaatagacaatgttcaaatttatcaagaactcgatgccatgattttagaacagttagaacccattaagcgaaagttaagtaacgcgacagaacaatcaacacgccaaagaattgaagctgtgcgaaatgattacattaatcagctattggaagatatcgtagaatatcccgaagaggataaacaattctttacttcaaaagtggatcgattattattaaatagatatctaggtatacctatatttttaggtattatgtggcttatttttcaaacaacctttacatggataggaacaccattatctgatcaattagacgcttttataagtggtcctttatcagaatggattaaatctgttatgaatacattacatattacgtcgtttcttcaagatcttattacagatggtattatcgctggtgtgggttctgtattggtatttgtaccacaaattgttgtgttattcttttttatttctttattagaagattcaggttatatggcaagaatagctgtattaatggataaaacaatggaatctataggtttaagtggaaaatcatttattcctatgattattggatttggatgcaatgtaccaagtattatggcagcaagaagtatagagaatgagaaagaacgtttgattacaatattggttgcacccttcatgtcatgttcagcacgcttaccggtttatgcactttttgtaggagcgttcttttcagcacatcaatcactagttgtattaagcttatatattttaggtatagttgtcgctttactagtaagtacgttattgaataaattgatattaaaagataatcagtctgtttttattgtggagttaccgacataccgtgttccatcatttaaaacactttggcgcagtacttgggaaaaagcaaaaggttttgtcaaaaaagcaggtacctttatttttggtggttcagtcgttatttggacactcacatacatcggtccgcacggtgttaatgtcccgattaatcaaagttttatgcatatgattggtcaagggttcgcgaatttaattgcacctttaggatttggctcttggcaggcaggagcaactttaatacctggctttcttgctaaagaagtgattatcagttctatggctattttatactcttctagcgaaagtggtttaacacaagtcattcaacagcaattcactccactttcagcttatgcattcatgatttttattttactttacgttccttgtatttcaacagtcgctacgattcgtaaagagacaagttcttggaaatggacattactagcggttgtttatccaatagcaacagcatatatattaacgttcgtattctatcaagttagtcaattatttatataa

SEQ ID NO: 953 - DNA, 1083 bp, S.epidermidis
cttgaacatcacgaaatacattcacttatgctattaaatttgatagcgacttataaaatgaaaggggcgcatcccatgaaaaacatcaagaaaccctttgatttaaaaggtaagtcattgctaaaagagtatgatcttacaggtgaagaatttgaaggtctaatcgattttgctatgacattaaaaaaatataaacaacaaggcacaccacatcgatatttagagggtaagaacattgctttactcttcgaaaagacatctactcggacgcgtgccgcatttacagtcgcatctattgatctaggtgcacaccctgaatttttagggaaaaatgatattcaattaggaaaaaaagaatctgttgaggatactgctaaagttttaggcagaatgtttgatggaattgaatttagaggtttttcacaaaaaactgttgaacaattggccgaattctctggagtaccagtatggaatgggttaactgatgattggcatcctacacaaatgttagctgattatatgacaattaaagaaaattttggatatttaaaaggcatcaacctaacttatgtaggaaacggacgtaataatgttgcacattcgcttatggtggcgggtgcgatgcttggcgtaaatgtacgtatttgtacaccctcatcattaacaccgagagatgtatattttaatattgctaaagatcaagcgtctaattatggaggttcagttaagatgactgataacattcatactgctgtcaaagatgcagatgttatttatactgatgtttgggtatcaatgggtgaagaaagtgaattcgaaacacgtattcatttattgaaagactatcaagttaatagaaaaatgcttaatttaaccggtaaagtagatacgatatttttacattgtttaccagcttttcatgatacacaaacagaatatgggcagaatatttttgagaaatatggcttaactgaaatggaagtgacagacgaaatctttagaagtgagcattctagagtgtttgatcaagctgaaaatcgaatgcatacgattaaagccgtgatggcagcaactttaggctag

SEQ ID NO: 954 - DNA, 135 bp, S.epidermidis
aaaagtaatcagattacacaaataaaaaaagaagagtattatcaaataggcattgatagttttgtcaacgtaatgttggtcaatgaaaaaatggtaaatatgtatatatgtcattcaatcaccgactgtctatga

SEQ ID NO: 955 - DNA, 123 bp, S.epidermidis
aggttaaatcaacctaggacaacaatagataattactttttcctatatcagattaagagatttagaataacatcttatcgctaccaaatgtatctcccaatgcttgttgggctaacacattaa

SEQ ID NO: 956 - DNA, 477 bp, S.epidermidis
gaggttgatcattcaatgaaaaagagtaaacgacaagatttagtaactatgattgttaagcaaaatcacatttataaaaaagcagatattattgattacattgatgatcactttggtgtacgttatagcatgactactattgcgagagatttaagagaacttcatatttatcgcctgcctgtgaaggcaaatcaatatgaatacaaattacttacgcaacaatctcaattagactcaagagtaagactaaatgattatatagaaacagaaattattaacactatgattaaagaatcgtatatactaataaagacgacaccaggatttgcacaaagcataaattattatattgatcagttacaactgaaagagattataggaacgataagtggtaatgatacaattatgattcttacacattcccagtctatagctgaatatgtctattacaaaatatttaatcataattattcataa

SEQ ID NO: 957 - DNA, 297 bp, S.epidermidis
gggatgagtcaatatccattctatagacgcatgtttatcatcataaaaaaatgtacactcatatataattcaataaaggagttgtatcctatgagaaaaatacttaagggtattatattatcattaataatcatcggcttaatcaaaacgttcaatgaatatgatattatacattgtgcaaatcattatttcgaacaaatcaaaagtggaaaaataattgaagatatcaaaatcgatcatttcaataattatcataatattaattttgaagatctaaatccttctgactttttttaa

SEQ ID NO: 958 - DNA, 732 bp, S.epidermidis
aagagaggtcatattgtgattgaagcgaatcaaattttagctaaaatgaaaaatcaaaaaatcaactatgataaagtattaagaaagataatttctcaatgggaacgtgatggagaacgccctaaaatcttacttcatagttgttgtgcaccttgtagtacatatacgttagagtttttaacacaatatgcggatatagcgatttattttgcgaatcctaatatacatcccaaaagtgaatatttaagacgtgctaaagttcaagaacaatttgtaaatgattttaataataaaacaggtgcaaatgtaaagtatattgaagccgaatatgaaccgcataaatttatgaaaatggcaaaagataaaggtttaactgaagagccggaaggtggactaagatgtacggcttgtttcgagatgcgattagaaattgttgcaaaagctgctttagaacatggttacgattattttggtagtgcaatcacactctctccaaagaaaaatgcgcaattaatcaatgaactaggtatggatgtacaaaatatatataatgtaaaatatttaccaagtgattttaaaaagaataaagggtatgaacgttctatcgaaatgtgtaatgattataatatttttagacaatgttattgtggttgtgtatttgcagcgatgaagcaaggtatagattttaaacaaataaataaagatgctcaagcatttttacaacaattttaa

SEQ ID NO: 959 - DNA, 135 bp, S.epidermidis
atattgttacacaacgttttagagatacatatcttaatttttatatttaaacaatcatcgtacaaatctatcacagtaatgttacacactaaaaaacctgagacaacaagttatctcaggcttctatatgagtaa

SEQ ID NO: 960 - DNA, 168 bp, S.epidermidis
atatttatacattttgtcacccatctcgttaatatcatacttttatcatatacaacagacttctctaaatcaaaatctctttattataaaatcattttaaatccaaaaagtatttttgaaaatatttctaattatctgtatactttaaacaaatactttgcaagttaa

SEQ ID NO: 961 - DNA, 138 bp, S.epidermidis
gtgcaaatacacaatctagtaacacaaatgtacaagctgtttcagctccaacttcttcagaaagtcgtagctacagcacatcaactacttcatactcagcaccaagccataactacagctctcacagtagttcagtaa

SEQ ID NO: 962 - DNA, 189 bp, S.epidermidis
tgtaattcacatttaaaattaaaatcggggatttccctaatggcatggatatggttttctaggatgaaattgaggccaaaattaaaatatattattaactattttataatatatgttgcaattgaaattacactttacgctgtcattttaaaccacaaactattttataatgagctgcattcattatag

SEQ ID NO: 963 - DNA, 1983 bp, S.epidermidis
gggagcacacataagatgaagaaaaataaatttttagtatatttactatcgacggcgcttatcacgccaaccttcgctacacaaacagcttttgctgaagattcatctaataaaaatacaaattcagataaaatggaacaacatcaatcacaaaaagaaacatcaaaacaatctgaaaaagatgaatttaacaacgatgattctaaacacgattctgatgataaaaaaagcacttctgacagcaaggacaaagactctaataaaccattatcagctgactcaacacatcgtaactataaaatgaaagatgataatttagttgatcaactttatgataattttaagtctcagtcagtagatttttctaaatactgggaaccgaataaatacgaagacagttttagtttaacgtcactcatccaaaatttatttgattttgattctgatataacagattacgaacagccacaaaagacaagccattcttctaatgacgaaaaagatcaagtagaccaagcagatcaggcaaaacaaccatcacaacatcaagaaccatcacagtcgtctgctaaacaagatcaagaatcatcaaacgatgaaaaagaaaagacaactaaccatcaagccgattctgacgtcagtgatttacttggagaaatggataaagaagatcaagaaggcgaagacgtagatacaaacaaaaatcaatcttcttctgagcaacaacaaactcaagcgaatgatgatagctcagaacataacaagaaatattctagtattacagattcagcattagactctatattagatgaatatagtcaggacgctaagaaaacagaaaaagattacaataagagcaagaatacaagtcacactaaaacatctcaaagtgataatgccgacaaaaatccacaattaccaacagatgatgaattaaaacatcaatcaaaacctgcacaatcatttgaggatgacattaaacgctcaaatacacgttcaacaagtcttttccaacaactacctgaattagacaatggtgacttatcttctgattcatttaatgttgttgacagtcaagacacacgtgatttcattcaatcaattgctaaagatgcgcatcagattggaaaagaccaagatatatatgcatcagttatgattgctcaagctattttagaatctgactctggaaaaagttcacttgcacaatcaccaaatcataacttgtttggaatcaaaggtgactacaaaggacaatctgtaacttttaatactttagaagctgatagcagtaatcatatgttcagtatccaagcaggtttccgtaaatacccaagtactaaacaatctcttgaagattatgcagatttaatcaaacatggtatcgatggtaatccgtcaatttataaaccaacttggaagagtgaagctctatcatataaagatgctacttcacatctgtcacgctcatacgccacagatcctaattattctaaaaaattaaatagtattattaaacattatcatttaacatcttttgacaaagaaaaaatgcctaacatgaagaaatacaacaaatcaataggtacggatgtctctggtaatgacttcaaaccatttactgaaacttccggtacatcaccttacccacatggccaatgtacttggtatgtgtaccaccgtatgaatcaatttgatgcatccatttctggtgacttaggtgatgctcataattggaataatcgtgctgaaagtgaaggctatacggtaacgcacacacctaaaaatcatactgcagttgtgtttgaagctggacaattaggtgctgatacacagtatggtcatgttgctttcgttgaaaaagttaatgacgacggttcaattgttatttctgaatcaaatgttaaaggattaggtgtcatttcattcagaactattgatgcagaagatgctcaagatttagattacattaaaggtaaatag

SEQ ID NO: 964 - DNA, 684 bp, S.epidermidis
cataaaggtcttagaagaagaaaaagacaatttctatatttattcaatagaaattgtcttttttataattgtataaagaaaaccatgcgctatgcgtatggttcagaaaaggttttaccgttatctaaaaaaacatctcatcatgctagaatatatattggtcagccaaccaaaatattcaacacgaggagatgcttttttatgtcatctgacacaaacagtttagcacatacaaaatggaattgtaagtatcacatagtctttgcaccaaaatatagaagacaagtgatatacggaaaaatcaaaagagatattggagttattttacgtcaactatgtgaaagaaaaggcgtagaaataatagaagcagaagcatctaaaaatcatattcatatgttagttagtattccacctaaattaggagtatcctcatttgttggatatttaaaaggtaaaagcagtttaatgatttttgatagacatgctaatttaaaatatagatatggaaatagaaagttttggtgtaaaggattttatgtagatacagtaggtagaaataaaaaggtaattgaaaattacattcgtaatcaattacaagaagagatcgttgcagatcaaatttcaatggaagaatacctagatccctttacaggagaagaaattaaaaaaagacgaaaaaaatag

SEQ ID NO: 965 - DNA, 159 bp, S.epidermidis
caatttaaacacatccttatatcgacattactaaactctattccctattttgactattttaatattattaaatttaagtttgtacctgttaaattattgtactcaatcactcacttatattatagatgtatacatacttataaatgcaaccacacttaa

SEQ ID NO: 966 - DNA, 756 bp, S.epidermidis
ataacaaaacaaacaaattttaaattatatctggaggatttatatatcatgaaaaaaacagttatcgcttctacattagcagtatctttaggaattgcaggttacggtttatcaggacatgaagcacacgcttcagaaactacaaacgttgataaagcacacttagtagatttagcacaacataatcctgaagaattaaatgctaaaccagttcaagctggtgcttacgatattcatttcgtagacaatggataccaatacaacttcacttcaaatggttctgaatggtcatggagctacgctgtagctggttcagatgctgattacacagaatcatcatcaaaccaagaagtaagtgcaaatacacaatctagtaacacaaatgtacaagctgtttcagctccaacttcttcagaaagtcgtagctacagcacatcaactacttcatactcagcaccaagccataactacagctctcacagtagttcagtaagattatcaaatggtaatactgctggttctgtaggttcatatgctgctgctcaaatggctgcacgtactggtgtatctgcttcaacatgggaacacatcattgctagagaatcaaatggtcaattacatgcacgtaatgcttcaggtgctgctggattattccaaactatgccaggttggggttcaactggttcagtaaatgatcaaatcaatgccgcttataaagcatataaagcacaaggtttatctgcttggggtatgtaa

SEQ ID NO: 967 - DNA, 1542 bp, S.epidermidis
ttatttttgcacgaattcttaaaccaaagaaaggtgagcaaaaaaatggctaataaagagtcaaaaaatgttgttattattggcgctggtgtcttaagtacgacatttggttctatgattaaagaattagaacctgattggaacatcaaactctatgaacgcttagatcgtccaggtattgaaagttctaacgaaagaaacaatgccggtacaggacatgcggcgttatgtgaattgaactatacagtacaacaacctgatggttcaattgatatagaaaaagccaaagaaatcaacgaacaattcgagatttcaaaacaattctggggtcacttagtaaaaagtggtaacatcagtaaccctagagatttcattaatccacttcctcacattagtttcgtaagaggtaaaaataacgttaaattcttaaaaaaccgttacgaagcaatgcgtaacttccctatgttcgataacatcgaatatacagaagatatcgaagaaatgagaaaatggatgccattaatgatgacaggtcgtactggtaacgaaatcatggcggctagtaaaatcgacgaaggtacagatgttaactacggtgaattaactcgtaaaatggcaaaaagtattgaaaaacatccaaatgctgatgttcaatacaaccacgaagtaattaatttcaatcgtcgtaaagacggtatttgggaagttaaagttaaaaaccgtaattctggagacgttgaaactgttctagctgattatgtatttatcggtgcaggcggtggcgctattccactattacaaaaaactggtatcccagaaagtaaacatcttggtggattccctatcagtggtcagttcttaatttgtacaaaccctgatgtaattaatgaacatgacgtcaaagtatatggtaaagaaccaccaggcacacctccaatgactgtaccacatttagatacacgttatatcgatggtgaaagaacattattatttggaccatttgcaaatattggccctaaattcttaagaaacggttctaacttagacttattcaaatcagttaaaccttataacatcacaacattactagcatctgcagttaaaaacttacctttaatcaaatactctatcgaccaagtattaatgactaaagaaggttgtatgaaccatctacgcacgttctaccctgaagctcgtgacgaagattggcaattatacactgcaggtaaacgtgttcaagttatcaaagatactaaagaacacggtaaaggattcattcaatttggtacagaagttgttaactctaaagaccactctgttatcgcactattgggtgaatcacctggagcatcaacttcagtatcagtagccctagaagttttagagaaaaactttgctgagtatgaaaaagattggactccaaaattacaaaaaatgatcccatcatatggtaaatctcttatcgatgatgttaagttaatgagagcaactcgtaaacaaacatctaaagatttagaattaaattattacgaatctaaataa

SEQ ID NO: 968 - DNA, 141 bp, S.epidermidis
attaattcgcaaaatcgttttaatagtcttcctaaaacatttatatacacgaattttatattttacgatagtttcaaattactttttttagttaattggttttatttatctactttaaatactgtaaaagtaaaaagttaa

SEQ ID NO: 969 - DNA, 228 bp, S.epidermidis
ctttattttaaatatatcggtgacagacatccactgaaaaacactagttatatttttaaaatgagagcttcaggaatttttctctatacaaataaaccgataaataaaataaatataatacctgatactgaaataattgtctctaataacgaccatgttaaaaatgtttctttaactgtcagcccgaaatattctttaaacatccagaatcctgcatcattgacgtga

SEQ ID NO: 970 - DNA, 150 bp, S.epidermidis
acattttgtttgttcaagaaccgcatctttgaaaggagtgttattaagatgaaaaaattagcagttattttagcattagctggtgcagcgttctatggtttcaaaaaataccaaaatcatgtaaaccaagctccaaacattgaatattaa

SEQ ID NO: 971 - DNA, 195 bp, S.epidermidis
aatgaatttaaagataattattgtcgagttattaaaaaatcatttaattatgatcaaacagggaaaagaagacgtattataagagagttcgtcaaaaaattgacattatttcatgaatattcaattttatttatcaaaattaaatcaattcaatcagacatatttaaacatatgctttatatcaagtcatcataa

SEQ ID NO: 972 - DNA, 1101 bp, S.epidermidis
agacttattaatggaggaatgactatgccagaatctaaagcgttacttaaatctttaacagatgttaatggtatttctggacatgaaatgcaagttaaatctttaatgaaagattatttaacacctgtgagcgatgatatcgttgaagaccaattaggtggtatttttggtaaaaagaatgctactcatggaactaaatctttaatgatttctggccatttagatgaaattggctttatcgttacacaaattgatgaacaaggatacatttatttcacgccaattggtggatggtggaatcaagtcatgttatctcaaaaagtgacgattactactgaaagtggcaaagagatacgtggaattattggttctaaacctccacacgccctctcgtcggaagaacgcaaaaaaccagttgatattaaaaatatgtacatcgatattggtgtgcgtaataaagaagaagcgaaagaagcgggaatcgaattaggtaatatgattacaccttatagcgaatttgaatcattagcgaatgataaatacttaactgctaaagcttttgataatcgctatggatgtgcactcgctgttgaagtacttcaacaactaaaagatgaaaacatagacatcaatttatatgccggtgcaactgtacaagaagaagtaggtttacgtggtgctaaagttgcagcaaatttgattaaacctgatttagcaattgcggtggacgtcggggttgcatacgatgttccaggtatgacgagtgaaaaaaatgaaggtaagttgggcgatggtccattagcaatattgatggatgccactagtatcgctcacgatggtttgcgcaaacatattaaagacgttgctgagcatcataatattccagtacagtgggcaacaacacctggtggtggtacagatgcaggtagcattcatgtagccaatgaaggtatcccaacgattacaatcggcgtgccattaagatatatgcactctaatgtatctgtgctcaacattgatgattatacaaattcagtgcgcttaattactgagattgttcgatcattaaatgatgacagttatcaagcacttatgtggtaa

SEQ ID NO: 973 - DNA, 141 bp, S.epidermidis
cttataattaaaaaaataaaatttttgacaactatgttagcatatttatttaagatgctacattatacattagtacacaaatgtgatttaattattcgtaataatgataatacaaaagggtgggataattatgataggtaa

SEQ ID NO: 974 - DNA, 159 bp, S.epidermidis
ttgataattaaattttgtttttacgatacaagcttcttttggaaattgaaaagatacgataaatatagtggtgagtctaacaacacttcttgtgggttatttatagttgttaagggaagcttaaaagatacttttggtaacgtcaaaataaaaatttaa

SEQ ID NO: 975 - DNA, 189 bp, S.epidermidis
gttaaaattaaagtaactaatcttatattgaggtgtatcatgagaaaactgatatctaccattatcgtttcaacattattaattggaggatgttccacggtgcataaagaagcaaaacatacatcacaatcaattcctgaagaagttcccgcaagtcaatacaaaggtcaaggtttccacaaccagtag

SEQ ID NO: 976 - DNA, 882 bp, S.epidermidis
atggaaattaaacaaattaaatatttcgtagaagttgtacgacaaggtggtatgacgcaagcatctgaacacttatacattgcacagtcaacgattagcaaagcgattaaaaatattgaaaatgaatacgatattacattgtttgaccggtcacaaaaacaaataaaactaacagatataggtcaaacattttatgataatagtttagaatttttagctttattcgagaaattatctttagaaatgaatgacattgtgaacgttcaaaaaggtcatattaaaataggcttatcaccaatgatgaatgttcaaatgtttacaaatgcattgaatcagtttcacagactctatcctaatgtgacatatgaagtgattgagggtggtggtaaaattgttgagaacttaacatctaatgatgatgtggatattggtattactacattacctgtagatcacactgaatttcattcaacttctttatataatgaagaattattattagtagtaagtaatgaccatcatttagcacatttaaataaagtagacatggcagatttgaaagatgaagagtttgttttatttcatgatgattattatttaaaagatcaaattatagagaactgtaaaaggctaggctattaccctaaaactgttgctaatatttctcaaattagttttatcgctaatatgattcaacaaggaataggaattagtatcgttccagaaagtttagttaatttaatggggaataacgtaacgtccattcaattagagaatgttgaattatcatggcatcttggcgtgatatggagaaaagatgcttatctcaatcatgtaactcgcaaatggattgaatttatttctgagatgaaaccaacatag

SEQ ID NO: 977 - DNA, 273 bp, S.epidermidis
atgaagattaacatatttggatataatatcttcgccaagggcggaacatcaagaagtaatattaacttagtgaaaagcttattagaaattggacatgaggtacactactttaattatcaggactataataaaagtgatatcacaaaactaattatttacgaaggtttgagcacaaagcatcttcatattcatcaatttaatagtggaaaagaacttgctcatggagacctacttataattactagagaaacctttttaatcatgcatatctag

SEQ ID NO: 978 - DNA, 912 bp, S.epidermidis
agggggattaacatgtttgattcaattagagagacaatagattattcagttgaaaataacatcagttttgctgatatgatgattaatgatgaaatggaaagagaaggtaaatctcgcgaagaagtgcgtgatttaatgagacaaaacttaaatgttatgcgtgaggcagttgaaaaaggtacgactggcgacggtgtggaaagtgtaacaggttatacaggtcatgacgctgctaaacttcgagattacaacgagaataatcatgcattatcaggtcatgaaatgattgatgcagtcaaaggtgcagttgcaacgaacgaagtcaatgcagcaatgggtattatttgtgctactccgacagctggttcctcgggaacgattcccggcgtaatatttaaattagaaaaaactcataatatcactgaagatcaaatgatagattttctattcacatcagctttattcgggcgagtagttgcaaacaacgcaagcgttgccggtgcaactggtggttgtcaagccgaagtgggttcggcatctgcaatggctgcagctgctgcagtatcaatttttaacgggtcaccagaacaatcaggacatgccatggcattggcaattagtaacttattaggcttagtttgcgatccagttgctggtttagttgaaattccatgtgtaatgcgtaatgctattggttcaggaaatgcattaatatctgcagaccttgcactagctggagttgaaagtcaaattccagttgatgaagtcataggtgctatggatagagtaggtcgtaatttacctgcatcattaagagaaacaggtttaggcggtttagcaggtacacctactggcgaagaaattaaacgtaaaatattcggcgaagcagacaacatggttaaaaataaataa

SEQ ID NO: 979 - DNA, 138 bp, S.epidermidis
tcgccttgtttaatttctgcagccatcgacgttcactcctttaaaattgtatatatttatatttatcacgctttgacgttttcaaacataattagtttacagtttacatttatattgataactattgcttttttataa

SEQ ID NO: 980 - DNA, 126 bp, S.epidermidis
ttcctaactaaccatatgattaatagtgctgtaccagttattagcatacttaatgcgatggatgttaacttactgaatttcactgaaaaaggtaaagctattagtgacacgccaataggtatttga

SEQ ID NO: 981 - DNA, 303 bp, S.epidermidis
gagttgactaaaatgattataattaatgctaaattaaaaatcgatgctaataaacgcgaggattatctaaaacttatgaaagaattagtcataaattctagaaaagaagacggtaatttattctatcatcattacgaagatgtaactgagaaaaatgtctttgtcgtagttgaaaactataaagacgaacaagcggttcaagcacacaatcaatcagatcactttaaagtttttagtgataatattagtcaatatttaattgaagaacctcaaattgatgtaagtcaacctattcaattataa

SEQ ID NO: 982 - DNA, 942 bp, S.epidermidis
ttattttataaagtggtttattttgttgagttaaatatattagaatgtgagggagtatttgaattgaagaaattagcagtgatatgtgcgtttacaatattaatattagctggttgtggtcttggtgatagtgataataatggaagctcaacgataaatgatgatcaacaatcaggatataaaagtaacagagattcaaaatcaagtataagtagaaatcaaacagaagataatcagcaggacacacaacaagatacccattcgaatagatactatgctcaagtttggttaactgctttagatagttatagaggtgaaagtgaccttccttttgacgatttagaaattgtacatcaaaatatttctaataaagttttagatccctatcacccagacgaatcagccaaactacctgaaggaacagaattgttaacagcaagtgttactgcagcaggttcagtttattataaaagtaatggagatggcacaattacaatatatagtgtaccatcacatttccaagggagttggcgtgacgctgattactctaaaagagaatctcaacgcattatagatgatgctcgtacagttaagttatacaacgctagtgaaagtgaaatcaataagataagtcagatgatgaggactgaattttcagttggtgataatttaacagatgaagatgatacttctgaatctgaagatcaatcaagtagttctgatgaagtaacggtgacacgaagtaatgttatcgatatagttgaagactacgaagggcatcaattagatacagacacatatatttacaaagaaccagaaaaagatagcgatggtagttgggggttctcatttacagataaagaaggccatttagaaggatcttatattatcgataaagatggagaagtaacgaagtatgatgaagatggagagccagaataa

SEQ ID NO: 983 - DNA, 123 bp, S.epidermidis
aataattataaactaactatttttaaaaatgtacaacaatttaacaaattcttaaagattcgctatttacgaagcaatacttgccgtctgttttactgctatatcattagcaatggtttatga

SEQ ID NO: 984 - DNA, 132 bp, S.epidermidis
aaaaattataaaaaagacaatttctatattatttcaatagaaattgtctttatttacttatcttggacctttttgtcccagcctctccatttctataatattactattctatttttcattaatcacatttaa

SEQ ID NO: 985 - DNA, 1242 bp, S.epidermidis
aacgtatataatagatgctataacttttctaggagaataatgatgatgactacaagttccaaacacttatctaaaatattaatcgttatacttggcgttatgactgcatttggtcctttgactattgatatgtacggaccatctttacctaaagttcagcatgcgtttggttcatcaatttcagaaatacaacttacattatcctttgctatgataggtttagctattggtcaatttgtattcgggccactatcagatgtattaggtcgtaaaaaaatggcactcattttattgattggatatttaatagcctcattactatcagtgtttacagttcatttaacaatatttttaattatccgtttaattcaaggtttagcaggagggggtgcaatcgtcatagccaaagcttctattggagataactatgacggaaacaaattagcaaaatttttaacttctcttatggtcataaacggtataatcaccatcattgctccactgttaggtggcctcgctttatctattgcaagttggaaaatgatttttatatttttaacaatcattaccttaatagtcatcttaggcatcttattaaaaatgccagttgggctccatcaaaaacaatctcagttaaattttaaagcaatatttaaagattttggtttgttattaacaaaacccaccttcgttattccgatgttattgcaaggattaacttatgtcatgttattcagttatttgtcagccgcaccttttatttctcaaaagatgtatcatatgacaccacttcaatatagtgcaatgtttgctattaatggagtgggtttgatagtcgtcagtcagataaccgctattatagtagaaaagataagccgatatgcgatgctcatatatttaacaatcattcaaatgttaggtgttgtaattttaatatttactttaacattacatcttccattgtatgttttacttattggcttttttattaatatatgtccagtcacttctatagcaccactttgtttttctatggcaatggctgaacgcacaggtggaagtggcaatgcttcaagtttacttggcctattccaatttattttaggaggcctcatttctcccctagttggtttgaacggtcagcatgatatgtccccgtatctaattattattagtgctacagctgttttacttattgcactacaaattatttatttcaaattatttatgaaaaacacatag

SEQ ID NO: 986 - DNA, 240 bp, S.epidermidis
attccatataaaggagtatatattttccgccactttttcaactcatatattctcaaattgatttatagtaatagtatgtatttctcttcattattatttagacatttacttcaaaacaatataattgaaataaaaaagagtctggacatccatctaccttgtgtccagactcttaatcatgctcatagtattttattgattcaatcatcatcttatttatatcttttcaaacctttttga

SEQ ID NO: 987 - DNA, 687 bp, S.epidermidis
tgtcgatataaggatgtgtttaaattgctacttaaggttgaacatcttacatacaaggttgataatcgtacgattttagatgatattaatttgaatattaataaaggagacacgattgctattgtaggtccttctggaagcggtaagagtactttactcaaacaattgaatcatttaattagtcccacgagtggagatttatatttgaatgatcaatcttactttaattataagccggaagagataagaacacgtgtgagttatttaatgcaacaaagtgagttaatcggttatacaattgaagataatatgaaatttcctgctgaggctagaagtgaagcttttgaccgtgataaagcgaaacaactcatctctcaagtaggattaggtaattatcagttagatgctcaaattgagcacatgtctgggggagagcaacaacgtattaccatcgctagacaactcatgtatgaacctgaagttttattattggacgaagctactagcgctttagatacacataataaaaagaaaattgaagaaattatatttaaactagcagataaagggattgccattttgtggattacgcatagtgatgaccaaagtatgcgtcattttaagcgtagaatcacaattactgacggtaagatatcgagtgatgaggagttgaatggtaatgagtaa

SEQ ID NO: 988 - DNA, 318 bp, S.epidermidis
ataacgtataaaagtttaagaatgctattattcattggaggtcctatcatggataaaataaacaaagaagataccgatactaaaaaagatagtaataacaactataaacatcaaaatgaccatatagatagacaaggtttaaatggttatcaaaaaactgatttagatcttgagatagaacgagaactacaggaaatgatggaaaatggagaatctaataaagaaacaaaaagtaagcatttcaaaatcttatctttcgtttcaatgattgtcattgtagtgatagccatcatacgattcatccaaaaaacgatataa

SEQ ID NO: 989 - DNA, 138 bp, S.epidermidis
attaagcataacgtcaatcctcatttaatttttaatatcataaaaagaaatatattttttattaaaaataaaagcacttacattggcttgtttcatatatttatagtttatattaaaacacgattaaatcaattatag

SEQ ID NO: 990 - DNA, 138 bp, S.epidermidis
tcttttaataaaggcattgaattgatgtctttattgacgaaaaagaccgcgattaactcatattcgtttatttcatatatgaataaacaaagtattacatttttctataggaaacctattccttttatgaatggttaa

SEQ ID NO: 991 - DNA, 297 bp, S.epidermidis
caattaaataaagcctataagaataacttaatggctaaaacaaacaagtctgggacaaggatattttatgtcccagaccttctttatgtatatacagattcttatgagatgagtccaacacagagaatttccgaagaaattccacggacaaagcaagttggggttggggccccaacagagagaatttccgaagaaattccacggacaaagcaagttggggttggggagaagacaggggacaatgaattctatcctagtttagcgttcattttaataaggggaattttacaaagttga

SEQ ID NO: 992 - DNA, 144 bp, S.epidermidis
ctaaagaataaaagtcaaactttaggagaaacagtaatgtcgttttatgaacgagtattaaaactaggtgaaaataatcatcgtactgcttttgaatttcgttttgaagagttattttcaaatgaagaatggtgcgcattatag

SEQ ID NO: 993 - DNA, 813 bp, S.epidermidis
gggtggaataaagtgacgacaccaacaacgcataaatataatcgctatttaaataaaaggatgtctcttaaaactagcttttcaattattttaatcacgggtttgattatctggagttttatttatactggatttagcattggagatttaatgataggtctgccacaaattggcgtattcttcaaacaaatgatacctccagattggggttatctagatcatattacacaaccaatgctagacacgattcgtatggcaattgtcggtacttttctaggaagtattgtctccattcctatagcgttactgtgtgcgagtaatattgttcaaacaaagtggattgcgattccatcacgttttgtccttaatattgtacgcacaatacctgatttattattagctgccgtatttgtagccatatttggtattggacaaattccgggtgtattagcactttttgttctaacaatatgtatcattggtaaattattatatgaatcattagaaacaattgatccaggacctatggaagctatgacagctgtaggggctaataaagtgaaatggattgcatttggcgttgttcctcaagcaatttcatcatttatgtcatatgtgttatttgcctttgaaattaacattcgggcatcagcagttttaggtcttgttggcgcaggtggtattgggttgttctacgatcaaacgttaggattgtttcaatataaaaagacagcaatgattatcctgttcactctaatcattgtagttattattgactatgtgagttcgaaagtgagggaaaaattagcatga

SEQ ID NO: 994 - DNA, 231 bp, S.epidermidis
agaggtgataaggtgagtttttatcattttatacaaaatttcgttggtgatgaaacacctctaggtaaactagccacatgtattaaccaagatgaagatttacctatggaagaaacaacagcacataatatattaaactattttaatcagttaaattattttgatgacgattgtattgaagctgtaaaacgctcactatcactatatgaacaaagtaaagtagccctataa

SEQ ID NO: 995 - DNA, 2637 bp, S.epidermidis
aaaggagataacagtatgtctaaaagctacgctaaattttacaaatgtgctttgcaagttaacccatatagttacattaaatatagaggcctagaacatgaaatgacagaggaacaatataatgagtctatataccaatattgtaagaccaataatatatcaattattggtctagcagatcatggtaacgttgataactcgagtaaactcagacaatatttagtatctaaaggtatccttgtatttccaggttttgaaatttccacatcagaaaaagttcacattgtatgtttattttcagaaaataccgaagaacgagaattagagagatacttaggagaactaggattatcaaatcttgaagaaggtaattctccaagtactctaagttttcatgaaatcacacaaaaagtattagatagaggaggattttggtacgcagcacatgttaccagtgataatggcatcttgaaaggaaaacataacaatctctggcaatcagataaattaatagcagcacaaataccttcaaaaaaaaacgaagtagaccctaagtatactagtatacttaaaaataaagatcctaattatcaaaaacaaactccttttgctcttattaatgctaaagatattagtaaaccggaagatctagcgttagatacttcaagttgtttaattaaaatgtcaaagcttaattttgaaagctttaaattagcttttagagatcctgatgctagagttaaattaaactctgacattaataacaaatttccacattcttctattgataaaattaaaatttctatgggatacttggataacctctcgttagatttatcttcaaatcttaatactattattggtggtagaggaactggaaaatcaacacttatcgaattaattcgttatgcattagatatagctcctacgagtcaaaatacaaacacatcttttgaaaacatctgtaagtctaatttaggaatcggtggaaaagtagaattaattgtcacatcacatgcacaatatggtaaacaatttaagataataaaaagatataatgaagatcctataattaaagatatagacaacaatgtgtcaaattacacagttaaagatattctccctaatatagaggtctatagccaaaatgaaattatcgatttaactacaaatgaaaacgcaaaactaaacattttgaatcgatttttagataaagatgatagaagtaatgataaaaaagaagaaataaaaactaatttacattcaaattcaaaatctttaattaaagctaaagaagatcttgaaaatttacaagaaaagatcaatcaattacctaaattaaaagaaaagttaaaacatttcaatgaactaggtattggaaagaaattagaagtacagggtaaaatatctagagaagaacaatacatacagaatactaaacaaattattgaagacaatgatatttctataacaaatatcattttaccttttaacgaaaattataatcaacaaattaaacatgttgagatttttgatagtattaaaaatattacagacaatcataataaaaaattaaaagaaataaaatctatgtttactgacctaaaagatactacacaaaacgaaatagaaaaaatttataatgtttggaaagaaaagaaaaaaaatattgagaaggaaatcaatagagctattaaatccctagatgatatagaaggtaaaactaaagaagatatagcacatgaatacactgagactcaaaaacaaataacttctattgaaccattagaaacacaattatctcgagttaaaacatctattgaaacattagaaaatgaaaggatacaacttaaagaagatttaaaagaaatatttgatgaacaactaaaaaatcttaacagatgcgtaaaaaaaataaataatagatatttaaaaaaacaagtaaacattaaaattcaaccatatgcaaatgttaataatttaatagagttcctcaaagaggaaaacggattaggagattcaacattaaaatggataaaaaatcatcaaagctttaattttcctaagtttattaaattaattaaggatagagacagtgaagctatatacgaggaatataaagatagcggtttaaaaaaacacacagcagatattctttcaaatatgctctatgagagaattctaaagttggaatcaatagagctagaaaatattatagatatacgattgaatgttggaagtgacaaagatacgaaattccgatctctaaatcatttatccaaaggacaacagtgcactgctattttgaatctattaactttaagtaataatgatcctcttttagtagatcaaccagaagataatttagataattcttttataacaaacaatttagttgaaaatattcgtaaattaaaaattaatagacaatttatttttgctacacataacgctaacatacctgtatttggcgacgcagaattaatagtgacaatggaaaatgaaaacggtcaaggaagtgtaaacaatgaaaacttaggatccattgataatactttagtaagaaattctgtcatccaaattttagaaggtggagatgttgcttttaaaatgagaaaaaataagtatggtctttga

SEQ ID NO: 996 - DNA, 1011 bp, S.epidermidis
ggttcttgtaaaatgtcgcgttatgaacgtcaaacacgctttgcaccatttggagaagagggtcagcaaaagctatcctcctctcaaatacttatttttggcgctggtgctttaggaagccatattgtagatcaactcgcacgcatgggggctcatcatattgcaatcgtcgatatggatattgttgaaatttcaaatttacatcgacaaacactcttcgatgaagaagacgcacatactttaatatccaaagttgaagcaatcaagcataaggttaatcaaattaatataaatgtcaatctaacaacttatgatttagaagttacttcatcaaatatcgaaaatttgataaaaaatgtcgaaccagacatcatcattgatggcatggataacttcaaaatacgatacctgattaatgaggtttgtcacaagtatcaaatcccatgggtttatggtgcagctgttggtagtaaaggatcagtatatggaatagatcaccaaggaccatgtctaaaatgtttattgcaaacaattcctgacacaggggaaagttgcgctattaatggcgtaattccccctgttatatcaatgattgcaagctatgaagtagcagaggccgtacgttatctttcaggaaaaggattttcaaagcaattaatcactattgatgcatttaatatcaattataagtcaatgaatgtagatgcactcaaaaataaagattgcccagtgtgtgaaaaacatgaatatacgttactagaaagccaacaagaacgtactattgaggacttgtgtgggaatgcttatttatttagattcccacctaaagcttttaaacacgctgcccatttccctgggaatatggtgaaatctacttcctttgccaaattaattcaatatcaaacttatgaattcaccttgtttaaagatggtcgtatgaatgcatatggtatacacaatgatgaagaagcacatcacctatacaatacgttgttaaaatccatacgctaa

SEQ ID NO: 997 - DNA, 948 bp, S.epidermidis
ttaagatgtaatattagtaaagaaaggtgtatcatgataaaaataatcgccacaattatcgtttcaacactaatattaggaagttgttcgacaatgaatgaagaagaaaattatgcatcacaatcaattcccgcaagtcaatacaaaggtcaaggtttccaaccagtagctgaaaaaagtgctatcgcacacgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcctttttgataaggaagcaatacatgaagaaggctccatgcgaagcaatgataatggagatactatgagtgatatggtaggaactgtgttaagcggttttgagtatagagcaaataaggaaaaaatggataacttagaaaaatacctcaaagataaagaagataaatatcactatactggattcaccgatgaagcaataactaaaactcaaaatataggttatcaaaataattacttttacattactactagttccacgaaattacgagattatagaaaacattttgaacctttaattaaagaaagtaacgatgattttagaaagcatatgaaacaattaaagtctaaaaaagatacgtatcttaatacagaaataacaactacacttttcagtactcttgatgaatatgacgaaaaaatcattagaaaaaatagtatatccatggctaaagaaataagaaaagagccatctattccacataatttcacattccacttattatttagcaataacaaattaaaaatcaacgatccaaacataaataacaatcaaattaatgagtatggggtgttccaccatgacggatttaaaaattaa

SEQ ID NO: 998 - DNA, 159 bp, S.epidermidis
caacaaagtaatgccacacaaaacttctttgtgattataattttaataaatataattttgtataataaaaataaacgatttcaacagaacaaagataaaataataacatatgctaatataaaaataaacgatttatttatatttaaaaaatataagtga

SEQ ID NO: 999 - DNA, 156 bp, S.epidermidis
gttcttttcaatttatctatatcatgtacaataaaattaaatagggattattttaaacgcattgtttcaataataggaggcaaacatggaagaaagaattggtttgatagacattggttccaacacgattcgacttgttatatttggctacaataa

SEQ ID NO: 1000 - DNA, 141 bp, S.epidermidis
ataacaatcaaattaatgagtatggggtgttccaccatgacggatttaaaaattaatgatatggatatagctgaaataaatggcttttgggtatatcaaaatactaaaaataaaaaatttacagttaatggtaaaaattga

SEQ ID NO: 1001 - DNA, 189 bp, S.epidermidis
aatctgatcaaaatggaggttatacttttgaatattaaaaagcattggttaccaattgttgtagtcattcttgtagttgttatctttttattagttactttcgctagggcaaatgaaggtttagataattatgagcaacatgaattaaataatggtgaacagcaatatctttcaaaaggggcaagctaa

SEQ ID NO: 1002 - DNA, 1521 bp, S.epidermidis
aaatttaacaaacttaacggaggtcgtttgatggaacttgtagataaattatcaaatcgtcaatatattgatggagaatgggttgaaagttcaaataaaaacacaagagatattataaatccttacaatcaagaaacaatcttcactgtagctgaaggaactaaagaagatgttgaaagagcaattttagctgctagaagatctttcgaagacggtgaatggtcacttgaaacaagtgaagtcagaggtaaaaaagtgagagccgttgctgataaaattaaagaaaatagagaagagttagctaaattagaaacattagacactggtaaaactttagaagaatcctatgctgatatggatgatattcataatgtgtttatgtattttgctggtttagctgataaagatggcggtgaaattatcaattcacctattcctaatgctgaaagtaaagtagttaaagaacctgtaggtgttgttactcaaattacaccttggaactatccattacttcaagcatcttggaaaattgcgccagctttagcaacaggttgctcattagttatgaaaccaagtgaaattactccgttaacaacaattcgtgtatttgaattgatggaggaagttggtttccctaaaggaacaattaatttagtacttggtgctggatcagaagtgggcgacgtgatgtcaggtcatgaagaagtcgatttagtttcatttacaggtggtattgaaacaggaaaacacatcatgaaacaagcagctaatcacgtgactgacgttgcattagaattaggcggcaaaaatcctaatattatttttgatgacgctgattttgaattagctgtagaccaagcacttaatggtggatatttccacgctggtcaagtgtgctctgctggttcaagaatcttagttcacaatgatattaaagataaattcgaaaaagctcttatcgatcgtgtaagcaaaatcaaattaggtaacggttttgatcaagatactgaaatgggaccagttatctcaacagcacaccgcgataaaattgaaggttatatggaagttgcgaaaaaagatggagcaacaattgcaattggtggtaaacgccctgaacgtgaagacttacaagccggattattctttgaacctactgtaattacagattgtgatacatcaatgcgtattgttcaagaggaagtctttggaccagttgtgactgtagaaggatttgctgacgaagaagaagctattcgcttagcaaatgattcaatttacggtttagcaggtgctatatttactaaagatattggtaaagcacaacgtgttgcaaataaattgaaacttggtacggtttggattaacgatttccatccatactttgcacaagcgccatggggcggttacaaacaatcaggtatcggtagagaattaggtaaagaaggattagaggaatatttagtaagtaaacacattcttacaaatactaatccagaaccagtggattggttcagtaaataa

SEQ ID NO: 1003 - DNA, 156 bp, S.epidermidis
ctcatcaacaaacacccttcttttataaagaaaagctatgagactcaagccgcaagaggtccacaaaccttcacgtttaatcccttagcttttctttttataattcattcaatttattttatttcatatcatgaacagctttttcatattgtctaa

SEQ ID NO: 1004 - DNA, 1389 bp, S.epidermidis
ataataaacaagagaaagaaggggaatgcgatgtttggagagatttggccactcatcagtgttgtattaggaattattatcttattaacattaattattggattgaagcttaatacatttatttcattaatcattacctcaatgataacggcgttattattaggtatgccacttaacaaaattatggaaaccattgaaaatggtatgggtagtacgttaggtcatattgctttaatctttggcttaggtgcgatattaggtaaattattagccgatggtggtggggcaacacgtattgctgatacacttattgcaaagtttggtcagaaacatgttcaatgggctatgttgatagcagcatttatcgttggtattgcgctattttttgaagtaggtcttgtactattaatcccactcgtatttacagtagctaaacgcgcaaatgtatcaatattaaaattgggactaccaatggtcacagcgttatctgttacacacggattcttaccaccacatcctggacccgttgtcatcgctaaggagcttaaagcaaatataggtgaagttttgttatatggtatgattattgctatccctgtaacacttattgcaggtccaatctttaatcgatttgcacaaaagatggttccaacagcgtatacgagagaaggggatatttcttctttaggtactcaaaaggaatttaaagaagaagagatgcctggtttcggaataagtttattgactgctattttacctgttattcttatgttgatttctacaattgtgcaactgattacaggacacgaagaagcaacaaatgtattcgaacaaattgtttacttcataggaactgctggtactgcattgcttatcgcagtaatatttgcaatctttacaatgggaatgaagcaacaacgaaaaatggaagacattatgaaatcagttacgcatgctatttatccaatcggcatgatgttactcatcatcggtggtggtggtacatttaaacaagtgctcatcgatggtggcgtaggtgatacaatcgctaagatgtttgaaggaacaagcatgtcgcccattttattagcatggattgtagctgcagtcttaaggatttcattaggatcagctacagttgctgctgtatcaacaacaggcattgtgttaccacttttagagcattcagatgttaatgtagctttggtcgttcttgcaataggtgcaggtagcgtaattctctctcacgtcaatgatgcaggattctggatgtttaaagaatatttcgggctgacagttaaagaaacatttttaacatggtcgttattagagacaattatttcagtatcaggtattatatttattttatttatcggtttatttgtatag

SEQ ID NO: 1005 - DNA, 495 bp, S.epidermidis
tcccaatgcaaattacttatatttgtcagtaaccttcctcctcaggtcgtccatcatttcaattttaaattgaggagggacttatctatgaaattatctatttttcatgatggtcaattttttgtaggtgtcgttgaataccaagaaggcttcattcataaatatctaaaagttacatttggcaatgaacctagcgatgaaacagtgttacgattcataacttttaaacttattcctttattaaatcaaacacactgtaagaagaaacctattcaaaagcataaaaagattaatccaaaacgtttacaacgtaaaatcgctaaagaacaaaaagagaccaatttaactacatttgctcaacaagcgattaaagaagaacaagagttgaataagctaaagagtaaaaaacttcagcgattagaaaaagaacgacacagacaatacaaaagaatgttaaaaagaaaaaaagcacatgaaaagcacaaaggtcactaa

SEQ ID NO: 1006 - DNA, 903 bp, S.epidermidis
tatatgcgcaaagtattaattttcgcaattgcgggatttttagcacaacttgttgatgggtcattaggcatgggatttggcgcttcatcgtcatcaatattattaacttacggtatagcaccggcagtagtgtcagcaaccgttcatttttctgaaattgcaacaacagctgcatctgggacatcacattggagatttgataatgttcataaaccaacaatgttgaagttagctatacctgggtcaataagcgcctttatcggtgcaggtgttttgacatttattcatggtgattatattaaaccattcattgctttattcttgttaagtatgggattttatattttgtatcaatttctatttaaacgtgcacatgaacatcatcatcatgtgggaaatttgagtagttttaaagtaattccacaaggttttgtggcaggatttttagacgcaatcggtggtggtggttggggaccggttaatacgccgctcctgctttcaagtaaaaaaattcaaccacgatatgcgattggaacagtctcagcaagtgaattttttgttacgtcatctgccgctttaagtttcattatctttttaggagtcactcaaattaattggtttgctgtaattgctttaagtctcggtggaatggtagcagcacctatttcagcgtatttagttaaagtgttacccattaacattcttgcaatttgtgtcggtggtttaattatttttacaaatagtaatgcattattaagctattttgtaaaagataacactatttcaaatacagttcgattcattattattcttgcaattattattttgcttgtttttcaagtcgttcgaaacaagaaattgtctttttcttataagaaaagccgagtaaacaaatataattaa

SEQ ID NO: 1007 - DNA, 135 bp, S.epidermidis
atgaatagcaattcctcgataataaataacaatattaatatagggagtgggacagaattcataacgagttcattgtcctactccctatattttaatttaatctataagtctttcatttattttctaggtacttga

SEQ ID NO: 1008 - DNA, 1542 bp, S.epidermidis
ctggaaagcaatatgataactactacacaagaggtgaacattatggctatgtctgacaaaaaagacgtcgtgttaatcggtgctggtgtactaagtactacatttggttctatgttgaaaacgattgcacctgattgggacattcatttatatgaacgtctagatcgtcctggtattgaaagttcaaatgaacgtaacaatgcaggaacaggacatgcagctttatgtgaattgaactatactgtacaacaacctgatggttcaattgatattgaaaaagctaaagaaattaatgaacaatttgaaatttctaaacaattctggggtcatttagttaaatcaggagaaattcaaaatcctaaagaatttattaatccattacctcatattagttttgttcgtggtaaaaataacgttaaattcttaaaagatcgttatgaagcgatgaagcaattccctatgttcgataatatcgaatatactgaagatattgaagaaatgagaaaatggattccattaatgatgaaaggccgtgaagataagggctacatggcagcgagtaaaatagacgaaggaactgacgtaaactacggtgaattaactcgtaaaatggctcaaaatcttaaaaactcaccaaacgttgaagtgcaatacaaacatgaagttgttgattttgaacgtttgtctaatggtaaatggtcagttaaaattaaaaatctaaataatggacaagtattcgaacatcaaactgattatgtgtttatcggtgctggtggtggcgcaattccattattacaaaaaactggcattccagaaagtaaacatttaggtggattcccaatcagtggtcaatttattgcttgtacaaatccgcaagttattgaacaacacgatgccaaagtttatggtaaagaaccacctggtacaccaccaatgacggtacctcacttagatacacgttacattgatggtgaaagaacattattatttggaccatttgcaaacgtgggacctaaattcctaaaacatggttctaacttggatttattcaaatcaattaaaccatataacattacgactttacttgcttctgcagttaaaaacttaccattaattaagtattcatttgaccaagtcatcatgacaaaagaaggttgtatgaaccatttacgtacgttctatcctgaagcacgtgatgaagattggcaagtttatacagctggtaaacgtgtacaagttattaaagatactgaagagaatggtaaaggatttatccaatttggtactgaagtggttaattctgaagaccactcagttattgcattactaggcgaatcaccaggagcatcaacttcagtatcagtagcactagaagttttagagaaaaacttccctgaatacgcgaaagactgggaacctaaaatcaagaaaatgattccttcatatggtgaatcacttattgatgatgttcaattaatgagaaaaatacgtaaacaaacatctaaagatcttgaattaggattctataataaagcaaaataa

SEQ ID NO: 1009 - DNA, 1056 bp, S.epidermidis
tataatttaaaagattacaaaatatttattataggagggttttatatgcattgtccgaattgcggtaatccaatagaagatgatgatttattctgtggtgaatgtggacataaaataagtcgacatccacagtcagtcagaaatgcagaaagtgaaataacaaaagctgaaaagaatgatgaagaacaaaacataacatcaaataataaagaaaacaacgcagcgactcatcaaaatgttgattcaacatctcatgatgagactagatcaaatgaaaatgacgtagcagattcaacattacaatctaagcagtcacataatgatacccaacaatcaaatctctctacataccatcaaagacctcaacatcgagaaattcctcaaaatcaacacaatcacgatcaacagcaaagtcaaataggtcaacaagctaaacaagtaacaaatgaaagtaaaggtttctttaaaagtgcatttactgcacctgataaaatcattcaaactaatcatgttttcagttttaaattattattatcattattaataatcggttttattgtattagcaattttactcgcttccgtaataccagttgagattggtattttcggtactacaagaggaagtttggtaacgagtatcatttttggtattattctatttttggttgtcatagtaggtgcaatatttgggcttacacgtttagtagttagacaacctattgcatttaaaaaagtattatcagactatgtgttaattaatagtgtttcgttagcaattttaattatttctgtaattttaatattagcagaatcatacagctttggcggaagtatagcattattgtctttattattatttattgcttctggtatttatctaattgcgaagtatagcactggtaatcaaacaagaatatccagcttttatggtgtgattatttatatcattattttgttcttatttattcgtatttttggggaggcatttttccatcaaatatttggtgattttatagaagaactaggggatttatttgaaggaggaacttattaa

SEQ ID NO: 1010 - DNA, 1482 bp, S.epidermidis
tgcaatttaaatttaaaactgatctttcagggaatacttctaatggaggtgtttaacatgacaaatcaattatttattaacaatgaatttatagaaagtcagtctaaagagacaatggatgtcattaatccagctactggcgaggcatttgatactatcactcttgcaactgaagaggaagtaaacgacgccattgaaaaatcgcaacaagcacaacttgaatgggagcgcgtgcctcaacctacacgtgcggaacatgttaaattacttatacctttattagaaaaaaatcgcgatgaaatagctcaattatacgtaaaagaacaaggtaaaactttagcgcaagcttatggagaaattgacaaatcaatctcatttatcgattatatgacaagtctgagtatgtcagataaaggacgtgttctacaaaatagtattgcaaatgaaacgattcaaattatcaacaaacctatcggagttactgctggtattgtgccatggaacgcaccgatacttgtccttatgcgaaaagtcattccagctatagtaactggttgttcagtagtgattaaacctagtgaagagacaacgttactcactcttcgattagctgaattattcagagcatcaactataccagcaggattgtttcaaattgttcctggcactggagaaacagtaggtacacaattagcttcgcataaagacattcaacttatttctttaactggaagtatgagagctggtaaatctgtttacgaaaatgctgctcaaactgtaaagaaagtaaatttagaattaggtggaaacgcaccagtcattgtcacatcaaatgccgatttagataaagcagttaactatatcgtgacagcccgtataaataatgcaggtcaagtttgtacgtgccctgaacgtatctttgtacatgaagatgttcacgatgactttttaaataaagtaacttccaaaatgaaaagcttaactgttggagatccatttgatgaaaacaccgattacggcgcaattattaaccaaaaacaacttgatagtattcatgaaaaggttcaagatgctattaaaaatggcgcaacattgatgactggtggacatcaattaaaacgccatggtttcttctacgcaccaacggtattagataacgttagaaaagactataatgtctttaaagatgaaatttttggtcctgttcttgcgataacaacataccgcgattttgaacaagtgattgaagacgctaatgatacaaacgctggcttatcttcttatatcttctctgaaaatttaacagaagtaatgacagcaaccgaacgtctaaaatttggtgaagtatatgcaaattgtgaggctgaagaagtcgttaatggctatcacgcaggttggcgtgaatcaggcttaggtggcgctgacggtattcacggttttgaagagtactacaataccacagtaagttatatcagatactaa

SEQ ID NO: 1011 - DNA, 144 bp, S.epidermidis
aacagcttaaaaaaatcattgtcacaaaagagttataatcaaatgagatgtggatacttaatgaaagattataattatgtattcccaaaaataaagcgaactcttgttatcaatagtattgataactcgaattcgcttttttaa

SEQ ID NO: 1012 - DNA, 168 bp, S.epidermidis
tgtttattaaattatacgaaagggcttatttttttaaagtattttaatgtaaaattacatataaacacaaagtattttggcgagactcttgagggaacaggacaagctgaagactacaggctgaagctgtcccctaagaaagcgagccaacaatacgaagtattttaa

SEQ ID NO: 1013 - DNA, 141 bp, S.epidermidis
tgtttattaaattatacgaaagggtcttatttttttagtatttcacatataaagacaaagtattttggcgagtccttgagagaacaggacaagctgaagctgtcccctaagaaagcgagacaacaatacgaggtattataa

SEQ ID NO: 1014 - DNA, 834 bp, S.epidermidis
atgaaattaaagcgtggatttcaaaaaaataagacgcccgggcgtctagaaatgaataaagttattgaaagtgacgtaacgttatcgagtatgctttggctaggaggtgagaagtctatgtcgatttatacttcaggagatatagctcataaatgccatgtgtcaacacgcactattcagtactacgataaacaaggaatcttatcgccaaactatacttctgaaactaacagacgtttttacactgataaggaagtggagaaacttgaactgattttactacttaaggaaataggttgcacaattaaagaaattaaagtgttattaaaagatgattcatcaatgaaatctctttacacgtttcttcaaatcaaaaagcatgagatacaacagtcaataacagataaagaacacaaggtatgtaaaatagagcaaattcaacgctatgttcatcaaaattcaatttctccaattcattatttacaagatataactacttatatggaagaatctcatagactcaaaggtgtcagaaagaaattatggttaagtatagctctgattgggtcattacaatatggtggtttgatcatctcaattgtaactcgaaggaaaaagcctttcttgtcgatgatgcctgtggtagctatgtattcactttggttaacaaaaaagtataaaaagaatgtttcatatgtctgccctaattgccatcatgtgtttaatcctagtgtcattcattttgtaacagcatcacatacacctaaaactagaaagcttcaatgtcctgattgtcacgaaatgcattactgtatagaaattgctaagcaatga

SEQ ID NO: 1015 - DNA, 714 bp, S.epidermidis
atacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaaccttgaacaattaagtctataccaagatagcttaggctatcttggtcaacaaatgaattttccagaaaaaatgacatttcatccaaaaatatttgaagaaactatttctaagtctcaccccggctacgaagatttgcttgcatatagagaagtcatgatgaattatactttgtcagaaattaaagctatctatacagatacatttgattttagtaaaaaacacccactctatatgacatttaataaatttgacacgcaaaaggaacggggtcaaatgctagctaaattaaaggttttatacgaaatgtttggactaaaaatggttgataatgaattatctgattttctcccattgatgctacagtttttgcaagttgctgattttaaaaatgatagtcgagcacaggaaaaccttcaacttgtcattatgattattgaagatggtacgtatgaaatggcaaataccctagctgaaaacaataatccctatgcatatgttgtcagtgcattaagaaaaacgttaaaagcgtgtatcgtgcctttgaaagaggtggaaaatcatgcttaa

SEQ ID NO: 1016 - DNA, 129 bp, S.epidermidis
ctttatataaacatttggtattggaatataaaatctaataaatatataaaattgaattatcaattattaaaaacaaatacgttacctgagacaattattgttgtctcgggtttttttatctataaatga

SEQ ID NO: 1017 - DNA, 792 bp, S.epidermidis
ttccatataaatcttctaaggaggaacactttaatgaaagcgttaatcgttgatgatgaaccacttgcaagaaatgaattacaatatcttttaaatcttaatgatgctatagatgaaattgaagaagcagaaaacatagaagaaacattggagaagttactctacaacacatttgacttaatattcttagatataaatttaatggatgaaagtggtattgatttagctcaaaaaattaataaaatgaagcgatcaccacatattatctttgcaaccgctcacgagaaatttgcagtcaaagcctttgaattaaatgcaaccgattatatattaaaaccttttgaaaaagaacgtattaatcaagctgtaaataaagttgacatggctaaagataaaccaaaaaacaaagataaaactatcacacctaaatatattgattatagtgatgatgagcgcgctcaaacacatgtacttccaattgaagtggatgaacgtattcacatcttaaatttcacagacattatcgcattatctgttaataatgggattacaacgatagatacaacaaaacaaagttatgaaacgaccgaaacacttaatcattacgagaaaaaactaccttcctctctatttattaaaatacatcgcgctactatcgttaataaagaacatatccaaacaatagagcattggtttaattatacgtatcagctgacgttaacacatgaatttaaatatcaagttagtcgttcttatatgaagacttttaaacaacaactcggtcttcaataa

SEQ ID NO: 1018 - DNA, 123 bp, S.epidermidis
tatgatataaatacatactaccatgatttaatatataaaacattaaatccaaaccgacactctatgcacgtcacctatacatatcaacactatttatatattcttactgacatttcgtggtaa

SEQ ID NO: 1019 - DNA, 1773 bp, S.epidermidis
aaagagataaaagatatcaaagagacgtgtattaatagaagggacgggggatacatggttaatacaaataatcatatttcggaagaattagataaaaatcttgatgaaatggaatttttaaaagcaaatagtgactttttgcgtggaactattgaacaaagtttagctaatccaatcactggatccattacacaagatgatgcaaaactgctaaagtttcacggaagttatatgcaagatgacagggatttaagagatgagcgtcgtaaacaaaaacttgagcctgcatatagttttatgattcgagttcgtgtacctggggggaaagcgactcctgaacagtggattgctatggatgatatctctaatcaatatgcaaatcatacgattaaattaacaacacgccaagcatttcaatttcatggaattcttaaacgtaatttgaaacaatcaatgaaaaatattaatcatgcagtacttgattctattgctgcatgtggagatgttaatcgtaatacgatgtgcaatcctaatccttatcaatctcaagtacataaggagattaatgattatgcaacgcgtataagtaatcacttacttccaagaacaaatgcatatcatgaaatttggcttgatggtgaaaaggttttagattcgagtgaggaaaaggaacctatttatgggaatacgtatttaccacgtaaattcaaaataggtattgcagtaccaccatctaatgatattgacgtctattctcaagatattggtttaatcgctatcgttgaacaagatgagttaattggatttaatgtgactatcggtggcggtatgggtatgactcatggtaatactgaaacatatcctcaacttggacgtctcataggttttatacctaaggaaaaggttgtagatgtatgtgagaaaatacttacaatacaacgtgattatggtaatcgtgaaaatcgaaaaaatgcacgttttaaatatacagtggaccgtctaggagaaacttgggtgactgaagaattaaaccgacgattaggttgggaaattaaagcgccacgtgatttcgaatttgaacataatggtgatcgattaggttggattgaaggtattaataattggaatttcactttatttatacaaaatgggcgtgtgaaagatactgaagactatttgttaaaaacagccttaagagaaatcgcagaaatccatactggagatttcagattatcacctaatcagaacttagttattgcaaatgtttctcctgagaaaaaggaagaaatacaagctattattgataaatataaattaacagatggcaaaaattatacaggacttagaagaaattctatggcttgtgttgctttcccaacgtgtggtttagctatggcagaatctgaaagatatcttccttcactaattacaaaaattgaagatttattagatgagtctggtttaaaagaggaagaaataacgattcgtatgacaggttgtcccaatggatgtgcgagaccagcgctagcagaaatagcctttatcggtaaagcacctggtaaatataatatgtacttaggtggtagttttaaaggcgaacgtctaaataaaatatataaagagaatatcgacgaaaatgagatattagaaagtctacgtccattgttgttgcgttatagtaaagagcgtcttgacggagaacactttggggactttgtaattcgtgacggtgtgatagccaaagttcatgatggtcgcgattttcatagttaa

SEQ ID NO: 1020 - DNA, 627 bp, S.epidermidis
aaagccgtaaatttaatgagagcaaaaaaattgataagtcatcttactgtatctagaataacaagtacaagaaacgtaattattgtaataaagagagaaggggttataataatgacaaaatttaactttgatcaagttcacagtgatattcagtttaaaattaaacatcttatggtgtcccaagtaaaaggaacatttaagcaattcgatgttcaattagatggagatattaatgatttaacttcactaaaagcaacagctactattattccaagttcaattgacactcaaaatgaggacagagacaaccatttaagatcaaacgatttctttggtacagaagacaacgataaaatgacatttgtaactaaagaaattaacgaaaatcaagtagttggagatttgacaattaaaggtgaaactcatgaagagacatttgatgttgaatttaatggtgtaagtaaaaatccaatgaatggacaacaagtcactggttttatcgttagtggaacaattaaccgcgaaaaatatggtattaattttaaccaagctttagaaactggtggcgtgatgttaggtaaaaacgtaaaatttgaagcatcagcagaatttagcatcgacaattaa

SEQ ID NO: 1021 - DNA, 600 bp, S.epidermidis
tttaaagtaaagattcataaattaatattagggggatcacatttgaaaaaggaaaaagttatggactggacgaccttcataggcgtagtcattgtgttactttttgctgttatacctatgatggtttttccgaaagcaagtgaaataatcattaccgatatcaatagtgccatttctaattcaattggatcggtatatctctttatgggactggctatattttgttttgttttatacatagcatttggtaagtatgggaatgtcacgttaggaaaagcgactgacaaacctgaatttaataatttcacatgggcagccatgttattctgtgccggtattggttcagatattttatattggggtgttattgagtgggcattttattatcaagtacctcctaacggtgcaaaatcaatgtccgatcaagcacttcaatatgcaactcaatatggtatgtttcactggggacctatagcctgggcaatatatgtgctaccagctttgccaatcggttatttagttttcgttaagaagaaacccgtctataaaattagtcaagcttgtcgaccaattttaaaaggacatacggataaattatga

SEQ ID NO: 1022 - DNA, 129 bp, S.epidermidis
aaactggtaaagtccgtcaatggaataattatcatcatggttcctaagcaaaaaatctataaagtaattgaaacaattctcaacactttttcgatatatttcttccttattatcgtaatgataatatag

SEQ ID NO: 1023 - DNA, 165 bp, S.epidermidis
ttctcatcaaatacctttagtgattttctactgttaagcacttcgttaaaatcatttatacgtgtcaattttagtactcctccattttttaaaaaattgttttattatcaaattaaactcattcaaatatttgataaatttaatttaaagcaatttgaattatag

SEQ ID NO: 1024 - DNA, 153 bp, S.epidermidis
aaagcatcaaatcaaaaagaacacaatgtcgaatgcagaattataagcattttatatttaattgttattacatcttatgtgtataaaatatatcatttacatgataaagggacagtggtcatgacgacgactgtccctttcttattatattaa

SEQ ID NO: 1025 - DNA, 1674 bp, S.epidermidis
aagaaatcaaaggtggaattatatatgaaacaacgcgtaggacaatatttaatggacgcggtttattcagcaggtgctgacaaagtttttggtgtcccaggagattttaatctagcctttttagacgatattattgcacataatgatattaaatggattggtaatacaaatgagcttaatgcaagttatgctgccgacggatatgcacgtattaatggcatcggtgcaatggtaacaacatttggagtgggtgaattaagtgctgtcaacggaatcgctggatcttatgctgagcgtgtgccagttattgccatcactggggcacctactcgagctgtagaacaagaaggcaaatacgttcaccattcccttggcgaaggaacttttgatgattatagaaaaatgtttgagcctattacaacagcgcaagcttatattacacctgataatgctaccacagaaattccaagagtaatcaatacggcgcttcaacaacgtcgtccagttcacattcatttacctattgatgtcgcactaacagagattgaaatttcaaacccattcaaaccagaagtcgaaccacaaaaaaacgttcaaagttatatcaatatggttcaagacaaacttgaatcggcatcacaacctgtcattattacaggacatgaaataaatagtttccatctgcataaagaactcgaacaattcgttaatcaaactcaaattccagttgttcagttatctttaggtaaaggtgcatttaatgaagaaaatccttattatatgggtatctttgatggttcaatagcagaacaagatattcaagattatgttaatcaaagtgatgctattttgaatattggtgctaaattaacagattctgcaacagctgggttctcatatcaatttgatattaatgaagtgattatgctaaatcataatgaatttaaaattaatgatacatgcatcgaagcattttcattaccaaatatattaaatggtttaaataagtatattcactacaaaaacactaatgatttcccacaatatgagagaccacaatcacacaattacgaacttagtgatcagccattaactcaagagacttatttcaatatgatgcaagattttttacaacaagatgatattttaatcgctgaacaaggtacatcattctttggtgcttatgacttagccttgtacaaagataatacttttatcgggcaaccattatggggatctatcggctatacactaccagcaacgctaggaacacaaattgcaaatccatatcgtcgaaacattctattaattggtgatggatcactacaattaactgttcaatcattatctacaatgattcgtcaaaatttaaaccctgtgatatttgtaattaataacgatggttatacagttgagagaatgattcatggtatgaaagaaccttacaatgacattcgcatgtgggattacaaatcattaccttctgtatttggtggtgacaatgttttagttcatgatgtaaacacttcagaagaactcatgctcaccttcgaaaatattaaatctaatagtgatcgcatgcactttgtagaagtgaaaatggctgttgaagatgcaccagttaaattaagtaatatagctaaagcattcgcatcacaaaacaaatcatcttaa

SEQ ID NO: 1026 - DNA, 126 bp, S.epidermidis
caccgcacaaaatcaataagtgaaaatactaagacgagtaacaatcattttcatattcgtttaataagatgtccgcctaaatatccaaattcaaccctttgtatcattactggacaaaccacttaa

SEQ ID NO: 1027 - DNA, 1113 bp, S.epidermidis
cgcatgacaaatcaaaaaactgtgggtctagtcgtcgctccaggtgttactgaacgccttgcagaaaatctcatacaagaaatgcctaaaatgttatctacacattatgatcatcagcaagaatggatttttgatttagttacggatccgcttactggttttgctgaatctgtagatgaaatttttgggaaagtagccgattatcacgataagagacaatgggattatgtgatagcaattacagatttaccgatgtttgcggacaagcaagtgatggcattagatattaatatggaaaatggtgcagctatattctcatatccggcatttggctggcgtccagttaaaaaacgtttcaagcatgcgatttataatattattcaagaattaaatgaagctgaacaagaaagtcgtaattatgataataataagcaaatagaaaattcagtaaaaaaacaatttccgctctctaaaatagataaagaaacaatatatatgaaagaaacagactcttatcacttaagatatttatcaagttcacgttctagaggcatgtttcgccttgttagtggaatgacctttgcgaataatccattaaatatgatggcaagtttaagtaatatagtagctattgcatttactacaggtgcatttggacttgtatttacaacgatgtggcaaatggcttataacttttcaatgtggcgcttatttggaatttcaattattgcgattattggaatgctaatatggataatgatgtcacatgatttatgggagccagttaataaaagcaaccataagcatattacttggttatacaatcttacaacaataatgacattgatttttgccattataatttattatattattctttatttactattcttaattgctgaaatcgtattattgccatcaggattcttaggtcagcaagttggattgaaaggtcctgcaggcattgatttgtatttaagtattccatggtttgcagcttcaatttctacagttgcaggtgcaataggtgctggtttacttaatgatgaactcattaaagaaagcacatatggatatcgtcagcgtgtaagatacgaagaacaacgtcgataa

SEQ ID NO: 1028 - DNA, 1890 bp, S.epidermidis
acaatgacaaatatcggaataacaaagtataagaggtggataagattgaacttaagtgttaccaatagtccttttacggaagggcaagctaaacaaatcaatgaattgcttcacactttatcacctaaccaacaagtatggttaagtggctatctgatggcaaatcaacaatcaaatacatctacagattctgtagaacaacataacttagatgacaatacagaagcgatgctacatgaaaaggaaccttcagttgagccggaagctagatcgataacaattttatatggatctgaatctggtaatgcgcaaggacttgcagaaatatttgaacaacgtttatctgatattggaaatgacgttacgctcaaatcaatggatgactttaaacctaagaatttgaagaaagtagaagatctatttattatcacatctacacatggcgaaggagatccaccagataacgctgttgaattacatgaatacatccacggacgtaaagcgccaaaattggatggggtgagattttcagtattagcattaggagatcaaacctatgaattcttctgtcaaactggtaaagattttgataaccgtttggctgaattaggggcagaaagactttatcatcgtactgattgcgatgttgattatgaagaagacgctgaaaagtggatggccaatgttattaatacgattgattcaacaccagctggtactgaaagtgaacaagttgttagcgaatctataaaatcagcaaaagaaaagaaatatagtaagtctaatccttacgatgctgaagtattgaccaatattaatttgaatggtagaggttcagacaaagagacgagacacattgagttattacttgataattttggtgaagaatatgaaccaggagattgtgtagttgtcttgcctcaaaatgatccagctatcgtagacttacttattagcacattaggctggagtccagaaacacaagttttaattaacgaggatggagatactttaaatcttgaagaggcattaacatcgcattttgaaattactaaattaacaaaaccgttaatagaaaatgctgcgatattttttgataatgaagagctttctgaaaaaattcaagataaagaatggattcaaaactacgttgagggaagggatttgattgacttattaaatgacttcgcaacgacagaactacaacctgaaaatttacatcaattattaagaaagttaccacctagagagtactcaatatctagtagttataaagcaacaccagatgaagttcacattactgttggagcagttagatatcaagcacacggtcgggaacgttcaggtgtttgttcagtacaatttgcagagagaatacaagagggcgatacaattcctatctatttaaaacgaaatccgaattttaagtttccgcaagatgaatcaacacctgtgattatgataggtcctgggacaggtgttgcaccgtttagatcctatatgcaagaacgagaggaactaggttttgaaggaaatacatggttattctttggagatcaacacttcactacagattttctgtatcaaacggaatggcaagaatggcttgaagatggaactttatcaaaattagatgttgctttttctagagatactgataaaaaagtgtatgtgcaacataaaattgtagaaaatagtgaacaatttaatcgatggattgaaaatggcgctactatttatgtatgtggtgatgaaagtaaaatggcaaaggatgttcatcaagcgattaaaaatgtgttaatcaaagagcaaaacctatctgaaacagatgcagaagaatacttaaaacaaatgaaaagagataaaagatatcaaagagacgtgtattaa

SEQ ID NO: 1029 - DNA, 597 bp, S.epidermidis
aggtcgacaaaaagagatatgtgcaagagtgaaacacatgaaggcacttcgttcatgaatattttaaacattaaagaaggtcaacactatatagctaaaatagaaagtcatagctttgtagatggtgaaggtgttcgatgcagtgtatatgtttccggatgtccttttcaatgtaaaggttgttataacgttaaagcccaaaattttaaatacggagaacctttcgaacttgaaatgcttgaagagattttagattattgtgcgccttcttatatcgaaggcttaagcatacttggtggagaaccattttgtaatttgtttatcacactccaacttgttgaagcttttagacaacgattcggtcatacaaaaacaatttgggtatggactggctttttatttgaatatttgaaacagcaagacgatgcgcgcaagtcattactcgaacatattgatgtattagttgatggtatgtttattcaacatttatatcgtccgaatcttccatataaaggatcacttaatcaacgggtttggtgcattgatgttcaatcttccttacaaaaagaacaggtcattgaatatctaactaaatag

SEQ ID NO: 1030 - DNA, 255 bp, S.epidermidis
aaaaaagcaaatgaagcaacaaatttcaaagccaaaattgaagtcgtttcaacattattcagtactaaatctgatttcactaaaaataactctaagaaagatttattattcttaagtgatgatttatatcattacaaagaaaaacctgaaaacacaaacataactttacaattaagtgagccaaaaattaattctacacgcgcattttatgatgctaataacccattagaatatggagtgcataaacatgagtaa

SEQ ID NO: 1031 - DNA, 696 bp, S.epidermidis
tgtatggcaaaagttaaagagaaagttgcagtcgttacaggtgcgagtagcggtataggagaggcgattgccaacaagttaagtcaacaaggtgcatcaatagttctggttggtcgtaacgaacaacgcttaaacgaaatagtccagcaattaaataacccggctaaagttgttacagcggatgtcactgtaaaatcgaacatagatgatatgttaaaagctgtaatagaccattttggtcatatcgatattgttgtgaatagcgcaggtcaaagtttatcatctaaaattacagactataatgttgagcagtgggatactatgatagatgtaaatattaaaggtacactccatgttttacaagcgacattgccttatttgttaaaacaatctagtgggcatatcatcaatcttgcatcagtatcaggatttgaaccgacaaagacgaacgccgtttatggtgcgacaaaagcagcaatacatgcaatcacacagtctcttgaaaaagaattagcacgtacaggcgttaaagtgactagtatttcaccaggaatggttgatacccctatgacggaagggactgattttggggaacgcaaaaaacttgaagcacagaatattgctgatgctgtagtatatgctttaacacaacctagtcacgttaatgttaatgaagtaacgataagacctgtttaa

SEQ ID NO: 1032 - DNA, 2409 bp, S.epidermidis
agtatggcaaaacaaaaacttgtaatgattggtaacggcatggcagggttaagaacgatagaagagattttagaacgttcacaatcacaatttgatattactattattgggaaagaaccttatccgaactataacagaattatgctatccaatattttacagaagaaaatgactgtcgaagatacaattatgaatccttatgattggtatcaagagaataatattgaacttataaataatgatccagtggaaaaagttgataaagaaaacaaaatagttactacttctaaaggtattgaagtagagtatgacatttgtattttcgctactggatcaaaagcttttgtgttacctataccaggttcaaaccttcctagtgtcattggatggcgaacaattgatgatacaaataaaatgattgaaattgcccaaacgaaaaaacgagcagttgtcattggtggaggtcttctaggcttagagtgtgccagaggacttctagatcaaggaatggaagtgacagttcttcatttagctgattggctcatggaaatgcaattggatcgtaaagctggagaaatgcttaaagcagatttagaaaagcaaggtatgaagattgaacttcaagcaaattctaaagaaatcattggtgataaagatgttgaagccattaaattagctgacggtcgggtgattgaaacagatttagtagttatggctgttggtatcagaccttatactgaagttgctaaagatagtggattagatgtcaatagaggtattgttgtaaatgattatatgcaaacatctgattctcatatttatgcagtcggtgaatgtgccgaacatgatggtaaagtttatggattggtggcgccactttatgaacaaggcaaagtgctagcagattatttaactggtaaagaaacaaaaggttataaaggatctactactttcacttcacttaaagtatctggttgtgatttatatagcgcagggcaaattgttgaagatgaagatattcatggtgtagaaatttttaatagtgtagacaatatctacaaaaaagtgtatttaagtcatgggcaagtcgttggtgctgtcttgtatggtgatactgatgatggatcacgattttataatatgatgaaaaaacatgaaacgcttgaagattatacacttgtttctttattgcataaaggtgatgaagatgcggggacatctatcgctgatatgtctgatgatgaaacgatttgtggatgtaatggtgttgataaaggaacaatcgtcaatgctataacaactaaaggtttaacgtctgtagatgaagtgactaaagcaacaaaagcaggtaattcatgtggtaagtgtaaaggtcaaataggtgagttattacaatatacattaggtgacgactttattgctgcaaaaccaacaggtatttgtccatgtactgatttaacaagagaccaaattgtaactcaaataagagctaaaaatctcaaatcatcaaaagaagtacgacacgttcttgatttcaaagataaagatggttgtcctaaatgtcgacctgcaattaattattatttaaatatggtttatccttttgaacatagagacgaaaaagattctcgcttcgctaatgaaagatatcatgcaaatatacaaaatgatggtactttctcagtgattcctcaaatgcgcggtggtgttacagatgctgaccaacttattcgattaggagaagttgctaaaaagtataacgtaccacttgttaaagtaacaggttcgcaacgtgtaggtttatatggattgaagaaagaagaattaccacaagtttggaaagatttaggaatgcgttctgcttctgcttatggtaaaaagacgcgttctgttaaaagttgcgttggtaaagagttttgtcgttttggtacacaatacacaactcgactaggaataagacttgaaaaaacatttgaatatattgatacacctcataaatttaaaatgggagtatcaggttgtccgagaagttgtgtagagtctggtgttaaagattttggcgtcatatctgttgaaaacggctaccaaatatttatcggaggtaatggtggtactgatgttactgtaggtaaattgttaacgacagttgaaaccgaagatgaagtgattcaattatgtggtgccctcatgcagtattacagagaaacaggtgtttacgctgaaagaacagcaccatggttagaacgtatgggctttgaaaatgtcaagaatgtcttattaaatcaagaaaagcaaaaagaactgtattcaagaattatggaagccaaaaaagctgttgagaatgaaccatgggaaactattgttgaaaataaagaagcacaaaaaatctttgaagttgagaaggtgtaa

SEQ ID NO: 1033 - DNA, 339 bp, S.epidermidis
agcattaaaaagaaagaaaggtggctatgctacatggtcaagcccagacagaggcaatatccaacggtaacctcttatttaaatatagttagggagagcttatttattactatatccggagtattttggatgtattgtatcgttgtgatgattgtttatataggaactcttatcaattctcaaatggaaagtgttataacaatacgtattgcattaaatgttgaaaacacggaaatttacaaattattcggatggatgagtttgtttgtacttattatatttatcttttttacatttagtctcgcgtttcaaaaatataagaaaggtcgtgacatatga

SEQ ID NO: 1034 - DNA, 447 bp, S.epidermidis
atgtctaaaaataaaaatgattacgaacatatgctgttttacttcgcgtataagacttttattactacagcggatgaaattattgagcaatatggcatgagtcgccaacatcatcgattcttatttttcattaataaattaccgggtataacaattaaagaacttttgattacgcttgaaatatctaaacaaggatcgcatgcaacgttacgtaaattaaaagaagaaggtttaatcgtcgaacaaacatctaagcaggatagacgagtaaaaaaactttttaccactgaagcgggtgatgatttaataggtaagttaaaccaagcacaagatgaattaattcaacagacactacaaaaagtaggccatgattggtacgcgatgatggaagaactagctaattatcgtgaaggattcaaaacaattgaacatttgaaagaagattaa

SEQ ID NO: 1035 - DNA, 927 bp, S.epidermidis
aatatgaaaaaattttggggaattttattaattgtgatgtcaattgctcttgtgggatgttcgaatagcaatgattcagatcaatcttctaatgaaaagtcatcatcaaaaagttcggagaaaaaaacggatgtggcgactgaatatacaaaagaggacgaatataaagaactagaaaaagaagctaaggatcttaaacaaaagccagttcttaatgaaatcgatgcacttattacagaaaaaggttttacaaacaaaacgggattgcaaggctgggaagactataaaaaattagtggataaggtaacacttgcagattataaatacacaaaagaatctaaagggtcatctatagaagaagttaataagttctttaaagataaaaaaggtgtagagattaaacgaatgaaaagtaaggaaaaaaatattaagcatatcaattatatgtatgtagatccagatggtaaaaaaacaggtgaaaataagcaacctatgtcctacgctcaaatacttgcaacatttaaagaaggtaaattagtagctacaaatattcaacctggattttttgctttagacaaaaagaaaatggttaaagctaaagacttagaaaaagttaagacattggaagatttaacgcgtttgaaagatcctaaagcgacatcatatggtattttacagacgaaatataaagggaaaccatacactcaagtttcaatattaggcagtgattctgatgaagagaatgatatttcctcagccatcttagcttattatctattttcaccaacggaattagatagtgacgataatcataaatacgttgaagttgcatcagcgccattcttaagtgctcaaaacgatttttcatcttatcaactaggcgtatttaaaaaaattatcgaaagtagtatgtcgttcgatgaataa

SEQ ID NO: 1036 - DNA, 549 bp, S.epidermidis
ggagtgaaaaatatgtcgaatattaatattagagtggcacatgaacaagatgctgaagaattacatagcatcatgcaaattgcttttacacctttaagagaactaggtattgattggccatcagttcacgctgatcttgaaatggtaaaggataatttaagacaaaatactacatttgtacttgaaaatgaaaaagaaattatttcaacgattacggtttgctatgcatggagtagtgtaaaacccatttcaggttatccgttcgtttggtggtttgcaacacgaccaacttatgatggacaagggtatgggagtcaacttttaaaatatgtagaggagacatttttacgcgatactttaaaagctgctgcggtaaccttaggaacatcagcacgtttgcacccttggttattaaacatttacgaaaagcggggttatgaaatatacgctaaacatgaaaatgatgatggtgatttaggagtcataatgcgtaaaattttaataccagaacaatttaatgatgacattttgggccgaccgccattttag

SEQ ID NO: 1037 - DNA, 1269 bp, S.epidermidis
aaatttgaaaacttactcttcacattgagacgatttttttataatatatcactcatattgatttttgatattaagaaaagggaggaaacactcatgaaagataataaaatgttgttcattatttttatgataggaacatttacagtaggaatggctgaatatgtagtgacaggattacttacacaaatcgctgacgatatgaaggtttctatttcgagtgcaggtttattaattagtgtttatgctattagtgttgcattgatagggcctttaatgcgaatcataacattgaaagttcacgcccaccgtctgttaccaattttagtagcgatttttataataagtaatttagtgggaatgttagcaccgaattttaatgtattgttattatcaagactcatgtctgcggcaatgcatgcgccattcttcggtgtgtgtatgagtgttgctgcgacagtcgcacctcctgctaaaaaaacacaggccattgcacttgttcaggcaggtttaactattgctgtaatgttaggtgtaccattcggatcatttttaggtggctttgcaaattggagagttgtttttggatttatgattgtgttggcaatcattactatgttaggaatgattaaatttgttccaaatgtttctttaagtgcagaagcaaatattagcaaagaattaacagtgtttaagaatccacacattttaattgtgattgcaattattgtgtttggttactctggtgtgtttactacttatacatttatggagccaatgatacgagatttttctccatttaaaattgtaggtttaactgtttgtttatttatgtttggtctaggcggtgtgatagggaatttaattactggtaatgtaccggaagataaattaacaaaaaatttatacctcacatttcttttactatttgtaacaatcatactatttgttactgttattcaaaattcaatattagcattaatcatttgcttcttattcggttttggtacatttggtacaacaccgttacttaatagcaaaattatcttaagtgcaaaagaagcaccacttcttgcaagtacgttagcagcttctattttcaatgttgctaattttcttggtgcaatcattggatctatattattatcaatagggttaccttacattcaaattactttgatatctggtggaattatagtgttgggtatgcttcttaatcttgttaatcaactttatgaaaagaaacatatcacatttaatgaatattcatga

SEQ ID NO: 1038 - DNA, 933 bp, S.epidermidis
gacaaagaaaaatgtaggatacagggtttgagacatatgaagtttgcatatattcaatcgattcgtaatgagatttcaattattttaataattctattattttttgcacttatattttatgtgttttctttaccttttgatgcatacgtactagcaatcagtataatattactattgatgtgtgtacgttggtggataaagtatttaagttttaaaaagaatgaacatcttaaagataaagtagcatatttagaacatgagttagcacatgttaagaatcagcaaattgaatatcgtaacgatgttgaaagttattttttaacatgggtacatcaaattaaaacacctatcactgcctcacaattacttttggagagaaacgaggagaatgtagttaatcgtgttcgacaagaaattgtgcacattgataattatacaagtctcgcattaagttatttaaaattattaaatgaagagtcagatatgacaattaccaaagtgacagttgatgatttgattcgcccgttgattttaaaatatagaattcagtttattgaacaaaagacgcaaatccattatgaaaaaagtgaggacattattttaaccgatgcacaatgggcttctataatgatagagcaacttttaaataatgctttaaaatatgctaaaggtaaagatatttggatagattttgatgttgccaatcaaactctacagattaaagataatggtattgggattagtaaagcagatattcctaaaatttttgataaaggatactcaggatttaacggtagattgaatgaacaatcaactggtataggtctatttatagtgcaacacattgcaaatcatttaaatatacaagtaactgtacaatcagagttgaatcatgggacagtattttttatacattttactaaagaaaaataa

SEQ ID NO: 1039 - DNA, 1665 bp, S.epidermidis
atggcggaaaaacaatattctgcagcacaaatggtaattgatactttaaaaaataatggagttgagtatgtatttggtattccaggtgcgaaaatcgactacttatttaatgcactagaggatgacgatattgaattagtcgttacgcgtcatgaacaaaacgcagcgatgattgcacaaggtattggtcgtttaacaggaaaaccaggtgtggctattactacaagtggcccaggggtaagtaacttaactactggtttattaactgcaacttctgaaggtgaccctgtattagctatcggtggtcaagttaaaagaaatgacttattacgtttaacacatcaaagtattgataacgcatcattacttagatcctcaactaaatatagtgcagaagtacaagatccagaatcactatcagaggttattacgaatgcaatgcgtacagccacttcaggtaaaaatggagcgagctttatcagtattccacaagatgttatttcatcacctgtcaaagctgatgcaatttcattatgtcaaaaaccacatcttggtgtaccttcagaacaagaaattaatgaagtgattgaggctattaaaaattctaaattcccagtattattagctggaatgagaagttcaagccaagctgaaacagaagctattcgccgtttagttcaaaaaacaaatttacctgttgttgaaacattccaaggtgccggcgtaattagtcgcgaattagaaaatcacttcttcggtcgtgttggtttatttagaaaccaagtgggtgacgaattacttagaaaaagtgatttagttatcacaatcggttatgaccctattgaatatgaagcaagtaactggaataaagaattagatactaaaatcatcaatgtcgatgaagaacatgctgaaatcactaattacatgcaaccagttaaagagttaatcggaaacattgcaggtacaatagatatgatttctgaacatgtaaatgaaccatttattaatcaagatcatttagatgaacttgaaaaattaagaggcgaaatcacagaagcaactggaattaaagcaactcacaaagaaggtgtgatgcacccagttgaaatcattgaaacaatgcaaaaagttttaactgatgatactactgtaactgtagatgtgggaagccattacatttggatggctcgtaaatacagaagttacaatcctagacatttactatttagtaacggtatgcaaactctaggtgttgcacttccatgggctatttcagctgcacttgtacgtccaaatacacaagttgtttctgtagctggagacggtggtttcctattctcaggacaagaattagaaactgcagtacgtaaaaacttaaatatcattcaattaatttggaatgatggtcgttataacatggttgaattccaagaagaaatgaaatataaacgctcttcaggtgtagaatttggaccagttgattatgtaaaatatgcagaatcatttggcgctaaaggattacgtgtgactaatcaagaagaattagaggcagcacttaaagagggttacgaaactgatggaccagtattaattgatatcccagttaactatgcagataatgttaaattatctacaaatatgttaccaaatgctttaaattaa

SEQ ID NO: 1040 - DNA, 1206 bp, S.epidermidis
ttaattggaaaaggagatttgattataatgtctaacaatgaaacaataaccaattatacaattaaacctcatggaggagaactcatcaatcgtgttgttgaaggaaacgaacgtgaacgtttgattgaggaagcattaaaatttaaaccgattactttaaatccttggggaatatcggatctagagctcataggtattggcggatttagtccccttacaggatttatgaacaaggaagactacactaaggttatagaggaaacacatttaagcaatggcttagtttggagtattcctatcactttacctgtaacagaatccgaagcagataaacttgaaataggtgatgatattgctttatatggtgaagatggtcagttatatggaacgcttaaattagaagaaaagtacacatatgataaagaaaaagaagcgcgtttggtgtacggaactactgaagaagctcatcctggagttaaaaaggtttatgaaaaaggtaatatatatttaggtggtcctattaaactattaaatcgtccaaaacatgacgcgttttcaaattatcatctggatccttcagagacgagacaattatttcatgatttaggttggaaaactgtcgtaggttttcaaacgagaaatccagtgcatcgagcacatgaatatattcaaaaatcagcactagaaattgttgatggtctacttttaaatccactagttggtgaaacaaagtcagacgatattccagcggatgtacgtatggaaagttatgaagtgatattaaaaaactattatcctgaagatagagcacgtctagtcatttatcctgctgcaatgcgctatgccggaccacgtgaagcgatacttcatgcaactgtccgtaaaaattatggttgtacacattttattgtgggaagagatcacgctggggtaggcgattattatggtacttatgaagcacaagagctgattactcaatttgaagatgagttaggtattcaaattttaaaatttgaacatgccttttattgcgaagcttgtggtaatatggcaactgctaaaacatgtccgcatgacgcttctcaacatttacatttaagtggtactaaagtaagagaaaaactgcgtaatggcgaatcattgccaactaaattttcaagaccagaagttgccgaagttctaattaaaggtttgcgagaaaaataa

SEQ ID NO: 1041 - DNA, 696 bp, S.epidermidis
ggagagtgtttaatgatggctaaaagctatgattatcaaagtgctttcgatattattggaccagtaatgatgggaccttcaagttctcatacagcaggtgcagtaaaaattggtaattcagcgagagctgtgttaggagatatgcctaagcatatagaaattcgttattatgaatcttttgctaaaacgcatcaagggcatggtacagacgttgctattgtcggtggtgctatgggctacagcactttcgatagtagaattaaatcatccttagacatagcaaaagatgaaaatattacaattgatattattgaagatgaaggagaaagtattggtcaacatcctaactgtgcttatatcaaagcaaatacgaaagacggacgttatatagaagtgataggtatttctattggtggcggtacaatcaaactaaaaggtatcaatgtaaatggtttaaatgtggaactgaatcatgggcttccaatgttagttatagatggaaatatgaataaagctaaaataaatcatcttattaatgatttatcagatatggacttagacttaggtgaagaattaatagaaacaaatgataatgaaggtttagttgtatttcctttaaataaagcaatctcagaatcagcattaaatattattaaagataaacatagtgatttaaacgtttcctatatcaaatag

SEQ ID NO: 1042 - DNA, 1074 bp, S.epidermidis
agaagtttgaaattatatggtcgtgatattgatcacaactcaccattctataaaggaaataaaagtgttcgcgaaggagatattgtaaaacaagataaactcgctaatacattaactaaaatcaaagataaaggtcctgattacttctatgaagatattggtaaaagtgtttcaaaacaattagataataaattaactgaaagagatttcaaagaatttaaaacagaagaaaaagaagcggtaagtactgattataagaataatcaagtgtattcagcacctaatcctttaggaggcacattaatgcttcaaggattgaaaattgatgaaaaagaaaatgtagacaatatggatcgcaataattttatcacagcaatgattaaatcacgtgatgttatgtataagaatagagacattgttaatggtaatgagcctagtaatgaacaacatctgactgatgattatttacttggtgaacttaacaaagttaatattggtgaaaacacagataatggcagtgattttgatcaaattagaacggataatacaagtacaacccattttgtagttattgataagaatggtaagttagcaagtacgactaatacactatccagttactttgggacaggagactatatgaaagagggattctatatgaataactctttaggcgactttagtaaggataaatcaagtcctaatcatggtgaacctcacaaggcgcctagatcatttatttctccgtcagtaattgttggccctaatttctatatgggtattggtacaccaggtgggaacaagattccaacaattcttaatgaagtgattgtcgattatttaaacagtgatggttcattacaagaatctattaataaaccaagattttataatgacggcggcacgatattttacgaaaatgctatgactgatgaagatataaatatctttaaaagtcttggttatggtgttgaagaaaagcataatgatccaaactttggcagtgtccaaggtgctgtttatgataaagataaaaatactgtagatgtcggtcatgatgtaggtaaccgttaa

SEQ ID NO: 1043 - DNA, 243 bp, S.epidermidis
ttccaattgaaccccaataagttttttttctttttttttgaaagcctttggggggctaataaaaagggtaataaaaagggggtgatttccggtgctttttttttttattccataaagccatacctctccaatagtacaactgaaggggatcggtgggtttttcaattgttaattggcgcaataagtcggtgccggaaaccagtggggccacttgctgataaattagggtcgtcaacggtctag

SEQ ID NO: 1044 - DNA, 825 bp, S.epidermidis
aatgaattgaaaactttaaatcatttaaacaaaatgaaggcatcacagcaaaagatttctatggttacagcttatgattatcctagtgctaagcaagcacaacaagctgaaattgacatgattttggtaggagattctttaggaatgacagtgttaggatatgatagtactgttcaagttacattgaacgatatgattcatcatggtaaggctgttaaaagaggtgcttcagatacatttatagttgttgatatgcctatagggactgttggtttaagtgatgaagaagatctaaaaaatgcacttaagctttatcaaaacacgaatgctaacgctgtcaaagtagaaggggctcatcttacatcatttattcaaaaagcaactaaaatgggtatacctgttgtttctcacttaggtcttacacctcaaagtgtaggtgtaatggggtataaacttcaaggggatacaaagacagccgctatgcaacttatcaaagatgctaaagctatggaaactgctggtgcagtagtactggttttagaagccatacctagtgatttagctcgagaaattagtcagcaactcactattccagttataggtataggggcaggaaaagatactgatgggcaagtgttagtgtatcatgatatgttaaattatggtgttgatcgacacgctaagtttgttaagcaatttgcagacttttcaagtggtattgatggattaaggcaatataatgaagaagttaaagcagggacgtttccttctgaaaatcatacttacaaaaaacgtattatggatgaggtagagcaacatgactaa

SEQ ID NO: 1045 - DNA, 519 bp, S.epidermidis
tacattatgaaaaggtttgcaaaagcatttgtcgtaagtggtattactttaggtgcagttttaggtttaaacgtaacagagcataatggtgtatctaatgaagcaaaggcacaaacagcacacagttactggtataaatataatggttatactgcatcgggtggcgactttgtacttagcaattcattttatcaaggtttaaaagctggaaacgttacatttaatggtattaaggtaaatcaaaaatatgaatctaagactgctactaaaaaaatatacgatcagacatttcaacaaattaatggaaataaagcaaacaacgtacaatttaaaattgcttccagaactgttactttagatcaagttaaacaaaagtatggaaaaaattataattatcagccgtcattatctaaaaacaaaacaagtaagacagatggcttgtacggttatcaagtcggaaaaggaaacatcgttttccacgttaaagatgggtatgtcacaagtgctacattgtcataa

SEQ ID NO: 1046 - DNA, 672 bp, S.epidermidis
acatatatgaaaattttcattgtagaagacgatttagtgattgctgaaagtttagctaatgagctatctaaatggaattatgaggtgcatgtggttgataattttgaaaagataatggaagattttcgccgagtagaaccacaactcgtattattagatatcaatctaccaacacttaatggcttccattggtgccaagaaatgcgaaaagtatctcatgtgcctattatgtttattagttcaagaacagataatatggatcaaattctggctatccaaatgggtggcgatgattttatcgagaaaccatttaacttgtctttaacagtagctaaaattcaggcactattgcgtcgcacttatgatttatcaatagctcgtgatgaaatagctgttaaaggttgtaaactaattgttgatgaggccaagcttagcaaggataatgaacatgttcaactttccttaacagagctacagatattaaaattgttatttcaaaatgaaaataaatatgtaagtcgtacagctttaattgagaagtgttgggagtctgagaattttattgatgataatacgctcgcagtaaatatgacacgattacgaaaaaaattactttctatcggtgtcgatgatttaattgagacaaagaaaaatgtaggatacagggtttga

SEQ ID NO: 1047 - DNA, 696 bp, S.epidermidis
tcactcatgaatgaatacttacaagcagttctaatgattttgttaactattgttctgtactatgtttccaaaaagattcaagataaatacaataatccactattaaatccagctcttattgcatcaattgcaataattattgttttattggtttgcggagtaagctataaggggtatatgaaaggtggtacctggattaaccatgttttaaacgctacagttgtatgtcttgcatacccactttatcaaaataaaaagaaaataaaaaaatatttaacaattattttcacaagcgtgttgactggtgtagttctcaattttgtgttagtatttacaacgttgaaaatctttggttattctaaagacacaattgttaccctgttacctagatcaattacagcagcagtaggtatagaggtttctcaagaattgggaggaacagatacaattactgtgctctttatcataactacaggtttaatcggcagtattttaggttcaatgcttttacgtatgggaggttttaaatcttccattgcgcgaggactaacttatgggaatgcttctcacgcatttggtaccgcaaaagcattagagcttgatattgaatcaggagcgttcagttcaattggtatgattttaacagcagtcattagttctgttctcataccagtactgattttattgttttactaa

SEQ ID NO: 1048 - DNA, 1350 bp, S.epidermidis
gagttaatgaaacaatatgatgtagtatttttaggaagtggtcatgcagcttggcatgctgcgttaacattaaagcaaagtggtaagcaagtagctatagttgaaaaagataccatcgccggtacatgtactaactatggttgtaatgcgaaaattttattagagggaccttatgaagtgcttgaagaagccaaacaatatcctaatattattgatagtcacaatttagaagtgaattggaagaatttaatgcgttacaaagaaaaagtcattaatcctatgtctgaaaccctcacatcgatgtttgaacaacaggaaattgatgtaatcatggggaaaggtaaactggtagatgctcatacaatagaggtaaataatacaactttacaatcagattatattgttatagccactggacaacatagtcatcaattagatattgagggtaaagaatatacgcatgatagtcgggaatttttatcaatgcaatctttaccggatagtatcacttttattggagcaggtattatcagtattgaattcgcttctatcatgatcaaatctggtgtagaggttaatgtgattcatcatacaaatcaggcacttgaagggtttaacgaatcacacgtcaataaattaattcaaaagttaaaagatgaaggtgttaaattttactttagtgagaataccaagtcagttaaaccgaatgcgcaacgttttatagtagaaactgagtctggaaaaatgattgaaacagattatgtactggatgcaaccggtagaaagcctaatgttcagcaaataggtttggaaaaagtgggtatacaatttagtgatagaggtattgaggttgacgattatttaagaacaaatgtgaaaaatatatacgcaagtggggacgttatcaataaaatgattcctaaacttactcctacagctacatttgagtctaattatatcgctgcccatatccttggattgaatacagatgctattcagtatccaccaataccttcagtgctttattcattgcctcgtttatctcaaataggtgtcacagttagcgaggctaagaaagatgatacgtatatgattaaagatataccattcggaagacaaatggtatttgagtatcaaaacgaaacagaagctgaaatgtcaattgtattagatagtcacaaacgtttagtaggagcagagatttatggtaatgacgctggtgatttggttaatctcctagtttttatcattaatcaaaaacttactgcacaagacttaaataaaaatatttttgcatttcctggagcttctagtggtgttatagatttattgaaattggcgatgatgtag

SEQ ID NO: 1049 - DNA, 1146 bp, S.epidermidis
attaaaatgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttttaggaattggtggcgcatttttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagtaccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataa

SEQ ID NO: 1050 - DNA, 468 bp, S.epidermidis
attgaaatgaagggatgtcttatgttaattagcgatacaaataaaacatatataatagaagaaactagtaattcattcacaattgaaaagaataatgatcagcagcactacgaagtattagaatcaatcaacagcttatctaatgattcattttgtgtgttaaatcacttattcgtcaatggaggtaatgaagaggtttttgagtcacggtttttaaagcgaaatcaacatttgcaagatgtgcctggttttaaagcgttaagatttcttagaccggtagtcaaagggagacattacattatcatcacgctatggaacagtagacaagctttctatgattggcaaaattcacaagcatatgcgcaaactcataaaaaacgtggaactcaaaaaggtgttgatcatcgtatagtcaatagagatttatcctataatataagaatagagttagaaagtcttaataactaa

SEQ ID NO: 1051 - DNA, 174 bp, S.epidermidis
ctagaaatgaaaaactatagtcatagaaaattggctgtagaacctatttggggatttatgaaggttattttgggtttcactcaagtgtcagctcgatctataaataaagtcaaagggaaaaaatttttattaatggtgcttaatattaagaaaaatagcgactcagagatttga

SEQ ID NO: 1052 - DNA, 1617 bp, S.epidermidis
aaagggatgaataaaaatattaaaatgaaaaacaaacgaaaaataaacaatacgcttgtttatactatctctgttttaattattgttgttattactcttattgcgggtatctttcctaaagcatttgggatgtatgcgcagagcgtttatgattggattacaaattggtttggttggctattccttatcattgtctttattttagatgtatttttaatattcttagctttttctagatatggtcgatttaaacttggttcggatgaagaagaaccagaattttccatgctatcttggattggcatgttattttcagcaggtcttggcgtcggtatagtcttttggggtgttgcagaacctttaacgcattatctccattcacccttccctggaaaaattgcagatcactctgaagaatcagcacgtgttgcgatgggatatacattcttccattggggtatttcacaatggtcaatatttgcaatttcaggattaatcgttgcatactttcaatttagaaaacaacgtaacgggcttatttcaacagctatggaacccgtttttggtgaagcttataaacgtcctttcaggaatattattgatatattagctattatcgcaaccgtcatgggaattgctacgtcgattggtttgggaattatgcaaatcggtggtggattaaaccatctctttgatgttcctaataataatttcactaaaatcttaattactattttgatggtagccatatttttaggatcttcattaactggcttaaatcacggtgtaaaatggttaagtaatttaaatattttattaggtgctattttacttatatttattttgatttttggagatttaaaatttattttagaatcatacacactagcaatttctgattatttgcagcattttatagaatatagtttacgcgtaaatccatactcaggagatgatagttggattcaacagtggactgttttctattgggcttgggttatttcttggtccccttttattgggggctttgtagcaagagtatctcgaggacgtacaattagagaatttgtcgtaggtgtactcattattcctcctctaatttcgtttacatggattgcaggttttggaggtacagctattaaacttgctttaaatcataacgacaagcttgttcatattgtagataaagattatactgttgccttgtttgaattattatcacattttccattgtcggaagtcactagttccttagctattgtacttattttcatctttattgtaacaagtgctgattcaactacgcatattgttgcaggtatggctacaggtggttctatcaatccaactttaaaacataaagtcctatggggtctacttattggggcgatttcagttgctatgacaattgcaggtggtcttaaaagtttacaaactgcatcagttattacaggtctaccattctctatcattttattattaatgatattctcactcatgagggctttaaaaagagaacccatccatcattttaaaatgacatcaattgatgatgaaaaagattactctatttcattagaagagcgtgaaaaacaggacgaacaagataacaagtaa

SEQ ID NO: 1053 - DNA, 1494 bp, S.epidermidis
acgatggtgaaagaagtagttctaggaattgatttaggcacaagcgcaataaaaattattgctgttgatcaactaggaaatgtcattgaatcagtaagcgaaacattaaagttataccaagagcatcctggttatagcgaacaagaccctaatgaatggtttgaggctactaagaaagggataaaagaattaattcaatcaacagaaatgtcagataagatagtaaaggggatttctttttcaggtcaaatgcatgggttggtcatagttgatgataatggcattcctttgagaaaagcgattttatggaatgatactagaaattcaatacaatgtagacaaattgaagatatatatggtgaaagattgaattacaatccgatattagaaggatttacacttcctaaaatgttatgggtacaacaacatgaacctgaaatttggaatcgagttgatgtttttatgttgcctaaagattatttacgttattgcttaacgcagacaattcatatggaatatagtgatgcatgtagtacattattattcaatcctgagaattatgaatggacaagagatgttggagatacatttaacattggtgatatctatccacccttagtaaaatcacattcgtatgttggaaatgtaacttcatcactggctaaagaattaggattatctagtgatgttgctgtatatgctgggggtggtgataatgcatgtggtgcaattggtgctggtgtcatccatgataaaagtgcattatgtagcataggtacttcaggtgttgtattaaatgttgaataccaacgtgtgacctcatatgatagtaatttacacttattcaatcatagtgttccagatacttattacgcaatgggagtaacgttggcagcaggctatagtttaaactggttaaaacaaactttttttgaaaatgaatcttttgaagagattttaaatttagctgcatcttcaaagataggtgccaatggactactatttacaccttacttagctggagaacgtacgccacatggtgatgctcaaatacgtggaagttttataggtatcagtgggcaacatactaaagctgactttgcgagagcagtaatcgaaggcataacgtattctttatatgattctataaagattatgagacgagctggtcatgaaatgaactctatcacttcaatcggtggtggtgctaagagtagattttggttacaacttcaagctgatatttttaatgtgcaaataaaaagattgaagcatgaagaaggcccaagcatgggagcggcaattttagcggcatacggtctaggatggtttaaaacaattgagtcttgtgtagaggcatttattaaagtagacgaggtgtttgagccgaataatgaaaatcatgacctttatgaacaatactattcagtttatgaagctatatataaacaaacgaaacagcttactgctgatttgttaacgataacgaattaa

SEQ ID NO: 1054 - DNA, 138 bp, S.epidermidis
actaatacgaataaagtcagtaatcactgtaatcaagatattatttatcattatttcgatttacttaacctatatcattacatcacaatatcacttggtattgttgcgaataaaataaaaaagactttacttttctaa

SEQ ID NO: 1055 - DNA, 1101 bp, S.epidermidis
ttaatcacgaacaaggagcgcgtactaatgacaaagaaaaaacgtttatcgcctagtgagtggttgcttaaacaatctaaaagacataaaaggaaaaatacactttacacggcaattgtacttttagtagcgttagttctactcatatttgctgttaaatcaatacaagtagaacctgtaaaaagtgatacgagagacaaagatagcattcgtatcacctatttaggtaacgtcactttaaataaacatattcgacaaactaacttgaatgatgtttttaaaggtattcaagatactttagatcatagtgatttttcaacaggttcattaatagtaaatgatttttcaagaaatcaaaaagataacataaataaaaatattgaaaatatcatgtttctacgcaagcataatgttaaaagtgttaacttaatcaacgaatctatggataatattcaagcgacagcaatgatgagaaaaatagattcccaagcaggttataattttttaacaggtaatggttcaaatccaattaatagtaaaactgtacaacaagacattaaaggtaaaaaaatagctaatgtttcatttaccgatatcgaatctaactatactaactctttaaaaaacacgacgtcaattagtttagatccagctatattttatcctttaataaaaaaattaaaggaaaataatgattacgtcgtagtcaatgtagattgggggatacctaatgaacgaaatgtgactacacgtcaaaaagaatatgcacatgcgttagcgaatgctggtgcagatgtcattattggtcataatacagttattcaaaaagttgaaaattataagcgaacgcctattttttatagtttaggtaacacaacgtctgataacttcttatcaaaaaatcagaaaggaatgattgtacaacaagactggaaaggttcgcataatcagttccatatcacaccaattcaatcaaaagatggaaaaatctctaaagataatatgaataaaatggatcatattcgattcaaaaataacattaaagataaatcaattgatttaaaatctgatcaaaatggaggttatacttttgaatattaa

SEQ ID NO: 1056 - DNA, 420 bp, S.epidermidis
gaagggacgaataagatgaagaaaacagcagtattaaatagtcacatttcaagcgcaatctccacactaggtcactatgatttattaacgattaatgatgcgggtatgcctatacctaatgatgacaaacgtatagatttagcagtgactaagtcattgccatgtttcattgatgtgttggagacagtgttaactgaaatggaaatacaaaaaatatatttagcagaagaaattaaaactgcgaatgcacagcaattaaaagcaattaagaaattaatcaatgatgatgtagaaattaaatttattgcgcattctgagatgaaagaaatgttaaaatctcctttaaataaaggaaatatacgtactggtgaaatcacccctttttctaacattatcctagaatctaatgtgactttttaa

SEQ ID NO: 1057 - DNA, 900 bp, S.epidermidis
tgtattaagaataagaggatgtatatgattaagcaaaattttacaactaaagtttatccacttaaacaatttgagggagagtatagtgaagttgcctacgcaggagatagccaagctgatgatgtgattgtatttattcatggtgcactcttaacatataaaattatgacgatgttcgagccttacttcagagattacaaattaatatttattaattgtccaagtcgtggtaaaagttcagatttagatcgtgacacacatacattagatgattacgctgcacgtatatatgatgtattaacgcaaattgttaaggagcaacaaataaaagaactgagtattgttggttattcaatgggtggaatgattgcgacacgattacttaagtacaatacattaccagtctctcatcttatttatttacatagcgcagcgaaaattactccagatgcaagtatgttagcacgattattcactagtgagagtaagagagcagtgttaaaagatgaaattaaggcagtaaaaaatcttcctcaatatatactagataaaacgatttatgcacaaaaggaaaacgcacttgatttggtacaatttattgcaccaattaaaactataattacggatatgatctacacgattaatacagattatttaccagatatcgatgagattaaacaatttccgaaaatattatttatgtctggaaaagaagatcaaattattccttatacggattctcaagctacgttagaaaagtttaaggcgttaggtggaaaaactaaagaagttatttatccaggaattggtcatatcgatttcccaagtgttttagaaacccaatcagatggacaaactggcgtggtagatgaaattaaagcgtggatttcaaaaaaataa

SEQ ID NO: 1058 - DNA, 213 bp, S.epidermidis
ttcgctaagaaagaatataaaaaatcctccaacgaagttggctcgacttcgttggaggtatcaggggtaggggttaattttgtttctaaatttatttactctaatttaatattaattaaggttttgagtatagggagaaatattttatacttatttattttctcttcatcatttttatattttacagggaaagtattttatttagattcgtaa

SEQ ID NO: 1059 - DNA, 126 bp, S.epidermidis
atttttgagaaaaaattagttgaaattaaacgactttatagatgtaatatgacgagaagatgggtgaaaagagtattatttttaatagatttgattctattagacgtctatacaataatcgaataa

SEQ ID NO: 1060 - DNA, 870 bp, S.epidermidis
gagggtgagaaaatgaatgaacaatggatgagcgcattgccacttgacaatgtgaaagacatttctccagtaagtggcggagatgtaaatgaagcatttaaagtcactacagttgaagaagatattttttttctactcgttcaacgtcaacgatcagaagccttttatgccgcagaaattgcaggactaaatgaatttgaaaatgcaggtataacagctccaagagtaattgcaagtggagagataaatggagatgcatatttattattaagttttcttgaagaaggtagtcaagggagtcaaagagagcttgctcgattagttgctagaatgcatagccaataccaacaagataataaatttggattccgtttaccacatgaaggtgcagatatttcctttgataattcatggactgagacatggaaagagatttttataaatcgtagaatggatcacttacaagatgagttattacgtgtaggattgtggaaacaagaagataaaaaaatgtatgaacgtgtaagaaaagttattgttgatgaactttcaaatcatactagtaagccctctctgttacatggtgatttatggggaggtaactacatgttcttaacaaatggccaacctgctttatttgatcctgcaccactatatggagatagagaatttgacataggaatcactacagtatttggtggatttacacaagagttctatgatgaatataatcaacagttaccactagccaagggatcacaaaagcgtatagaattttatagattatatttacttatgatacatttacttaaatttggaggtatgtatgctgatagtgtacaacgctctatgaaaatcattttagaataa

SEQ ID NO: 1061 - DNA, 1809 bp, S.epidermidis
atgaacgagaacaattatagacgtctcaacaaaacttataaaccgcactatttgcctggtttagatggtttgagagctatagcagtcattgggataatcatttatcatttaaatacgaaatggttatctggtggattccttggagtagatactttttttgtcatttctggttatctcataactagtttattattaagtgagtattatagaaataattctattaatttagttaatttttggcttagaagatttaaacgattaataccagcaatgatgtttgttgtcacggttgttttaatatatacattactatttaaacccgaattaattattagtataaaacatgatgctatagcagcacttttctatgtttctaactggtggtatatcatacaagacgtagactattttaatcaatttgctgtagcgccattaaagcatttgtggtcattagctattgaagaacaattctatctattctttccatttatacttttaggcttattaaagtttttcaaaaagagaactacaatgattattctattaatcatctctttattatcattaactgcaatgataacgatacatatgtatacaggtaacaattctagagtttatttcgggactgacacacgtttacaaacgttattattaggatgcttactagcatttatttggccaccgttctctttcagaaaggatatatctaaaggtgctaaagcaagtataagtgcaataggcatagtcggaatggcagtgctcatttatttgtttgtagtggttagtgatcaagataaatggatatatagtggaggattttatgccatctcgttcttaacactgtttgtcattgcaagcgttgtgcatccatcaagtgttttaaagaaaatactaagtttcaagttatttatttatataggtaagagatcgtatagtttatatttatggcactatcctatcattatttttatgaatagttatttcgtacaaggtcagattccttggtttgtatatatttgtgaagtgatacttatgtttgtcatggctgaagtatcttataaatttatcgaaacacctattagaaaaaatggatttaaagcattcacggtgataccgaaaaatttaacaagattttcaagaacgattattgtgttaatcttgcttgttccttctgcattcatagtatttggtgcctatgatagtttgggtaaagagcatgataaacaacaagctgcgaaacaaaaatcttttaaaacgaaccagaaagcaaaacctaaaaagccagatgaaaataatcaagataagtcttcacaacaacattttaatcctaaagaagcgtctccattattgctgggagattcagtaatggtagatatcggtcaagtctttagtgaaaaagtaccaaatgctaatattgatggaaaagttggccgacagttaattgagggtaaagatttaatcaatcaaaagtaccaagattatactaaaaaaggtcagagtgttgtgatagaacttggtacaaacggtgagtttacgaaagatcaaatgaatgaattaattgattctttaggtgaagcagatatttacttaattaaggtaagagtaccgagagactacgagtctactaataataaaattatggaacaagtagctaagaaacataaaaatgttcatattgttgattggtataaaacatctgaaggtcattctgagtattttgcatatgatggtattcacttggaatacagtggtgttaaggcattatctaatgaaatcattaagaaaatgaaagaagttaatgaaaaataa

SEQ ID NO: 1062 - DNA, 693 bp, S.epidermidis
aagaggtggaaaatcatgcttaatcaatttgtatgggttatttatccatatttatgtttagcaatatttgttattggacatatcgcaagatataaatatgatcaattttcatggacagcaaagtcgagtgaaatgattgaaaagaaacgattaaaatggggaagtttactttttcatttaggtattattccggtattctttggtcatgttgtgggattattgattcccgctaattggttagaggcgataggagtaaataatcatatctatcatataggtgcagtttatataggtagtgtttttggtataataacattaataggaatgttgttgctaactttaagacgactatccatcaaaaacgttagacgattaagttcattttcagatatatttgtgaatatcgttttgttgattattttaataatgggttgttattctacgcttgtaaccaatgcgattcaacctgaatttgattatcgtcaaaccattgcgatatggtttagacatttattcatgttttctccaaatgctgacttaatgttaaacgtgccttggtcgtttaaactgcacatattattagggtttacagtgtttgcgtgttggccatttactcgtttagtacatgtttggagtgtaccactgtcttatatgaacagaagatatattgtttatcgcaaaaacaaaatttaa

SEQ ID NO: 1063 - DNA, 234 bp, S.epidermidis
gtacttcgtttctttttaggaggatttggagcacacagattttaccatggtaaagtaggaagtggagttggattattagtcttaacattattaactgtttggtttacttttggaattcctactttaatatgggctattattgatgcttttttaattccaaactgggttaaagaagatgaagaaagaatacgtcagcaagctttaagcgaagtaaaattaatgaaaaataaataa

SEQ ID NO: 1064 - DNA, 216 bp, S.epidermidis
ttggaatacctaattcatgagtacgtcgacttaatcgagctacttttaattgtaattcttctagtttccctgacatcgtttcaccctctatatatgttaaagttagatgttatattgttatattttaacatagaaaaatctcttcaacgttctaaacgtcgaagagatacgaagctttatcccataaatttaaaaatatcattctcatacaaatga

SEQ ID NO: 1065 - DNA, 153 bp, S.epidermidis
cttatttttttgcatcatactcccaagattaatatttactatattcattttgctttttattcaattcaactatgttattctgtacatagattaactagtatcactaggggtgcaattcaatttgctgagagaaagtttactttcaacccttga

SEQ ID NO: 1066 - DNA, 198 bp, S.epidermidis
ctaaaatttgattcgcttcaatcacaatatgacctctctttcatctacataacacattatttaataatattatatattagcgaatatataaaggaaatatcgaatgtacaagacaattcgactttaactcttaaaaaattaaaaaaagcgaccgaatttgaattgcgtgtatttccacattttaacaacaagtcctaa

SEQ ID NO: 1067 - DNA, 129 bp, S.epidermidis
atggcacttgactatacgcacttatctgccatcttatttaatcataccatacttaaacgtgcaccctatttatacaatagtacatatgtggcgaactttactgtttattttttcggtaaaatcatctaa

SEQ ID NO: 1068 - DNA, 1356 bp, S.epidermidis
ttgaaaattgatcaaacacttacatcacgaattagacaacttgaggcttatatcatgaaacaatttttaaacatcactcaacgtaaatttatcgaatggttgattatcttatccatttttatagttagcattcctaataaatggacattaatgatatctatcgctttatctttattacttcttaaaagaggggcgctaggtgtcgttcaattaatcatactttatatgctcagatcgcaaatatacactccctatgatacacaagagatggcgcattacatagtaagtatgaaatatatcttgatttatgtaattggagtattttttctatttaaatatgtaaaacattggataagaaatgaaatgatattaagatttatcaagtctactatgattcttatgctactttatatcataatgagtttagtcgtatctaatgatccgatagaatctattcttaaattgcttaacttctttataccgctaattttgattgttatgtatgttagtttaataaaaaagataaagaatctcattaactggattaatcaatttatcacgctagtgattgcctttacttttttatttatagttatagcgccaaaatcatatttaattgatgaggaatcacttagaagtgttttcaaggatgcacattcattcgcagttattcttgctatgggtctagttctatatatggtaacaataatcaaacaacaagattatgatgtattcaatttattattattaaatattggaatgatagagctctatttatcaaactctcgtcatattttcatatctgttattttatgtctaatgcttctattaccgttatctcacataaaaaagagaattaaacatcccataattggtgctatgatactaatggcaattgctataataaatcaaccatatatttatcatctttttattaaactaatcttaaaagggaagaatagccaagaggtctttatgccgagtgatatgaatattaaagctattgattatgcgctaactgagcatccttttttaggaagcggttttggtataccaatgataaaagcgagttcagaaatacaatactttaatgtagcaacgagtaatatcatcttcggtatgattatctttactggaataataggacttactttatgtacgatatacatgcttcatatggtacttttagttacttttccaatgagtattactattttattatttttaatcactatctttgttaatatggattatattattttatttgattccgtggggctaggtatattgtgttatatattttggggaatatatttaaaagaaggtatgtatcaatacaacaacggacaatggtaa

SEQ ID NO: 1069 - DNA, 705 bp, S.epidermidis
gcaatgattgaacatttaggaattaatacaccttattttgggatattagtatcattaataccatttgtcatagcgacttatttttataaaaaaacgaatggtttctttttactagcacctttattcgtaagtatggttgcaggtattgcttttttgaaattgacaggaattagttatgagaattataaaatcggtggcgacattattaatttcttcctagaaccagctacaatatgctttgcgattcctttatatcgcaagcgcgaagtattaaaaaaatattggttacaaatatttggtggtatagctgttggtacaattattgccttgttattaatttatcttgttgcaataacattccaatttggcaatcaaattatagcatctatgctacctcaagctgcaacgacagcaattgcattacctgtatctgacggtatcggtggtgtcaaagaattaacctcactcgcagttattttaaatgcagttgtcatttctgctttaggtgctaaaatagttaaattatttaaaatatctaaccctattgccagaggacttgcactagggacaagtggacacactttaggtgtcgcggcagctaaagaattgggtgagactgaagaatcaatgggaagtattgcagttgtcatcgttggcgttattgttgtagcagtagttcctatacttgctccaatcttattataa

SEQ ID NO: 1070 - DNA, 1791 bp, S.epidermidis
atgaggattgacgttatgcttaatttatttattttattacttgaacgcgtgggattaattattttactcgcatatatactcatgaatattaatcattttaaaacaatgatgagcgaacgtgacaaatggcgttcaaaattccaactaatcattatttttggtatattctctatgatttcaaattttacaggaattgaaatagaaaatggccatatcgtatctggtgatatttattaccacttaagcaaagacgcctcaatggccaatacccgtgtattaacaatcggtgtttctggtctaataggtggaccgtgggtagctataattgtaggcattatttcaggattatgtcgtttatatattggcggggctgacgcatatacctatcttatttcatccatagttatcgctatcatatctggttactttggtcatcaaacaataaaacaaaatacatatccgtccattaaaaaaggtgctattatcggtgcaataactgaaattattcaaatgggctgtatattattatttacaaataacttacatcacgcaattacattagtcagttttatagcactaccgatgattatcattaatagtttaggtacagccatatttttaaccatcattttgtcgaccatcaagcaagaagaacaaatgcgtgcagtccagacgcatgatgtattacaactcgctaacgaaacactaccttactttcgatctggacttaatgaaaaatcagcccaacaagctgctgaaattattttaaaattaatgcaagtgtcggcggtcgctattacaaataaaaaagatattttaacacatattggtgcaggcagtgaccatcacgtagcacgtaaagagataattactgatttatctaaagaagtgattcaatctggaaaattaaaagtcgctcatacgagagaaggaattggatgtcaccatcctaattgccctcttgaaggagccattgtcgtccctctttatatacataatgaagtcgcagggactttaaaattttatttcacagataacaatattatttcaacttcagaccaacagctcgcaaaaggtctcgccaatatattttcctcacagctagaactaggtcaagctgaaatgcaaggacaattattgaaagacgctgaaattaaatcattacaagcacaagtcaatccacatttcttttttaatgctattaacactatatcagcactagtaagaattgatagcgaaaaagcacgacgtttactgattcaactcagtcagttcttccgctctaatcttaatggtgcacgtaataatacgattactttacaaaaggaattacaacaagtagcagcatatttatccttagagcaagcgcgctatccaaatagatttaacatacactatcgaattgatgatcagtgtcaagatgcgctcatcccaccttttataattcaaatattagtggaaaattctattaaacatgcatttaaaaatcgtaaaaagaataatcatattgatgtggatgttagcatgaagcaagactacttaagtatatctgttcaagataatggtcaaggcataccagctgatcaattagatactattggatatacgacagtaacgtctaccactggtactggtaatgccttagtcaatcttaataaaagacttactggactatttggaacaacatcggcactgaacattcaatcttctcaatcaggcacgactgtaagttgtttaattccatataaatcttctaaggaggaacactttaatgaaagcgttaatcgttga

SEQ ID NO: 1071 - DNA, 144 bp, S.epidermidis
aataaacatgattgtcgtaatgagattatagtttttactttcttccatcgatttccatactcctttctaaattttattcaatacgattattatgacagtttgtttcaaattcctaaagagatatttaaattgacgaaaaattaa

SEQ ID NO: 1072 - DNA, 543 bp, S.epidermidis
tggtttaatgagaaaattttaactgtgagcatatatattgtgaatatatgcgagtcattttacactataatcaatcgtgcgcgattgaaaagaggtggatatgtgaaacaagaacaaatgaggttagcgaatcagctttgtttttcagcatataatgtaagtcgtttatttgctcaattttatgagaaaaagttaaaacagtttggtataacttattctcagtatttagtattactgacgttatgggaagagaatcctcaaacattaaattcaattggtagacatttggatttatctagtaatactttaaccccattactaaaaagacttgagcaatctggctgggttaaaagagaacgtcaacaatctgataaacgacagttgataattacgttaactgacaatgggcaacaacaacaagaagctgtttttgaagcaatttcaagttgcttaccacaagaatttgatacgactgagtatgatgaaatgaaatatgtgtttgaagaactagagcaaacattaaaacatctcatagaaaaataa

SEQ ID NO: 1073 - DNA, 1377 bp, S.epidermidis
aaggaggacctcataatgaaatatattgtggtaggtacatctcattcaggatatgaagtgatccaaacattgcttaaagaagatgaaaatgctgatattcaagtttttgaaagtgcagatcaaccgtcctttttatcttgtggtattcaaagttatcttgaagacatctcatcatcattagatgatttacattacgcatcagttgactcttataaggcacaaggtgtaaatattcatacgaatagcacagtcacagatttagatactgacaataagactgttgtagttgaacaccaaggtcaaacagcaacttattcttatgataaattgttcctaagtcctggtggcaaacctgttacccctccagtcgatggaattgaaaaatataaacatgtattatttatgcgtggacgtgattgggcaaatcaaattaaagaacgcatgaaagatgccaaaaaggctgttgtagtcggaggtggctatatcggtattgaagctgctgaagcttttgctaaagcaggcatagatactacaatcgtagatgtcgctgatcgtatattaaacacttacttagataaagaatttacagacatattagaaacaaatgcacagcaacatggtcttcattttaaaggtggcgaaacagtaaaatcaatttcaggaaatcaaaatggcgaagtaactactgtagttaccgacaaaaatgaatatgacgcagatactgtcttatttgctgtaggtgtcgaaccagctaccgagtggctaaaagataaaattgatttaggtaagaaaggaattataaacattaaccaccaacaacaaacatctgctaaagatgtctatgcgggtggcgatgcgacattagttccttttgcaccagtatctgaggatcgttatattgcattagcaacaaattcaagacgtcaaggcgttgtcgcagcaaaaaacatgttgggtaaagaaatgacaatgccacgcgtttctggtacttcaggtttacaattatttgattataaatttggacaaactggcattcacggtacagaaatcgataattatgatggcaatttaggtcaaacatacgtagaagaattgattcgtcctcagtttatgcaagatgatacgaaaattcatatgaaaattatttatgataaagacactcaccgtatacttggtggtcaagtcatgtcaaaagaagatattactgcttctattaacacaatttcagtagtaatatctgctggtttcacacttgaacagctcgctgtccaagatttcttcttccaacctgattatgatagaccttggcattatcttaatgtgttagcccaacaagcattgggagatacatttggtagcgataagatgttattctaa

SEQ ID NO: 1074 - DNA, 135 bp, S.epidermidis
ttaggtaatgatgttccaatcacccgaattataagtaataataaatatacgacaatcgcaactattacaattttaattattttattctttgcaattatccattgttgcttcatcacatcatttattacagattga

SEQ ID NO: 1075 - DNA, 276 bp, S.epidermidis
acaaaaaatgagcaagttgagcaatttttagctaaagaaagccaatggcaagattgttataaatttttgagaaatttaatttttaatgaaactgaacttgaagaaaattataaatggatgcatccttgttatacgataaacaataaaaatgctgtgctaatacatggatttaaaggttatgtagcgttgctttttcaaaaaggagcaatacttgaagaaaagtatcatacattgattcaacaaactgaaagactacaggctgaagctgtcccctaa

SEQ ID NO: 1076 - DNA, 1632 bp, S.epidermidis
tgtttagatgaaagtgaattgaaaggaagtacacttatgaataaatcaaatttactagcacctgagaattataatattgttacagaaatagaaaaatatgcctcagaagatcataaaaaagccattatttacaaggataacgagcatgaaaatatttctgtaagttataaagaacttatcagtaatgctaataaagtagggaatgtattcctcaatcatgggctaaaaaagggagataaagttctcatcatgatgccacgtgcaatcgttacatatgaattatatattgcagcattgaaactagggatagcgattgttccaagttcggaaatgttacgaacaaaagatttacaatatcgaattactcacggtgagattgatgcagttatttcatttgattctctaactaaagaatttgaaaacgttaaagaatatgaccaattaaaaaaatttatagtagctggtcacaaagaagattgggtttcaatagaagatgaaaaagaaaaagtaagtgatgaccttaaaggcgcagatacaacacgagatgatttggcgattctttcttatacatcaggtacaacaggcaatccaaaagcagtaacgcattcacatggatgggggtatgcccatttacaaatggcaccaaaacattggttatgtatacaagagaatgatcttgtatgggcaactgcagcaccagggtggcaaaagtgggtgtggagtccatttttatctgtattagggatgggagcaacagcatttgtctataacggtcgtttccaccctgaaacatatctcgagttacttcaaaattatcaaattaatgttctatgttgtacaccaacagaatatcgtatgatggctaaacttagtcatttagaacagtacaatttagagtatttacacagtgcggtgtctgcgggtgaacctttaaatcgagaagttgttgaacaatttaaacgtcattttaatattactgttcgagatggatatggacaaaccgaaagtacattgttgatcggatttctaaaagatactgaaccacgtatgggttctatgggcaaaggtatacctggtagttttgttactgtcattgacgatgatggtaaagaggttggtccaaatgttaaaggtaatatcgccgtgcctttagacttaccggctttatttaaaggttactttaaagatgaagcacgcacaaaagcagcttcaacaggtgattattatgttactggagaccaagctcatattgataatgatggttatttctggttcgaaggtcgccgtgacgatattatcattagttcaggatataccattggacctttcgaggtagaagatgcactaacaaatcacgcagctgttaaagaatgtgcagttgttgcaagtcctcatgacattcgtggaaatattgttaaagcatttatcatcttgcaagatgattatgaagcaagtgatgagttaatccaagaattacaagtattttgtaaaaatgaagtagcaccgtataaatatccaagagcaattgaatttgttgaacatctaccaaaaacaaattcaggtaagatacgtcgtgttgaattacgtgacgcagaaataaaaaaatataaacaacaagattcatcacattaa

SEQ ID NO: 1077 - DNA, 147 bp, S.epidermidis
ttttgttgtgaaattttaataaattcacttttcattacctcactttatgttttacatttaaattcccataaagttttatcatcaaacacgtacagtaattatattagaaaatctaatatgctattgtttaatcaaactaagggatga

SEQ ID NO: 1078 - DNA, 306 bp, S.epidermidis
ataccgagtgaggttaaactcaaaaagttcctaaaaatcattcaaaaaacaattcattacatcaatcatcatttagaaagtgcaattgaaatttactcaacgtatactcaaaccgatatctctaaccaattaaacaaagatacaattgaagcaacagctaaatgttttacaaatgatttgtctatgagttccgactactacaatgatttacagttgtggcttaaagaagtcaatgatattaaagacacgattaacccaactttatattttacaaatcaactactattcagtcgatatacaaaataa

SEQ ID NO: 1079 - DNA, 813 bp, S.epidermidis
aaggaacacgaaactatgacaaattttcattctatagatgctacacaagtaacaaacgtcactttaaatgttaaagatttaaataaattaactgatttctattctaatgtattaggtttttctattgaaaaacaaacgaatcaacaaaccgtattcaacatcggaaatcttggttatactttaactttaaatgaacttaacaacggtcgacaaccggaatttagagaagcagggttattccatgttgcttatcttttaccgactcgtagcgatttagcagacttcctttatcatgctaacaatctcaacatcgcaatgggtggtggagatcaccttgtcagtgaagcgctatatttcactgatcctgaaggcaatggtattgaagtctatcatgatcgcccttcagaagactgggtgtggcgagacggttttgtcaaaatggatacattggaagttaatgtcaatgatttaatggctcaacggtcaaatgaaggttggcaaggttggccggaagaaggaaaaatcgggcatttacatctcaaaacacacaatttagaatctgcttatgaattttatgttgaaaagctagggttcgaacatatatctaatttcccacaagcactatttatgtctactcaaaagtatcatcatcatatagctacaaatacttggcagtcaaataagattagaactcaaaatgaacaaacttatggtttatgtcactttgacatatatcaacctaatgcaaatactactcatgttacctcacctgaaggctttgacattacaattcatggtaacgaaacaaaataa

SEQ ID NO: 1080 - DNA, 141 bp, S.epidermidis
atgagtaacgacacatctttgatagtcattgtcagaagttctatatcagcctctcaacatgattttgaaaaaagttatttttattatgtgacaatatttgcaaaattaaatattcgtttatttaatgaagcatacacgtga

SEQ ID NO: 1081 - DNA, 132 bp, S.epidermidis
gtcgattgcgaccatgtcgtgtcttttttatttttaaaattcaaaattattttaattatatacaaagtagataaaattccaaatattaagtataatatctttcgcgagttctacatattaaagatgaaataa

SEQ ID NO: 1082 - DNA, 1818 bp, S.epidermidis
atcgaattagaaataaagaaggtgtttaatatgtcattggaattgcccgtgatgctaacgattgtattgttcttagcactaggcatttttagtcaatggttagcgagtagaataaaatggccatcgattgttgtcatggccatcgtaggtttgcttgtaggacctatttttggactagcaaacccaaaagaggcacttggacctgaggcatttagttcaattgtatctcttgctgtagcaattatattatttgaaggtagtagtaatctagattttagagaattaaaaggcatttctaaagctgttataagaattattacaataggagcgggaattgcatggattttaggagcaatcgctttacatgtcactatgaatttccctctgtctatttcatttgttatcggaggactattcctaatcactggtccaaccgtgattcaacccttgctgaagcaagcgaaagtaaaaagaaatgtcgattcagtattaagatgggaaagtattatcttagatcctattggacctattattgcactcactgcattttatgtattccagatttttgaggaagggataggcttagtcgttattattctctttatcttgaaactcttagctgcaattttaataggttttggtgcagcctttctatttaattggcttataagtcaagataaaattcctcaaagtttaatgccacccattcaacttgtatttattcttttaacatttagtatctgcgatgagatattatcagaatcaggtttactagctgtaacaatttttggcttaatgatggcgcgtaaaaaacgtcacgatctcatctttaaagaatcagaccactttatagataatgcatcatctatacttgtgagtactgtatttattttaattacgtcttctctcactaaagatgtgttgctcaatgtgttatcttggcagctcatactctttagtttggttatgattgtattagtaagaccaatttcagtgcttctttcaacattaggtactgaaataactaaaaaggaacgtgcagtagtagcactaatggcgcctagaggtattgtggttttaacagtggcacaattcttctcaagtttatttatggacgataaaattcctatggctcaatatattacaccagtaacttttggtcttgtatttatcactgtagtcatttatggatttggttttacacctttaagtaaactgttcggtgtagcaagtacggagccaccaggcgtaatcattgtcggagaaagtgaattttcgttccatcttggtattaatctaagggatcatggtatacccgtcatgatgttcaacttatttgaaaatacatcagaaaaagcccacgaagctgggttcgaagtatttaaaggtaatcttttatctagcaatgatagaatttattctgatttattacgttataataaatgtattttgatgacacaatcgtttatctttaacagtttagcatttaatgaattagtgcctgaatttggcttgaataatgtagatatgatgccagtatcttttaatgatgaacaagcacgaaacaatttaaatggtccaatcagaaatcatatattatttgatgaaaatcataccccacgttggtttaatcaatttattacacaacataatattgttgaagtaccggcagaagattatgaaaaaattacagaaaatgatatgttaatctatcatatcaatgaagataaagaagtgacgtttaaacgaagcaatagagatatacctgaacatgaaacaggtgtttatggtattttaaaaaatgcttatttaacttaa

SEQ ID NO: 1083 - DNA, 975 bp, S.epidermidis
aagtatctagataaatgggaggaattgacattgaagaagtatcttaactatacactgattctgattgcattatctctcatcgtgttatctggatgcagtttaccaggcttaggtgatggaaatgctaaagatgatgtgaaaattacaacgactgaaacaagtgaaactaagattataggtcatatggaaaaattattaattgaacatgaaactgatggaaaaatcaaaccgacgttaattggtaacctagggtctagcattattcaacataatgcgttacaacgtggagatgcaaatatgtcagcggtacgttacacaggtactgaattgacgagtgtattagcagctaaacctactaaagatcctgataaggccatgtctgaaacacaacgcttatttaaaaagaaatatgatgaaaagtattatcattcacttgggtttgcgaatacatacgcattcatggtgacaaaagaaacggctaaaaagtatcacttaaaaaaagtatcagacttagagaaatataaagatgaactacgtcttggaatggatacccaatggatgaaccgtgcaggtgatggatatcctgcttttgttaaagattatggatttaaatttgatagtgcgcgtccaatgcaaattggtttagtatatgatgcattaaaaaataataaattagatgtagcagttgggtattcaacagatggacgtattgcagcttatgatttgaaaatattggaagatgatcgcaaattcttcccgccttatgacggtagtccacttgcaaatgaacaattaataaaggataatccagaaatcgataaggcactaaaaaaattagaaggtaaaatctcaacagaagaaatgcagaagttaaattatgaagcggatggaaaaggtaaggaacctgcagtgatagctgaagaatatttaaagaaacatcattactttgaagaaaagaaaggtggtcataagtaa

SEQ ID NO: 1084 - DNA, 129 bp, S.epidermidis
aactacatagatttattttacaacttaaattacgatttattcttatactatttcactacaaattatatatatcgtaaattcataccgcataatcatttaaatgtagtcaacatagaaacactattttaa

SEQ ID NO: 1085 - DNA, 132 bp, S.epidermidis
tatcagatagaattaaatgaatttttgagtttaattcataattactggtatattaaaaagcttgagacaataatgatagtcccaagcttttattataaatattttatattctataagctgtcgtcttattga

SEQ ID NO: 1086 - DNA, 447 bp, S.epidermidis
atgtatgtagagaatagttatttgagcaaacaattatgttttttattttatgtttcctctaaagaaatcatcaaaaaatatacagattacctaaaagagtatggtcttacatacacaggttatattgtattaatggcgatagaagatgatgagaaacttaacattaaaaaactaggcgaaagagtcttcttggattctggcacgctgacaccattattaaaaaaattagagaaaaagaattatgtcattcgaactcgtgaagaacaagatgaacggaaccttcaaatttctttaacagaacgtggcaaggatattcaaaatgttctatctgatatttcacaaagtgtttttaatgaatttaatattactcaagaagaaacccaaaatttagttgaagacttgcaaaattttgtaacgaaaaattttgataaaacagtggaaaagtga

SEQ ID NO: 1087 - DNA, 576 bp, S.epidermidis
cacatgcaagaagataggaaatttgaagtcaaatggcgactagttaattcatcaacttttatgtatggtacaaaattacgttttaatcaagataatatctattttgagaaccctttgatgccatccggtacaatcattcacagttggtatatgttaactgattttgcagaagaccgtgtaagccctaagctacctattttaaaaaaagggcgccaatatcaatttcaatttaattttgaagttgaacctgagggtgcggcttattttaaaatgaaattttatcgtaagaataaagaaattcttagtcatcaaattctaaaaaataaaaaagaaaatattgtctatcctagagaagcatattcatatgaattagaacttattaatgctggcatgaatcatctatcttttcacaatataattgtgcaagaattaagagaagatagtaatcaagcttatgaggcaacgcaatatatagatcctaagaaaaaacttaaagtaattaatcaaataataaccaatataaggacacatcatctagacacatcaaactatcacaggagtgatacgaatggctaa

SEQ ID NO: 1088 - DNA, 1263 bp, S.epidermidis
tgtagcgaagaaaaggaggaaatgagtatgacaaatggacctattcaagttaacagtgaaatcggcaaactaaagacggtattacttaaaagaccagggaaagaattagaaaacttagtgcctgattacttagatggattattgtttgatgatattccatttttaaaggtagctcaacaagagcatgatcattttgctcaagttcttcaagatgaaggaatagaagtgctttatttagaaaaattagcagcacaaagtatagaagattcaaatgtcagagagcaatttatagatgacgttttagcagaatctagaaaaactatcctaggtcatgaaaaagaaataaaaaaactcttttcaactttgtcaaatcaagcattaattaataagattatggctggcgtacgcaaagaagaaatacaacttgaatcgacacatcttgtagagtacatggatgataaatatccgttttatcttgacccaatgcctaatctatatttcacacgtgatcctcaagcttcaattggtagaggtatgacagtaaatcgtatgttttggagagcgagacgcagagaatcgattttcatttcatatattttaaaacatcatcctagatttaaagatgagaatattcctttatgggtggatcgtgactgtccgttcaacattgaaggtggagacgaactggtgttatctaaagatgtacttgcaatagggatatctgaacgtacttctgcacaagcaattgaacgtttagcacgacgtatttttaaaaatccgttatctacttttaaaaaggtggtggcgattgagattccaactagtcgaacatttatgcacttagatactgtttgtacaatgattgattacgacaaattcactacacattcagcaattcttaaatcagaaggaaacatgaatatatttattatcgaatacgatgataaagctgaagatatcaaaatccaacgttccagtcatcttaaacaaacattagaaaaagtgctcgatgttgatgaaattacattaataccaactggaaatggtgatatcatcgatggtgctcgtgaacaatggaatgatggttcgaatactttatgcatccgtcccggtgtggttgtaacttatgatcgtaattatgtttctaatcaattgttacgtgagcatggtatcaaagttattgaaattcctggaagtgaacttgtacgtggtcgaggaggccctcgatgtatgagtcaaccattaataagagaagatctatag

SEQ ID NO: 1089 - DNA, 1398 bp, S.epidermidis
aatggagaagaaaagattatggcagataaactgcaaagagaattaagcaatagacatatacaattaattgctattggcggggctattggaacaggtttatttcttggtgctggccaatctattcatttagcaggcccatctatcttactaacatacataatagtaggttttgttctctttatgttcatgagagctatgggagaattactgttatccaatttaggatttaaatcgtttggtgacattgctcatcatcatattggttctatggcaggttttatggtggggtggacatattggttaacatggattatttcaggaatggcagaagtgactgctgttgccaagtatgtttccttctggtatccaacaattccaaactggttaacagctgcagcgactattttagttttagttgctttaaatctattcagtgctaaattatttggagaattagaattttggctatctattattaaagttttgactattttagctttgatagccgttggtgttgttatgattgtatttggaatgaagacaagctatggccctgcaacggtaacgaatatatggaaagacggaggctttttccctaatggtgcacaaggtttcttcatgtcattccaaatggcaattttctcatttattggtattgagttgattggaataactgcaggggagactaaagatcctcacaaaacaattcctcaagcaattaataatgtaccgtttagaatattattattttatataggatcgttggcagttatcatgtctgttgtaccatggcaacaattgaatcctgctgacagtccatacgttaaaatgtttggattagttggaatcccttttgcagcaggtattattaactttgttgtacttacagctgcagcctcttcttgtaatagtggtatatttgctaatagccgtacgatgtttggattagctggaagaaagcaaggtccagcattcttacatagaaccaataagcacggcgtaccacattatgctattttagtgacatgtggcttattaagtatttcagtcgtgttaaatgcaatttttaaagatgcgactaaagtgttcgtacaaattacaacattttcaactgttttaaatattatgatttggacaattattatgatcgcgtatctaggttatttaagacatgaaccgaaacagcataaagaaagtaactataaaatgtggggcggaaaatacatggcttacagtattttagggttctttgcatttatttttattatactattgattaatagtgcaacgcgttatgccgtactttctgcacccgtatggtttgttatcatgctattgatgtatcaaaaatataaaaaagaatctcgcaaagctaaaattaaaaatgaggaagagtaa

SEQ ID NO: 1090 - DNA, 1437 bp, S.epidermidis
gtaaaggaagatggtgtcgtgggaagtactgttaaatatcgtaagtttattctacctattgtcgttggtttaattatctgggcattgacgcctattaaaccagatgccttaaatgatcaagcttggtttatgtttgctatttttgtgtcaaccatcattgcttgtattacccaacctatgactataggtgcagtatcaatcattggttttacaatcatgattttggttggaattgttgatacaaaaactgccgttcaaggcttcggtaatagtagtatttggcttattgcaatggcctttttcatttcaagaggatttgtaaaaacagggctaggtcgacgtattgctctgcaattcgttaaattatttggaaagaaaacgcttggtttggcttattcacttgttggtgttgaccttatcttagctcctgctacgccaagtaatacagcacgtgctggtggtattatgtttccaatcattaagtccttgtcagagtcatttggttcatcgccgagagatggttctgagagaaaaatgggtgcgtttttaatctttactgagttccaaggtaatttaattacttcagctatgtttttaacagctatggccggtaaccctatagcgcaaagtttagctgaaaaaacggcacacgttcaaattacatggatgaattggtttgttgctgctattatacccggattgatttctctcatcgttgtccctttcattatttataaattatacccacctactgttaaagaaacgcctaacgctaaaaaatgggctactgaacaactagaagaaatgggacatatgtctatagccgaaaaattgatggttggtgtctttatcatagcattggctttgtgggtattaggaagcttcattaatgttgatgccacgctcactgcatttattgctttagcattgttactattaacaggtgtattagcgtggtcagatattttaaatgaaacaggcgcatggaatacactcgtttggttctcagttcttgtattaatggcagaacaattaaacaagttaggctttatcccatggttaagcaaactcattgctcaaggtttgaatggctttagttggcctatcgttttagttttactcatcttgttttatttctactcacattatttattcgcaagtgcaacagcacatgtcagcgccatgtacgccgcgttactcggtgttgcagtcgcttcgggtgcaccgccattattcagtgcattaatgttagggttctttggtaacttactggcatcaacaacacactatagtagtggaccagcgcctatattatacgcagctggctatgttacacaaaagcgctggtggactatgaatattgtacttggtatagtctattttattatttggattggtgtaggttcactatggatgaaactcattggtatgatgtaa

SEQ ID NO: 1091 - DNA, 126 bp, S.epidermidis
ttagaacgagaattaaaacttaaaattaaaaggtattcattacactatatgagggtgtggagaagaattcgtgttaaatttcgtcatcgtcgtgcaactggcttaatctgttcgatttttctataa

SEQ ID NO: 1092 - DNA, 129 bp, S.epidermidis
aaagggagagaagtaaaaaatattaaaattgaagtgaaatatagcgagaatagtcaaaggcctaataaatttgacgttagttgtgaaattaatggagaagagcgtttgtattcaatagaaaatatttag

SEQ ID NO: 1093 - DNA, 789 bp, S.epidermidis
aaattgttggaggcggttaatatgtttaaaataggaaatttagaattacaatctcgtttacttttaggtactggaaaatttgaaaatgaagaggttcagtcaaaagcaattgaggcatctgaaacaaatgtacttacatttgcagtaagacgtatgaatttatatgatcgtaacctacctaacccacttgcaaacgttaatttaaaagattttatcacttttccaaatactgcaggtgccaaaacagctcaagaagctatcagaattgctgaaattgctaatcacgcaggtgtatgtgacatgattaaagtcgaagtcattggtgatgacgaaacattattacctgatccattcgaaacatacgaggcatgcaaagtattgttagaaaaaggttacactgtttgtccttacatctctaacgatttagttttagctcaacgtttagaagaattgggtgtacacgcagttatgccacttgcatcccctattggtacaggaagaggtattaataacccattaaatttaagttatattatcgaaaatgctagtgtacctgtaatcgtagatgctggtattggttcccctaaagatgcgtgtcatgccatggagcttggcgcagatggtattttactcaacacagccatttcagcggcaaaagatcctgtgaaaatggctgaagcaatgaaattaggtataaatgctggcagactttcatatgaagctggacgcattcctgttaagtatactgcacaagcatctagtccatcagaaggtttagggttcttgtaa

SEQ ID NO: 1094 - DNA, 621 bp, S.epidermidis
cgttgtatggaacaaattatcactgattttattagtaagtggggttatacagcgatattcattttaatcttattagagaacgtattacctgtcgttccatctgagattattttaacttttgcaggcttattatctgtgaaatcacacttatctatttggacattattaatcatagcaacaattgcttcattcattggtttactcattttgtattatatttgtagacttatctcagaagagaaattatatcgtttcgttgatcgacatggtaagtggatgaagttaaaaagtaaagatttgaaacgggcaaatgattggtttaaaaagtatggtgcatgggctgtatttttatgtcgttttgtcccagtacttcgagtattaattacaatacctgctggcattaatcgaatgaacgttatacagtttacaactttatctttaataggtactacaatttggaattttgctttaatactgctcggtcgtttgctcagtgacagttttgacgctttgatgaatggtattcatacatattcacgtatcatgtatgtcattattattattgcagtcatatattttgttatacgttatttaatgaaacgtcgtcggagtgttaaataa

SEQ ID NO: 1095 - DNA, 792 bp, S.epidermidis
ttagtaatggatatacaaaagtttgaatcttatttaaaaattaagcattcatattattcaaacccttctcttgaagcattgaattactatgtaagacgctttatgataactgtgccatttgaaaatattaatgttcaaaacaagattcctatctcaatcgatatcaaagatttatacaataaaattgttattcaacggcgtggcggtttttgctatgaattaaatcatttgtttgctacgtatttagaacataaaggcttccacgtcactcgtgctgcggcaacagttcacacaccaaatggtgggcgtagtcctgaaggctcgcatatgtcactttacgttaatatcgaaggaacactttatattactgatgttggatttggtgatttacctacaagtattatcgagataggttctaaaacacaattcattccaacatatgataaaaatggagtttactgtgctgtttggattaatgacaatcaatatgccttacagaagcttagacaaaataaatggatgacactctatgaagcgcatttaaaacctcaaagcattaaagactttaaagataaaataagctacaatgagcatcatcctcattctatttttgtacgacatttgcttattacacaaccacaatcgtttggacgtgcaacaatgacttatcattctttaactttaagcaatgacagtactaaacataaatatgacgttactaccaataactacaagtattttttaaaaaaatattttaatttaaatgtatcaatcatcccatttgaaccataa

SEQ ID NO: 1096 - DNA, 825 bp, S.epidermidis
ctttggatggaacgtttagaaaacaaaatcgcagtgattaccggtgcgagtactggtattggacaagcatcagccgtggcgttagcaatagaaggagcacatgtgttagcgcttgatatatcagatcaattagaagaaactgtgcagtctattaatgataatggtgggaaagcaactgcatatcgcgtagacatttcagatgataaacaagtcaaacaattctcagaaaaaatagcacaagaatttggacatgtagatgttatttttaataatgcgggtgtagataatggcgccggacgtattcatgagtatccagttgaagtgtttgataaaattatggctgttgatatgagaggaacgtttttagtaactaaatttttattacctttaatgatgaaacaaggtggttctattattaatacagcttcattctctggacaagctgccgatttataccgttcagggtataatgctgcaaagggcggtgtcattaatttcacaaaatctatcgctatagaatacggacgtgaaaatattcgtgctaatgccatagcacctggaacaatcgaaacaccacttgttgataatttagcaggtacatcagatgaagaagccggacaaacattccgagaaaatcaaaaatgggtaacaccattaggtcgactaggaacaccggatgaagtcgggaaacttgtagcatttttagcttccgatgatagttcatttataactggtgaaactattcgtatagatggtggcgttatggcttatacatggcctggagaaatgttaagtgatgaaagttggaaaaactctactaaataa

SEQ ID NO: 1097 - DNA, 192 bp, S.epidermidis
aattctacggacaaggcaagttggggttcggggccccaacaaagagaatttcaccgagaaattccacggacaaggcaagttgtcggtaacttggataacttattcaaaataaggtgtgtattcaactacgataagttatcatccttattttgtttcgttaccatgaattgtaatgtcaaagccttcaggtga

SEQ ID NO: 1098 - DNA, 450 bp, S.epidermidis
atttatagtttacttattaataataaggagatttgcccattggacctaacaaatcaaaaaatcctacacttacttgagcaaaatagtaagctatcgctttctgaaattggaaaggaagtaaatttatctacaccctctgttcgagaacgaatctataaacttattgattcgaaaatcattgaacgatatacaatcgatattaattacgatgcattaggtttcgatattaatgttttgatagaagtaactataaaaaataacctatataaagatttcaaagcatttatttcagttcaaaacaatgttgatttttgctatagaatttctggagatagttgctttatatttaaagcgcattttaaaaagatgagcgaagtcgaaacactcatcaacgaaatccaatattatggtcatacaaaaacacattttatattttcagaaacaaaatag

SEQ ID NO: 1099 - DNA, 1062 bp, S.epidermidis
ccacataaggaggtttttacgatgagtgaagaacgcaagttaacatttatgggggctattaatgaagctattgaccaatctatggaaaaagatgaggatgtcattttaattggtactgatgtctcaggtggtgcaaaagtagaccacatcaaagatgacgatacattcggtggtgtatttggtgtaacaaaaggacttgcaaaaaaatatagtcgtaaacgtgtaatcgatacaccaattgctgaacacattacattgagcacggcagtaggagctgctgcgacagggctacgtccaattgctgaactcatgttcaacgactttattggatttggtttagatccaattttaaatcaaggggcaaaaatgagatatatgtttggtggaaaagccaaaatcccactagttgtacgtactgttcatggagcaggggcaagcgctgctgcacaacactctcagtctttatataatatgtttgcagcaattccaggagttaaagttgttgttccatctaatccatatgatgcgaagggtctactgatgtcagctattcaagagaacaatcttgttgtcttttcagaagataaaacattattaggacaaaaaggtaatgttcctgaagaaccttatactatagaaattggtaaagccaatgtgacgcgtgaaggtgacgatttaacaattgtggctattggaaaaatggtagctgtagcggaagaaactgctgaaaaacttgcagaagaccaagtatcagttgaggtcatcgatttacgctcagtgtcaccatgggatcaagaaacagttttagattctgtgaagaaaacgggtcgcctaattgttattgacgaatctaatccacagtgtaacattgctggagacgttgcttcagtgattggagatgtaggatttgattacttagatggtccaattaagaaagtgaccgcaccagacactcctgtaccatttgcagcgaacttagaggcggcatatatgccgaatgctgataaggtattagacattgcatctgaattaattgatgatttaaaaaaggctaacgcatag

SEQ ID NO: 1100 - DNA, 954 bp, S.epidermidis
aattgtaaggagatggaatatatgaaaatagcaattgcaggttctggcgcattaggtagtggatttggtgctaagttgtttcaacatggttatgacgtcactttaattgataattgggaacctcaagttactacaatacaacaggacggtctacatatcgatattaatggtgaagcgcatcatttcaggctacctatgtatagactaacggaaattcctaaagcaacgtcctatgatattgtttttctatttcctaaatctatgcaattagaagaggtgcttagtcatattcaaccccatcttcatgataatacaattgttgtgtgcactatgaatggtttgaaacatgaacgtcttatacaacaatatgtttctatagatagaattgtacgtggagtaacaacgtggactgccggtattgatcaacctggtcacacgcacttaatggggcaaggtcctgttgaaattgggtgtctcgtgcccgagggaaaagaaagcgtagatatcattgttaatctgctacaaaatgcagaattaaaaggtgtaaaaagtgaacatttacatcaatcaatttggaagaaaatatgtgttaatggaacagctaattcattatgtactatacttgaatgtaatttggcagcactgaataatagtgatgacgctaaaaatttgatatataaaattacacaagaaattgttcatgttgcaacagttgatgatgttcatcttaatgttgatgagatttttgattacttaattgctttaaatgataaagtaggcccacactatccttctatgtaccaagacttaattaaagataatcgaacaactgaaatagattatattaatggagcagttagtaaattagggaaagagaatcatattgctacacctgtaaatgattttgtaacaaatcttgtacatgctaaagaaaatcaacgtggtgcacaatga

SEQ ID NO: 1101 - DNA, 1278 bp, S.epidermidis
atgaaaagtttagataaaggatttagacatttaacacgaaaagataaattaaaaaaacttgttgaatacggttggctagatgatgaaaactatgaaatattacttaatcatccgttaattaatgaggaagtcgcaaacagtttaattgaaaatgtcattggtcaaggtgcactaccagtagggttattacctcgaattatagttgatgataaagaatatgtagtacctatgatggtagaggaaccttctgtcgtagcagcagcaagttatggcgcaaaactcgttaatcaaagtggtggatttaagacaatttcaagtgaacgtctaatgattggacaaattgtctttgatgatgttgaagacacaggcacattagctaactcaatatatcaaattgaatcacaaattcatcaaatcgctgatgaagcttacccttctattaaagcaagaggtggaggatatcaacgtattgaaatagatacattccctaatcatcgattattatctttgaaggtttttgttgatactaaagatgctatgggtgctaatatgttaaatacaatattagaagcaatcactgcacatctaaaagttaaattttcaaatcaaaatgttttaatgagtattttatctaatcatgcgacagcatcagtagtaaaagtacaaggggaaatagatattgaagatttacatagaggagagagaagtggcgaagaggtagcacaacgtatggaacgagcgtcagttcttgcacaagtagatatacatcgtgctgcaacacataacaaaggtgtgatgaatggtatacacgctgtagtattggctacaggcaatgatacaagaggagttgaagcaagtgctcatgcatatgcaagcaaagatggtcattatagagggatagctacttgggaatatgatcgctcacgtaataaattggttggaactattgaagttcctatgactttagcgacagtaggtggaggtacgaaagttttacctattgctaaagcctcattaaatttgcttaatgttgaaaatgcacaggaactagggcaagttgttgctgctgttggattagcacaaaatttctctgcatgtagagcgctagtgtctgaggggatacaacaaggacatatgagtttacaatataaatcattagcgattgttgtaggtgcaaaaggcgaagaaattgcgcaagtagctgaagcgctcaaatatgaatcacaagctaatactgccaaagctcaagaaatcttgatgaatataagaaagtcataa

SEQ ID NO: 1102 - DNA, 138 bp, S.epidermidis
acacatttactagtaaataagtataaatttaaggtgaactatagtgtcaaaattgaatgttatgtgaattttttgggtgagactgacgtaagtctaaatacaatatatactcttctcaatagtgaaaagagtgcgtaa

SEQ ID NO: 1103 - DNA, 927 bp, S.epidermidis
ttaaacttactattgaattatatcaaaactagggggatatgcatggatataaaacacatgaaatactttgttgaagttgtcaaacaaggtggtatgacaaacgcttcaaaatccttgtatattgcgcaaccaactatcagtaaagcaattaaggatattgaagcagagatggctgtccctttatttgaccggagtaaaagaagtttagtacttactgatgcaggtaaaatttttttcaagaaatgtcaagaaatcatcgcactatatgataatttgcccactgaaattaatagtttgtatggtttagaaacaggtcatatcactattagtatgtctgcagtgatgagcatgcgtaaatttattggcgtattaggagactttcatcaactttatccgaatatcacgtacaacttaatcgaaagtggtggtaagacgactgaaaaccttatacttaatgatgaagtggatattggtgtgacaacattgccagtagatcatcaaaaatttgaatgtatatctttaaacaaagaagaactgactgtagttttaaataaagaacatcctttagcacaaaaatcttctattaaaatggaagaattagctgatgagaacttcattttatttaatgaagatttctatctcaacgataaaattattgaaaatgcgaagaatgctggattcgtgccgaacatggcctcacaaatctcacaatggaatgtgattgaaaatcttgtcattaatcaattaggtatttccatattgccagccactatagcacaattacttaatgatgacgtcaaaattgtacatttggaaaatgcacatacaacttgggagcttggtgtcgtttggaaaaaagataaacgtttaagtcatgctacaaataaatggatagaatttttgaaagaaagattatccgaagaataa

SEQ ID NO: 1104 - DNA, 1440 bp, S.epidermidis
caacgcttacttggatacttaaaatttactcgtaattatttttcagttttatacatcatcatacgattaggaggttacaacatgtttaatttcttaaaaccagctagacatatcaaatcattgccagcagaaaaagtagatgatacatataaaagactacgctttcaagtctttttaggaatatttatcggttatgctggttactatttattaagaaagaacttctctttagcaatgccttcattaattgagcaaggctttattaaaggggaattaggtattgcattatctgcagtatctatcgcatatggctttagtaaatttgtaatgggaactgtcagcgatcgaagtaatgctcggatgttcttaactttaggtttagtattgacagcaattattaacttattattaggatttattccattctttacttcaagcataactattatgtttatcatgctgtttttagttggttggttccaaggaatgggctggccaccatctggacgtgtgttagttcatgggtttagtgtcagcgaacgcggaagcaaaacgtcaatatggaatgtagcacataatgtaggcggaggtttaatggcacctattgctacgtggggtatttccatgactgcattatacaacttcggttatttaaaagggtttgaaggcgtctttatataccctgcactattggctatcattattgccatcttctcttacatactaattagagatacaccacaatctcagggtttaccaccaattgagcagtataaaaatgattatgccacttcaactaaacaaacaattgaaacagaactaactactaaagaaatattatttaaatatgtacttaataacaaatgggtatgggcgattgcttttacaaacattttcgtttattttgtgcgttatggtgttttggactgggctccgacatacttaagtgaggaaaagcattttgatttaagtgcttcaggttgggcttacttcttatacgaatgggcaggaattccgggcacgctactctgtggttatctatctgacaaactatttaaaggtcgtcgtggtccagcaggcttcttctttatgttaggcgtaacaatctttatccttatatattggttaaatccaccaggtcacgcatggttagataatctttcattaattggtattggtttcttaatttatggtccagtcatgttaattggtttacaagcgttagattatgttcctaaaaaagcagcgggtactgcggctggtctaactggtctatttggatacttgttcggtgcagttatggctaatattgtattagggtttgtagttcaacattttggatggcatattggctttgtgttattaacagtcatcagcatactcgctatgttatgtttcattttaacttggaataaacgtggtcaagaacaaatcgactag

SEQ ID NO: 1105 - DNA, 189 bp, S.epidermidis
tcaaagctactgcatccgcttaacattaaaatgatgattgacactataattaatttcttcaatataagtgctccctgctatgaccaatttatacgcttatcactatatctgttacattataaaaaagcaatagttatcaatataaatgtaaactgtaaactaattatgtttgaaaacgtcaaagcgtga

SEQ ID NO: 1106 - DNA, 135 bp, S.epidermidis
atgtgtatactagatgtaaataaaatcattgcgtgttactggttatgcaggcatgagcaaataagagtgtctatctttcgtgatatgaaattgatagtcttatttgttcatgctttttttgtggcacgtaaataa

SEQ ID NO: 1107 - DNA, 954 bp, S.epidermidis
caaatggtactttttcttcaacccgtatttcaagaacgtttatggggtggcaccaatctcactcaatttggctacgatattccgaataattctaccggcgaatgctgggcaatttccgcacataaaaacggtcctaacacaattctcaacggaaaacataaggggaaatctttaaaacaagtttgggacgaagataaagcacttttcggaaatgactcacgtaaagattttccacttctcactaaaattttagatgcacatgattgtttgtcagtacaagtacatcctgatgatgaatatgcgcttaaacatgaaggcgaatacggtaaaactgaatgttggtatattttagacgctcaacctggtgctgaaataatctatggtgttaatgctacaagtaaaaatgaacttgaacatatgattgatcatcatcaattcgactatttatttaaacatgtacctgttaaaccgggtgatttcttttatgtaccagccggtacagttcatgctattggttccggaatcctcattttggaaactcaacaatcttcagatacaacatatcgtatatacgattatgacagaaaagataaaaatggtcatacgcgtgaattacatttaaaccaaagtaaagatgttattgatatcactacaactgaacctaatacaacacctaagactgaaatgataaatggcaattgtcacactcaatttgttgccaatcatttctttacggttgaagaatggtctatcaaagacatattagattttcaaaaaccacacacttattgcctagtgtcaatgattaacggccacgggcaagtttcaatcaataacaaagtatataaaatcgataagggcgatcattttattttaacttctgaagatcaatatattaaatttgttggtaatatggatttaatagtcagttttagtaaagatgaggcatattaa

SEQ ID NO: 1108 - DNA, 156 bp, S.epidermidis
tttaattcactaaacaagttacttcataggtcttttaaatttctaaattatactaactatataagtgagctgaagagattagaaatcaattactttagttactttttgaagtcgtatataatttgtatcaacagaagtaaagagaggaaggtatga

SEQ ID NO: 1109 - DNA, 363 bp, S.epidermidis
gtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaagcgaattccattatcgttaactggcttcattcaatatgtagggccgacaatcatgtttatcttaggtatctttgtctttaaagagccatttaacactgatcaattgattacctttatttttatatggataggtattgtgttatatagtatttctcaatatgttcaaattaagaagaacccagttgtaaaatag

SEQ ID NO: 1110 - DNA, 1365 bp, S.epidermidis
aaagagtcactattgggagggaactcaatgagtaaggttaatcatttgatagatgaagatgaacgttattttgcacattctggacggattaaatattatcctctagttattgatcatggttatggagccacgttaatcgatatagatggtaagtcttatattgatttattagcaagtgcaagttcgcaaaatgtgggtcacgctccgaagccagtagtcgaagcaattaagaaccaaactgagaaatttattcattatacaccagcatatatgtatcatgaaccgttagtgcgattatcaaaaaaattatgtgacattgctcctggaaattatgagaaaagagttactttcggattaagtggctctgatgctaatgatgggattataaagtttgcacgagcgtatacaggacgtccatacatcataagttttactaatgcataccatggttcaacatttggttcattatcgatgtcttcaattagtttgaatatgcgtaagcgttacgggccattacttaatggattttaccatataccttttcccgataagtatagggggatgtttgagcaagctaaacctaacacagttgaggaatatttagctcctttaaaagaaatgtttacaaaatatgtccctgcggaggaagttgcatgtattgtggttgaaacaattcaaggtgacggtggcttacttgaacccgtgccaggttattttgaagcattacaagagctttgccacgctcacaatattcttattgcagtcgatgatatccaacaaggattaggtcgtacaggaaagtggagttccgtagatcattatcattttactccagatttaatgacatttggaaagtcattagctggaggtttaccaatgtctgcgattgtaggtcgtaaagaaatcatggaaagtcttgaagcacctgctcatttatttacaactggtgcaaatcctgtaagttgtgaagcagccttagctacgataaagatgattgaagatgaagatttactaaacgcttcatggaaaaaggggagttacgttagaaaaagaatagacccatggatagaacgttaccaatatgtaggtgatgttcgaggtattggattatcaattggaatagacatagtatcaaataaaattgagaaaactagagattctgaagcagcattaaagatatgtaattactgctttgaaaatggtgtgattatcatagcagttgcgggtaatgttttaagatttcaaccaccacttgtgattacctataagcaacttgataaagcattagatacaatagaagaggcgcttgaaaagttggaaagaggagaattaaatcaatatgacattagtggtcaaggttggtaa

SEQ ID NO: 1111 - DNA, 195 bp, S.epidermidis
ccaatgacacttgacgctatataccaagcattaggtaaaaacgtcaaagataataatattaatcctatgacggtcaaggcacttccgagtaacaaaggtcttttaggtcctaacgattgtaatatcatttcacccacacgtatcataattaatactgcaattaggtatgtaagtgaaatatatcctgtttcctga

SEQ ID NO: 1112 - DNA, 126 bp, S.epidermidis
aacgagacactttacaggatgcatgcgtatgcgtgcgtcctgttttttgttgaaattttacttcaattaaaagccgaaaatatttttgattattacactaaaatttatttatctggtgaaaaataa

SEQ ID NO: 1113 - DNA, 963 bp, S.epidermidis
cagggagcacttatattgaagaaattaattatagtgtcaatcatcattttaatgttaagcggatgcagtagctttgatcatcgtaaacgcgaaagtattaatgacaagaataaaatgaaagtatacacgactgtatacgcatttcaaagtttgacacaacagattggtggaaaatatgttgacgcgcaatcaatatatcctgctggtgctgatttacactcatatgaaccaacacaaaaagatatgattgatattgccaaaagtgatctgtttgtctattcaagtcatcaattagatcctgtcgctgcaaagattacgaattcgatgaccaataatagcatgaaattagcgcttgccgaaggactcaaacaaagtgattttattcactctaaagaccatgatgaaaatcatgagcatcattcacatcatgaagaatcgaatcaagatcctcatgtttggttagatcctgttctaaatcaaaaattcgctttcatgattaaagagaaattaatagagaaagaccctaaacatcaagcttattacaataaaaattataaaatagtaaataaagatattgtgcatattgatcaacaactacaatcaataacgaagcattctaaaagagataaagttgtgatatcacacgattcgcttggatatttagcgcatcgttatggttttaaacaacaaggtgttaaaggtatgaatgatgaagaacctagtcaaaaagagattttgaatatcgttaaagatatacagcattcgcatgcgccttatgttttatatgaacaaaatattacctccaaaattacagatgttattaagaaagaaacagatactaaaccattaagttttcataatttagctgtattgactaaagaggagcaaaatgatgattcaatttcataccaatcattaatgaaaaagaacatttacgtattaaatcgcgcactcaataattaa

SEQ ID NO: 1114 - DNA, 138 bp, S.epidermidis
atacaattttgtcgaagaaaagttcaaaaattgaaaaactgtctactaaaaatgataagtaaaaatttaattattaaaatgaatattgacattgatttaaattatacgtttaatataggtatcatttttaagatttga

SEQ ID NO: 1115 - DNA, 765 bp, S.epidermidis
aaaggagtttgcatagtgttattagaggttaaaaatgtaaaaaaagtctatggcagaggtatgaacacgacaatggctttaaatcaaatgaaccttgaaattgatgaaaatgaatttgtagcaatcatgggagagtcaggttcaggtaaatctacattactcaatttaattgctacttttgatcgtacaactgaaggcttgataaagttagacgggttgccacttaatcaattgaagaataaagacattgcacgttttcgtagagaaatgatgggatttgtgtttcaagattttaatgtgttgaatacgatgtcgaacaaagataatattttgatgcctcttgtacttgcaaatgaacgtccaaaaataatgcaaaaacgcttaatggaaataagtgaacaattaggaattgaagacttgcttgaaaaatatccgtctgaaatatctgggggacaaaaacaacggatagctatagcccgtgcgttgatagcacgacctaaattattattagctgatgaacccactggtgcacttgattcaaaaacctctaaaaaccttatgtgtttatttcgaaaaattaatcaaaagcatcaaactatattaatggtgacacattcaaatattgacgcgtcatatgcgaaccgtgtcatcttcatcaaagatggtcgtttgtatcatgagatttatcgtggtgaagaatcgcaaacagattatcaaaagcgtattgccgatagtttggccatattgaatggagtaggtgactaa

SEQ ID NO: 1116 - DNA, 135 bp, S.epidermidis
acaatttcttgtgtaattttatatatcaaatttttagcgtcatcactattattcagtgctgccaaattacattcaagtatagtacataatgaattagctgttccattaacacatattttcttccaaattgattga

SEQ ID NO: 1117 - DNA, 417 bp, S.epidermidis
acgatgccttggacgatggaagattatcctcaaagttggaaaaactttgaagaactcgaacggaaaaaagcgattgatattggtaatgcgatgctcaaagatggctataaagaatctgatgtgatacctattgctacaaatcaagctgaaaaatggtatcaacatgcttcaaaagaagaattagagacgttaaaaaacaaacatatcacgcaacatcaagaagatgaatcagcaaatcctaaacttaacgaagaaaatgttcatgtatattatgaagatcagctatggaaagtaaaatctacagaggctaaacgagcttcagatacatttgacacaaaatctgaagcagttaatcgtgcacatcatatcgcagagaataaaggtactaaagtggtcgagcatcgaaaagatgagtga

SEQ ID NO: 1118 - DNA, 165 bp, S.epidermidis
atgttgaattgctcgagtgacgttacttatgtttcccaatccataatcaataatcgcaatcattcaattactcctttagacgatggaatacgtccatcttcattttgtgcaagagaaatctttaatgctcttgcaaaagatttaaatattgcctcaatctcatga

SEQ ID NO: 1119 - DNA, 126 bp, S.epidermidis
gtcatcgattggtatttatctattttacgttctgtagatgctaaacttactaaagatttactgctatcagttttagaagtagttggcgttgaaaattgctttgctttagtagttgtactaacttga

SEQ ID NO: 1120 - DNA, 243 bp, S.epidermidis
atgaattgttgccacaggctgctaaaacaaaaacaagtgcaacaatgcaaagtaaaagtcttttcatttaatcaaaccccttattcttattattctaatcggaataaaaatattttatcccgttattacataatagtcaataaagagttacttgctaacaagtgttcagaaagttcaaactctattaactattattttaaactatttacaaatcgtaataattactatttacaaataacttaa

SEQ ID NO: 1121 - DNA, 750 bp, S.epidermidis
atgaaattctgccctcattgtggaaatccgataaaaaaggaacagtcattttgtaataaatgtggaaaacatttaaagacatcgacacaaagaaaaagtgaaaatcaaattgaacatatgcgtgaacagcaatcgtatatttctcgtgaggaaagacaacatcatgattcaacattttataaagaacaaaaacatactggttggctaattgtattatcaattatatttgtcttgttgatagcagcgctattgtatggtgcgtactatgcttacaatcattatattagtgatgagcaaagtcaccaaacaacagagtctcagcaatcaaatgaaagtgatcaaaatagggaccaatccactggtccaagcattgatgtttttagtgatgactttgatcaaggttatatgaagtcagcttcaacaagtggatatagaggtgtttataatggaatgacacgtgaagaagttgaagataaatttggaacatccaatggttctgtagaaagtttgaagtggagttacgaaacatatggtgatttagctgtagcctacgatgataatgaagttgttagcgtaggtgtagcacctaatcatatttcagaagatcaatttttaagtatgtataatgaaccggatgatagaaattcaagccagctcatttatgatagtaacaaagataatgacttctctgtattagttaatgttaaaaatggagatgttactgtcattgaaaatgtaaatcaaatttaa

SEQ ID NO: 1122 - DNA, 129 bp, S.epidermidis
gtttgtagctgttttattttagtcaaaatcaatagttacgttattactttgaaaggggcatctagttgttatgactgtcgcacgcacaacaacatttatattaagtgttttcatcgtaggtatggttga

SEQ ID NO: 1123 - DNA, 789 bp, S.epidermidis
atgaaaagacttttactttgcattgttgcacttgtttttgttttagcagcctgtggcaacaattcatctaacaataaagataatcaatcaagcagtaaagacaaggatacgttaagagttggtacggaaggtacatatgcgccctttacttaccataataaaaaagatcaattaacaggttatgatattgatgtgattaaagcagttgcaaaagaagaaaatcttaaacttaagtttaatgaaacgtcatgggattcaatgtttgcaggattagatgctggtcgttttgatgttattgcaaatcaagtgggtgtgaataaagatagagagaaaaaatataaattctctgaaccttacacatattcaagtgctgtacttgttgttcgtgaaaatgaaaaagatattacatcattcaatgatgtaaaaggtaaaaagttagcacaaacgtttacgtctaattatggtcaattggctaaagataagggtgcggacattactaaggtagatggatttaatcaatcaatggacttactattatctaaacgtgtagatggtacatttaacgacagtttatcttacttagattacagaaaacaaaagcctaatgctaaaattaaagcaatcaaaggacatgcagaacaaaataaatcagcatttgcattctctaagaaggttgatgaaaaaacgattgagaaatttaataaaggcctagaaaaaattagagataatggtgaattagctaaaattggtaagaaatggtttggtcaagatgtttctaaacctgaataa

SEQ ID NO: 1124 - DNA, 165 bp, S.epidermidis
gttattttatgtaatgatagtgaggtttatttctttgatattcagagacaaaagagatactttataagtattcaaatctctgagtcgctatttttcttaatattaagcaccattaataaaaattttttccctttgactttatttatagatcgagctgacacttga

SEQ ID NO: 1125 - DNA, 531 bp, S.epidermidis
actttgagactaaaagtaaaggggagtatgaagatgaagtcttcagttcgattgttgaatcacatcataaagataatgaacttacaacaatcattaattataagagatgaacagtggaatcaatcttatgaggcatacaatttcaatattaatggctacgtatttaaaagtaggttagctaagaaaacaacaaagaaaaaaggatattttttatcgctttgggaaaaagataaaacaaagaaaaatcgagcatttgactatgagtcatttcctgggaaattaattgtacacgtgttggatgattctcaagtaggtcagtttatttttccaaaacatgtactttttcataaaggtattttaagaaatcatgcatctaaagggaaaatggcttttcgagtgtatcctacatgggagaaagatttaaatcgtgtcgctcacaagacacaagagtggcaaaaacaatactttatagatatgtctcaaacaattgatgtaccaagtattaaacgtgcttattttaatgaagattga

SEQ ID NO: 1126 - DNA, 135 bp, S.epidermidis
cattatctatgtttaaatatctcatttaacttatgcttatcaagagaattttttaaattaatcgcttcattgacttattcttacgttattatcattgaacgtaaaaatttattcgattattgtatagacgtctaa

SEQ ID NO: 1127 - DNA, 1191 bp, S.epidermidis
aaaggagtatggaaatcgatggaagaaagtaaaaactataatctcattacgacaatcatgtttatttcaggtatcattgtaatggcaagtttatatacggctctacctcttacagcaactttcgcagaagactttcatgttcctaaatctatagcaactttaaacggtgttttattctcattaacatattcaatcagttgtctattttatggaacgatttctgaaaagtatggcagaattaaaactattttagtaggtatgagtgcattagttatcatctgtcttatgataggtattgttcattcatttacagtgttattaatattaagagcactacaaggcgtatttgctgcatcattttctcctgtagtcatgacttatacaactgaaacttatccacgtgtgaaacgtgtaacagcaattagtttcatcagtacaagttttatgttatcaggtgtgttagggcaaaatatgagtgaattagtcgtaagttatttgaattggcagtgggtatattttattttaacaatcttatatttaattctcgtattagttatttataaaaatgtacctgagagtccacataaaaatcctgatatacaactcattaagtttttcaataactttaaagatttcaaagacaatcttaaagttttctattgtttatttatttcactaacattactgattatgtttataagtatgtatgatattttaaatgaatatgtcacatcacaccaagttgggggagacatgtctgtgtcctcaatgatgaaattgttcggtgtgataggcatgttattatctctattagcagggcgtgtaagcagtcgtataggtatgaagcgcttgctaactatcgcattaacaacatgtattgtgtcgatcatactcatgggtgtaactacgaatattatacttattacaacatttagtgtgttgtttgttgcaggtatcgcatttgcgattcctactgttatttcaaaaataggtgtagttgttaaaaacaatcaaggtttctttttatctgttaatacatttgtattattcttaggaacagcgattgcacctattttaatgttatttgtaggcgaactgtctaactttttcttacagtttttaatgattgctattgtcggactgattgctttagttgtatcaatatttatgccaggtgaccaacgttcttga

SEQ ID NO: 1128 - DNA, 162 bp, S.epidermidis
ataatttttttagtttcttctgattatcttctagtaactcatttaattttttgctacccttcatacatttattcctcccaattagcaattaacttatatacatacattttacatgtagtatatcactttttaaaacttttaatcattattgtatcgaactaa

SEQ ID NO: 1129 - DNA, 642 bp, S.epidermidis
ttaaatggatggaggaatttttttatggacaaattaacagtaggtttagaatggtttttaaatcctgatcatatgccgttaatcttaggtatcgaaaaaggttggtttaaagaagaatcattagaaattgagatgattgaaccaaaggaacactttgacgcactagacgagattgaaaatggttcaatggatatcgcgattactgaacctattcatctggttcaagatagagctaaagaacaaaaagtcatcgggtttgcgagatatcttcacactaatggaggtattatgtataacaaagataaaaatatcgctcgccccaaagatttaatcggtaaacggcttcaatatcccggtgctcccggtccaggtggtattgctatggctaaaacgatgattgaagctgatggtggtacatttgaagaaggtgacatcacaccagttaatcatagtttttatcatactgatgcacttttaactgataaagctgatgctgctacactcattttcgaaaattttgaaattcttgaagctagaaatcaaggacttaatgtagattattttccacttaaaaattataatgtacccgatttttgtcaactcattttcattacaacacctgaagtattaaataccgagtga

SEQ ID NO: 1130 - DNA, 1533 bp, S.epidermidis
agtagaggatgctcaatgaagataaaactgtttgtcattgttgtcatttttttgatgactattttatcgataatttcaataacaacacgagaaatcgcacatagtaagaatgagacgatattgacacatgcttctcaaaaacatattgataaaatggttgagacagcaatgaagaaaggagatatccccggactagcaatattgatcatcaaagacaataaaatctttttaaataaagggtatggttatgccaatattgaaaaaaaagcaaaggtaaatccacatactcaatttgaaattgcatccaatactaaagcttttacaggttatgcaattctacaactagctcaagaaggaaaaataaatttaaatgacaaagtaagtacatttatacccggatttaaaatgaagtatgaagacaaagaaagagatattactattgaacagctattagctcaaactagtggtatccctggagatatcactgaagaaaatcgttactctaaacagtacgatagtattgaaaatatcgttaattttgcaaaaggaaaacgtctgaaccatgtacctggagaaacttttgaatattcgaatatgaattatgatattttaggtcttattattcaaaatgttacccatcaatcctatacatcatacatccaaaagcatgttttagcccctttaaagatgaaacataccacttttaaagtaaataataccaaatctaataacgaagcattaggttatatatgggaagataatgaaaataaagttgcacaaccagagtttaacattggggatactcctgcggcatatatgatgtcaagtacaagtgatttagcaaaatgggtccaactacagatccaccctacttcaaaatcacaagccaagttaattcgtcaatcgcatcaggtattatctaactcattaaatagtgagcctaacgcagatagctacggttcgggatggtttataaatactgatgaccatctcgtatttcataccggcgttttagataatttctcttcacaaattttattaaatattcgtaaatcttatggcattgtcgtattagccaatacaaattcaaatcaagtgactcgtttagcggaacatttaaatactcaaattatgaataatcgtcattacacaactatagaagaaaaagtgaaccaaacgaaagatatgcaacttatcatttccacattggccgatatattcatggtcatatttagtatcttagtttttagtaaaatcttaaaattacgtgaaggccacatcttcatccgtaaatgtttacgaacttcaatcatgttcagcatcattttgttgggatttgtagcaatgaatattcttttttatctacttcccttgataatattaggagatgcaacttgggggtttgttttatcatggttacctttacattcgaaatatttagttgtaagtgtctatctagccataaccatgttactggtttggttatctttaataagtataacttaccgttctgataaaaagaaaaaacattaa

SEQ ID NO: 1131 - DNA, 1953 bp, S.epidermidis
ttgaatttgtgggatgttagagaaaggaagattgggatgcaacaaatcattaactctttgatacacttcgaccgttcaaaaattgatatagctaaaggaatacgacaaggatttttaatgatactaccagcattgataggttacttattaggattccctatgtttggtattctaatatcaacaggtacgctagcacatgtctacgtttttagtggatcaccacaatctatgttaaaaacagtcatcacctgttcactatcatttactatttgcatgattcttggcaccttaacagtatctcagcctattttatttggattactattactgattgttgttacaatcccatattatacgtttaatgcactaaaaatcgctggtccatcatcgacattctttttagtaacgttttgcttatctataaacttaccgatagccccagaagaagcacttttacgtggatctgcaattctcattggtggtatattggctaccataacagtaattttaacaatcatatttgctaaagagaaagcagaagacagagcaattcatgcggattttaaaacattacataacttgctacatcattttgatgagccagaggatttcaaagcatatgctcgaaacgctgttacagaatttagaaattctgaaaaacttttaattacctcaacatcaggtggtaatggaaaattaagtaaaaggtttcagaaattaattttattacacacatcagcacaagggatatattcagaattactagaactcaatgaaaatcatattcgtccattaccaagtgacttagttgaaatgatggatcatatcattaaaaatgttcaacaacctaaacaacaatatcgaccgtggtcaaaagttgttgatgtggcaccagaatttcaaaatttaatggatcatattttgaaaatagatgaaatgattcacgcaaacgataatcaaattaaatatgaagcagatattcgcaagcctttatatagtaagcgaatatatcaaaatctaactttcgactcaattgtatttagaaatgctttgcaatatacagttattatggcagtagctatatttattgctctagcgtttaacattcaaaaagcgtattgggtgccattgtcagcgcataccatcatgttaggtaatgtgacaacgattcgtacgttagacaggtcacttgctagaggtattggaacgataatcgggactattgttttgtcgggaatcttggcatttcatatcgatcctattttcgctattatcattatgggattttctgccatgatgacggaagcgtttgtggcatctaactatgcatttgcagtcatttttattacgacacaagtcattatgctcaatggtctagcctctcaaaatttaaatattgagatagcgtacacccgaattattgacgttctgataggtatagctattgcagttattggtatattcatactcgcgcgtaaaactgcatcctcaatgttatctgatgctattgccgaattggtacgtaaagaaggtattttatttcattatttattttcaaaaaataaacaggaaacgaatgaacgtgatagggtagaaagtttgaatttaaacgttaaaatcagtaatgtgacacaaatttacaattcagcgaatggtgaattgtttagtaataaagaagcggtaaggtattactatccaagcatatttgctctagaggaaataagttttatgctagagcgtgccatgaataataaacaccgacaaacaataaatgatgatttaatgggtgaatatttagtcgtatttgaaaatatagctaagcatttccaatttcaagcagatttaaatatcagagacatgcaaccattacctcaatataattacatccgtgcttcgcttatgaatatacagcgtaattgtgctgaacaacgtcaggccatcacaaaagattag

SEQ ID NO: 1132 - DNA, 612 bp, S.epidermidis
atgaagcagtggatgaatagattaatcaccttaataggcgtattgttaatcattttagctatttatttattctcaaagccatatatcgataattatctacatgaaaaagataacgatcataaaattgaaaattatgataaaaaggaaaaagaacagacaaagacatctaaatcgacgccaaagataccttccgataaatctaaaatggctggttatatagaagttccagatgcacaaataaaagaaccagtataccctggtccagcaacaccagaacaactcaatagaggtgttagttttgcagaaggtgacgaatctcttaatcaacagaatatttcaattgctggtcatacgtttacagatcgttcgcactatcaatttacaaatttaaaatcagccaaaatcggtagtaaagtgtattttaaaactggaaatcaaactagaaagtataaaataactaaaatacgtgatgttaagcctacagaggttaaggtattagacgaacatcctaataagaaaaatcaattaacattaattacttgcgatgactataacgaagaaacgggtgtttgggaaacaaggaaaatattcatagctacacaaattaactaa

SEQ ID NO: 1133 - DNA, 141 bp, S.epidermidis
aaattatgtcgtacgtcatacccctttttttataataaatttcttttaatcacagaaaaatcgtattacaaatttaaatataccctatttttaaaattttcaatcaatcttatgtttaaaaacctcactaaagcccgttga

SEQ ID NO: 1134 - DNA, 129 bp, S.epidermidis
aagtgtagtcgtgtagctataatgacatttaatataaatttttataaaatgagaataaagtcactgaataaagagagggattcaatcgatggcaaatcaaaaattaccaacattaaaatatactggtaa

SEQ ID NO: 1135 - DNA, 174 bp, S.epidermidis
aaacctatgctatatgtcccatttctaataaatacacacgagaatcattataaagccttttatgaaaaaaagaaaagtaattttctgaacaaaaattatttcttaaacatagataagttcgattgtaaaatacaaacatttttaaagaaattgacactttttcatcaattatga

SEQ ID NO: 1136 - DNA, 699 bp, S.epidermidis
ggagttatttttatgactggaaatcaaatgttttgtagagaaaatgaacttgatgaaagttttaaacaattagcatcttatatcaatattcctgtaggcgtattactgccatttaaaagtcaatgttttgtgagacattacaacaaaggacaaattgtctactattcgtctgatgaaaccacgcatatttatctactcttaaaaggtaatattatgagagaaaattttaatttgaatggtgatgtatatcgatatctgaatagagaaaaagtgctctttcctttaaataacttatttcaagataaagttcctaatgaaatgtgtacagccctaacagattgcgaaatgattggaataccaagagatttaatagaatatttatgcaaaaatcacgaagagatttttgtgaaattattctccttattaagcgaaacacagtgtcaacatattgaatacaatatggctttaacgagtaaattagctaaagaacgcgtgactaagattttacgttacctatgtcaaacagtaggttatgatcatgacgagttttatgaaattaagcattttatgacaatacagttattgagtgatatggcaggaatatctagagaaacgacgagtcatatcataaatgaacttaaagaagagaaaatactctttaaaaacagtaaaaattggttggttagtaaagacttataa

SEQ ID NO: 1137 - DNA, 576 bp, S.epidermidis
agaagttcccgcaagtcaatacaaaggtcaaggtttccacaaccagtagctgaaaaaagtgctatcgcacatgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcccttttgataaggaagcaatacatgaagaaggctccatgcgaagcaatgataatggagataccatgagtaatatggttggaactgtgttaagtggttttgaatataaagcacaaaaagaaaaatatgataacttaacaaagttctttaaaaacaatgaagaaaaatatcaatataccggttttactaaagaagcaatacataagacacagaatgttggatatcaaaatgagtattattatttagcaggtaacgttactaatattaataattatagaaaatattatgaacctttaataaaaaaagattctaagagtttcaaagaaggtatgaaaaaaagcaaatga

SEQ ID NO: 1138 - DNA, 978 bp, S.epidermidis
aattgcacccgacaagaatatcgtggctcactaggttcacttaatcaactaatgattacaattggtattttagcagcatatttagtcaactatgcatttgcggatattgagggttggcgttggatgctaggattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccagcaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaattacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccaatgcgcgcacgtggcgctgctacgggcatttcagcgcttgtgctaaatatcggaacgcttatcgtgtcattgttcttcccaatattaagtgatgcattaagtacagaatgggtatttttaatctttgcgttcataggtgttttagcgatgattttcgtaattaaattcttaccagaaacacgcggacgtagtttagaagaaatagaatatgaattacgtgaacgtacaggggcaagaactgaataa

SEQ ID NO: 1139 - DNA, 2082 bp, S.epidermidis
atagaggtgctaattgtgaagacaagacaaaataaatacagtattcgtaaatttagcgtaggtgcatcatccattctgattgcagcattattatttatgggtggaggatcagctcaggcagctgagcaacaacaggataagggaactgttgaaaatagcacaacacaatctattggggatgaaaatgaaaagttaagtgaacaacaatcaacgcaaaataagaatgttaatgagaaaagtaatgttgattctattactgaaaatgaaagcttacataacgaaacaccaaaaaatgaggatttgattcagcaacaaaaagattctcaaaacgacaataaatctgaatctgtagttgaacaaaataaagagaatgaagcatttgttaaaaaacattccgaagagaaaccacaacaagaacaagttgaactggaaaagcatgctagtgaaaacaatcaaactttacactcaaaagcagcacagtccaatgaagatgtgaaaactaaaccttcacaacttgataatacaactgcccaacaagaagactctcaaaaagagaatttgagtaaacaagatacacaatcatctaaaactactgatttactacgagcaacaggtcaaaatcaatcaaaagatagccaatcaacagaagaggtaaacaaagaagtaaaaaacgacactcaacaagtgactgctaagaacgatgacgacaaagttgaaacatttaatttaaatagtaaagaggaacctcttaaagttgacaagcaagcgaatccaactacagataaagataaatcttctaaaaatgataaagggtctcatgatggtctcgctaatttagaaagtaatgctgttgctacaactaataaacagtctaagcaacaagtaagtgaaaaaaatgaggatcaaacaaataaatcagcaaaacaaaaacaatataaaaataatgatccaattattttagtacatggtttcaatggatttacagacgatatcaacccatcagtgctaacgcattattgggggggcgataaaatgaatattcgccaagatttagaagaaaatggatatgaggcttatgaagcaagtataagtgcatttggtagtaactatgaccgtgctgttgagttatactactacatcaaaggtggacgtgttgactatggtgcagcacacgcagctaaatatggtcatgagcgttacggtaaaacctatgaaggtgtgtataaagattggaaaccaggtcaaaaaatacatttagttggtcatagtatgggtggtcaaacaattcgccaattagaagagctattgagacatggtaatccagaagaagttgaatatcaaaaacaacatggtggggaaatttctccattattccaaggtggccacgacaatatggtgtcatctattacaacactcggtacaccacataatggtacgcatgcgtcagacttattaggtaacgaagcaattgtacgtcaacttgcatatgatgtaggtaaaatgtatggtaataaagattcacgtgtagactttgggttagaacactggggattaaaacaaaaaccaaacgaatcatatattcaatatgttaaacgtgttcaaaattcaaaactatggaaatcaaaagatagtggtttacacgatttaacacgcgatggcgcaacagatttaaaccgaaaaacatcattaaatcctaatattgtatataaaacttatactggcgagtcaacgcataaaacattggcaggaaaacaaaaagctgatcttaacatgttcttaccatttacaattactggtaatttaattggaaaagctaaagagaaagaatggagagaaaatgatggacttgtttcagtcatttcttcacaacatccatttaatcaaaaatatgttgaagctacagataaaaatcaaaaaggtgtatggcaagtaactccaacaaaacatgactgggatcatgtagactttgtaggacaagacagtacagatacaaaacgtactagagatgaattgcaacagttttggcatggtcttgctgatgatttagtacaaagtgaacaattaacatcaacaaataaataa

SEQ ID NO: 1140 - DNA, 168 bp, S.epidermidis
ggtcgtcaacggtctagtaatgcctcatccgctatagtatttattattgggggcacttattcgttgctgcatcaacccaatttagcattatttaattattgggccgttttaattattgcgtttaaccagtggggtggttcgatgttttcgggtacttgttttatttaa

SEQ ID NO: 1141 - DNA, 123 bp, S.epidermidis
atgcataaacgaattgtgtcattcttgaccacctcttattttttattatgtcatactatttatttacaagtatgtcataataaaaagagaattacaacatttttaagaaaaggctttcattaa

SEQ ID NO: 1142 - DNA, 471 bp, S.epidermidis
aatggtaaacgatgccgagaaaagattattaatcaaaatcgtgatattgtcgcaactgagaaatctttaccaccgtggaaacgttttttaagtcatttcagtttctacgcaatcgcattgcaatactttgtagttcagtttgttatcgcgttgttcctaatatggttaccaacatatttaactgaacaatatcatgtgaatttcaaagaaatgactatcagtgcattaccttggttatttatgttcttcttaattttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactga

SEQ ID NO: 1143 - DNA, 150 bp, S.epidermidis
gtgaacaagcgagacgatatacgtataccattttcaagtgaaaacgatgttaaaaataaattgtttaatattgtttatgcttacaatgctgtaaaaaagaactttaaacaggctgaagactctagaaatcctagaggtcaaaacctttaa

SEQ ID NO: 1144 - DNA, 627 bp, S.epidermidis
gggaaatggcgtttttttattgtagaaattggggggatatttatatttattgcgattacatatcataaacaactgactaaggacgatttacagcattataaacatatcgaagaagctattgatggcttgttatttcgcacttccatgaataacgaagaaaacaaggagatgattcaatctttacttcaattgggttttagtaaagataaaataattattcatagcgatgtgacactgttagaggatttacaccttaaacgtatccattttaaagaaaatgacacaactgctttcacatataaagaagctcatcctgatatttgtgtaagtatgtctacacatgacgttgaaacagtaaaacgatgttacgaaaatggtttggattctgtcttttttggacatatttttcctacctcttcacatccaaatgtaccaccgcgttctaaagaagctattcaacaggcattaaatgttcctatccctatttatgctattggtggtattaatgaacattcacttcaaaagatgccacctggatttaaaggtatatgtgccatatcatattttaacaatgcttcactagaagaaattaaacaattaagaaaggagtggtctactcatgcatga

SEQ ID NO: 1145 - DNA, 597 bp, S.epidermidis
tatatttttagaaaattgaataagggggagattttagaattgaaagataagattattgataacgcaataaccttattttccgaaaaggggtacgatggtactacacttgatgatatttctaaaagtgtaaatataaaaaaggctagtctatattatcattacgataataaggaagaaatatatcgaaaaagtgttgagaattgtttcaattactttatagattttttgcttaggaaccatgatgataattattccattgacggactttaccagtttttattcaaatttatattcgacgttgatgagagatatattaaattatatgttcaattatctagtgctccagaagcactgaattcagaaatcaaacaccatcttcaagaaattaatactaccttacatgatgaattgataaagtattatgatcctacgcacatcgctttggataaagaggactttataaacttaattcttctttttcttgagacttggtattttagagcctccttttcacaaaaattcgggattattgaggacagtaaaaaccgttttaaagaccaagtatattcactgttaaatgtatttttaaaaaaataa

SEQ ID NO: 1146 - DNA, 123 bp, S.epidermidis
acaatatttagacaatcggagtttatagagaattcaagtaagcctcacattaaagaatgtgcaggcttatttgtatatttggaatttttaacttggaagttaaaacaaattctaaaactatag

SEQ ID NO: 1147 - DNA, 471 bp, S.epidermidis
agggaatttagaataaaatgttttacggaggagattaatatgaattggttaaaaatattttatcatttattatgcgcaaccacgattagcgtgatattacttattataactatattaatggatgtgttactacaaaacacacatttaactcagttattactcaatattgattttttaatcaaccctgatgaagtgccaacaattattgaagtactgattcatttaagtattggaatattgatttatctcgcctttttaattatctatcattattcaaaatccttgtatcatctagcatacttacctttagtattgatatttactttgatgtatccacttctcgtttttcttgcgcaacgtccatttttttcctttagttggaacgaatttgcatggtggttagttgcacatctttttttcatcattttaatggcgacttgtctacctatcatttcgaaaaaaattttatga

SEQ ID NO: 1148 - DNA, 375 bp, S.epidermidis
actattcttagagaacgtctttcaatttctttatgcttatctgcacgtctttctaacttgatacgatctcgtccgagtataattaagaacgaaatcatcattagcgtaaatataacaattaaaggtacactagcaagtaatgatgctgttttcaatacttctaatgcacgttctcctccaactagcattaaagagaacggtagtaaacataacgcaaacgcccagaacaaacgattagcacgtaacggttctcctatcacttttttctgtgacgctgctgctaaaatatatgaaccagaatcgaatgttgttgctaagaataagaaagctgatattaagaataagataatagtaattgtcgagaatggtagttga

SEQ ID NO: 1149 - DNA, 1557 bp, S.epidermidis
ggggtaattagaatggtagtacctttcaaaaatgaacctggtattgatttttcagtacagacaaatgttgagcgttttaatgaagaattaaggaaagtaaaagcgcaactaggacaagatataccacttgtgattaacggagaaaaacttactaaaactgatacttttaattcagtgaatcctgcgaatacatcacagctcattgcgaaagtgtctaaagcaacgcaagatgatattgaaaaagctttcgaatcagcaaatcatgcgtatcaatcatggaagaagtggtcgcataaggaccgtgcagaattactgttacgtgtagccgcaattatccgtcgtcgaaaagaggaaatttccgctattatggtttatgaagccggcaagccttgggatgaagcagttggagatgcagctgagggtattgattttatagaatattatgcaagatcaatgatggaacttgcagatggtaagccagtattagacagagaaggtgaacataatcgctatttttataaacctattggtacaggcgtgacaattccaccatggaattttccatttgcaattatggctggtacaaccttagcccctgttgttgcaggtaacactgtattattaaagcctgctgaggatacagttttgactgcttataaattaatggaaatattagaagaagcaggtttaccacaaggtgttgtaaattttgttcctggtgatccaaaagaaattggagattatttagtcgaccataaagatacacattttgtcacatttacaggatcccgagctacaggtacacgtatttatgaacgtagtgctgtagtgcaagaaggacaacagtttttaaaacgtgttattgcagagatgggtggcaaagatgcgatagttgtagataataatgtagatacagatttagcggctgaagcaattgttacatctgcttttggtttctctggtcaaaaatgctctgcgtgttctcgtgccatagtccatcaagacgtacatgatgaaatattggaaaaagcaattcaattaactcaaaaattaactttaggtaatactgaagagaacacatttatggggccagtaattaatcaaaaacaatttgataaaatcaaaaattatattgaaattggtaaaaaagaaggcaaactagagactggtggtggaacagatgattctaccggttatttcattgaaccaacgattttctccggactacaatctgcggatcgtatcatgcaagaagaaatttttggaccagtcgtaggctttattaaggtcaaggattttgatgaggctattgaagtagctaatgatactgactatggtttgacaggcgctgtaattactaatcatcgtgaacattggattaaggctgtgaatgaatttgatgtaggtaacctttacttgaatagaggttgtacagctgcagtagtgggttatcatccatttggtggattcaagatgtctggtacagatgctaaaacaggaagtccagattacttacttaatttcttagaacaaaaagttgtttctgaaatgttttaa

SEQ ID NO: 1150 - DNA, 2871 bp, S.epidermidis
aggagaattagattgagtaatttgatacaagatattaagcaatctttatataagggatttatagataaagatagttcccataaaggcaattttgttccaagattactagtaaataacaaagaagaaaatgtactttctactattatagatcagctgcataattgccaatcattttgtatttcggttgcatttataaccgagagtggtttagcaagtctaaaatcacatttttatgatttaagtaagaaaggcgtaaaaggaaggataataacatcaaattacttaggatttaatagtccgaaaatgtttgaggaattattaaaattagagaatgtagaggttaaattaacaaacattgaggggttccatgctaaggggtacatatttgaacatcataatcacacttcttttattatagggagttcgaatttaacttctaatgcattgaaattgaattatgaacataatttatttttatctactcataaaaatggagatcttgttaacaatattaaacataaatttgatgaactttgggattctagcttttctttaactaatgaatggataaatgaatataaacagtcttttgaatatcaaacattgcaaaaagtatttgataacactgtcgttcaaaattcagaaattaaaaagtttaatgagtcaaaacttataaaacccaatttaatgcaagaacacgctttaaagtcattagaatctttgagaaatgtgggaggagaaaaggggttaattatatctgcgacaggaactggaaaaactattttatgcgcacttgatgtaagagcatattctccagataaatttctatttattgttcataatgaaggtatattaaatagagctatagaagaatttaagaaagtatttccatatgaagatgaaagtgattttggattattaacaggaaagagaaaagatcatgatgctaaatttctttttgcaacaattcaaacactttctaaaaaggaaaattataaattctttaactctaatcattttgactacatcgtttttgacgaggcgcatcgaactgctgcatctagttatcagaaaatatttaattattttaaacctaactttttgctaggaatgactgcaacaccagaaagaactgatgaattaaatatttttgaattatttaattataatattgcttacgaaattcgtttacaagaggccttagagagtaatattttatgtccttttcattattttggagttacagattatattcaaaatgaaatgagtcaagaagatgcatttaatctaaaatatttagcatctaatgagcgtgttgaacatatcataaaaaagactaattattatggttactcaggtgatgttgtaaaaggtttaatatttgttagtagtaggggtgaggcgtatcaattagcaaaccaattaagtaaacgtggtatatcatcggttggtttgacaggaaaagattctatagcttatagaactgaaacaattcaacaactaaaagaaggatctattaattatataattactgttgatttgtttaacgaaggaattgatattcctgaaataaatcaagttgtaatgttaagacctactaaatcaagtattatatttattcaacagcttggtagaggattaagaaaaagtactaataaagaattcgttactgttattgattttattggtaattataaaactaactatatgatcccaatagccttatctggaaataaatctcaaaataaggataattatagaaaattcttaacagatactacggttttaaacggtgtttcaacaataaattttgaagaagtagctaaaaataaaatttataattcactagattctgttaaattaaaccaaccaaaattaattaaagaagcttttaacaatgtaaaagaccgtataggtaaattacctttactcatggactttataaataacgattcgatagatccaagtgtgattttctcacgttttaaaaattattatgagtttttaataaaaaataaaattattgagaatgaattaagtattaatgaatttaaaaatttaacatttttatcaagacaattatcacctggacttaaaaaagtagatattgatgtattgaaagaagttatacaaaatgacgtaacttatgaaaatttaacaaaaaaaatgttaaacattaataacgatatttctgaatatgatattaacacttcattaagcattttagattttacttttttcaaaaagactataggtaaaacttatggactacctttaatacaatataaggataatcttatttgtctagcaaatgaatttaaagaggctttaaataaaccactatttaacacatttgttcatgacttaattgatcttgctaattataataatgacagatatcaaaataagaaaaacagtttaattctatataacaaatattctagggaagattttgttaagttattaaactgggataaagatgaatctggaacaatcaatggttatcgtatgaaacatcgtacacttcctttatttatcacttatgataaacatgagaatatcagtgataatactaagtatgacgatgaatttttgagccaagacgaattgaaatggtacacgcggtctaatcgtaaattaacttcaccagaagtacaaaatattttaaagcatgaagaaaataatacagatatgtatatatttgtgaaaaaaagagatgatgaagggaaatatttctactatttaggtaaagccaaatatattaaaggaactgagaagcaagattatatgcctaatggaaatagcgtggtaactatgcatttatcaatgaatacgtccattcgagatgatatttatagatacatcacttaa

SEQ ID NO: 1151 - DNA, 156 bp, S.epidermidis
aacattgttagttacatgctttcgttacgctatttacagacttcgtttaacgaaataactctatgtaaacattacaaaatgataacaccgcacacaaacgtacatttttctgataaagtaatgcttgtcgttaaaaaagaacgaaaccaaggataa

SEQ ID NO: 1152 - DNA, 129 bp, S.epidermidis
acgacacctagcgcccctcttttaagaagtaataaagataaagcgatagatatcattaatgtccatttattaggaatgctaactataaaaatggataagataatcaaccattcgataaatttacgttga

SEQ ID NO: 1153 - DNA, 210 bp, S.epidermidis
cctttttatagttgttttaaagtgaaattttttaaaaagtatgaaattgatttaaaaaaagatattttgtttatgaaaagtaaattgaatgagagattggaaatgaaaaacagagactgtggaagtatgaaagtatataaaaagagtagaacagaattcaatttgaattcattattctactctttaatcttgtatagaaacatttgctaa

SEQ ID NO: 1154 - DNA, 864 bp, S.epidermidis
aagtctaatagaaaaacattaaaattattgtacggctatattaagatgaaaataaatgttttatgcgagaagagggacaatatggatattaaacaatcttcagagaaacaaggtcgaccgcatcatttatcagacagtaggacagttttgaaaagaaattttatattaataccaacttatattttattacaaagtatcataccaatcattgttgttttcggctcattaggcatcactgccatgataacacaacaggcaccaccacaatggttgtatcattgttcattgagtttaagttttgtgattgctcaaggtctaatattaattatcttttataaaatacatcaatctgtaataaatgatgtgatgaagcaacaatggataattgcaaagaataaaataattaaaattgtaatagttgcgattgtcgtatatttattattacttataattcgggtgattggaacatcattacctaatcatttaagttatcatctcactcaatccgaacaacgtacgctagggctatttaaatcaccatatgtgttgttagttacttttatatccatggtattcttacgtccaatggtagaacaaatcatttatagatatctcatcatccatgaattaggaaaagtatggaatagacaatttgtaattggtttgtctattgttattgaaacgatcgtacatgtttacgacatggcatcgatttttgaaatttttccatatatcgttattgcttcagcagctacaatactatatattaaatcgcgggataatttaattgtcgcttatatatttcaagtgattttgcaatgtatcctttttatagaaattttatgtaagtataccaacttttaa

SEQ ID NO: 1155 - DNA, 141 bp, S.epidermidis
aagtatttcagagtttgcgtcgatgtattgaactttgagactaaaagtaaaggggagtatgaagatgaagtcttcagttcgattgttgaatcacatcataaagataatgaacttacaacaatcattaattataagagatga

SEQ ID NO: 1156 - DNA, 858 bp, S.epidermidis
ctacagctcagagtcaagcggaggaaagcgagcgataaggtgaaggataataatgaagtattaaagttatttatagtttcagattcaattggagaaacagcgcaacggatgattcatgcgacgctgacacagtttccagatttaactcaagtagaaattaagaaatttccatatattaaggacgaacaagaatttttaaatgtcttacaattagctaaagaacagaatgcaattgttgcaacaacattagtgagtgagtcatttaatgcattaggtcatcagtttgcaaatgaacatcaaattccctatgtagattacatgtctgagttaattagcataattaaacaacatacacacgctaaaccattaatggaaagtggtgcgttgcgtaagcttaatgatgagtattttaagcgtatagaagcaattgagtattcagtgaaatatgatgatggtaagcattttacagatattggagaagcggatgctttaatagtaggtgtatcacgtacctctaaaacgccattaagtatgtacttagctaataaaggatataagattgcaaatattcctttagtccctgaagtggctattccagataatgtatttcaacaaaagaatttaaaggtatttggattaacagcaagtcccaattatatcgcaaatatacgacgtaatcgtgcagaaacattagggctatcttcagaatctaattacaatagtttagagcgtatcaaaaaagaattatcttatgctgaagaagtttttagaaaattaaatgcaacggtaattaatacagaatataaatcgatagaggaatcggcattttatattgaaaagtttttagctaaacgttaa

SEQ ID NO: 1157 - DNA, 129 bp, S.epidermidis
agaatgtgcaggcttatttgtatatttggaatttttaacttggaagttaaaacaaattctaaaactatagcaatggctaaagatatgattaagttcattaaaaaaggtgtcttaagaatgatttattag

SEQ ID NO: 1158 - DNA, 153 bp, S.epidermidis
acttctttaagtaagtgggggacaagcagcgctgaatacattggtatagcgagtacaatcgctactactattgaaccgaaccaacaaatacgacgtgctttactccctagaaatttttctgtctgctgtccaggttgtataccctcgaagtaa

SEQ ID NO: 1159 - DNA, 660 bp, S.epidermidis
gtctacttaaggagtgtttgcatggaaatattagtcacagcatttgaaccatttggagatgaaaaaattaattctgcactagaggctgttagccatttggaaactaaaattggctgtcataaaattgatcgattgatacttcctacagtatttcatgactctgcggatatgattgctaaagtgttaaaatctaaaaattatgatgttgctctagctatcggacaagcaggtggtcgtagtgaaatcactcctgagcgtgtaggtataaatatagatgacgcacgcattaaagataatcaaggacaccaacctattgatcaagttatacgtcacgatggcgcacctgcttatttttctaatttacctatcaaaagaatgacaatggcaattcaaaaggctggtcttcctagcagactatctaattccgctggaacatttgtatgtaatcatatcttatatcaactcggatatatggcagaccatttttaccctgacttattatttggatttatacacgtgcctttgattcctgaacaaacaatcaatcattctcaacaatcttcaatgtccgttgaagatatcgtaaaaggattaactgaagcaatcaaagctatcgacttcgttgaagataacaagatcgcattaggagaaatccaatag

SEQ ID NO: 1160 - DNA, 1383 bp, S.epidermidis
aaatatataagcaaaggcctttgtcttttgtttaactttagtcattatttgtttaacaattgcatcagaggtctttttttaggtcatggaacaagacattctttatataggaaggggaaaacaattatgttaagtattaaaaacttaaccaagatttattcagggaataaaaaagcggtagataatatttctttggatattcaatctggtgaatttatcgcttttattgggacgagtggtagtggtaaaacaactgcactacgcatgattaatcgtatgattgaggcgacagatggacagattatgatgaatggaaaagatgtccgtaatatgaatcctgttgaattgcggagaagtatcggttatgtcattcaacaaattggtttgatgccacatatgactattcgagaaaatattgttttagtacctaaacttttaaaatggtctaaagagaagaaagatgaaaaagctaaagaacttattaaactggtagatttacctgaagaatatttggatcgttatccagctgaattgtcaggagggcaacaacaacgaattggtgttgtgcgcgctttagcagctgaacaagatattatattaatggatgaacctttcggtgcattagatcctattacacgcgatacattacaagatttagtaaaggaattacaacaaaaattaggaaaaacatttatttttgtcactcatgatatggatgaggctattaaattagcagacaaaatatgtattatgtctaagggaaaagtcgttcaatacgatacacctgacaatattttacgatatcctgcaaatgactttgttagagattttattgggcaaaatcgcttgattcaggatcgtcctaatatgaaatctgtggaaagtgctatgatcaaacccgtcactgttaaagcagatgattcattgaatgatgcagtaaatattatgagaacacgtcgagtagacactatttttgtagtcaataatcaaaataaattattaggatttttagatattgaagatatcaatcaaggattacgtgcgcgtaaagaattaattgataccatgcaaagggatgtctacaaagtacatatcaattcaaagttacaagactcagtgcgtactattctaaaacgtaatgttagaaatgtacctgtggtcgataatgatgaacatctcattggtttaattacacgtgcaaacttagtcgatattgtgtatgactcaatttggggcgaagaagattctgatagttatgagatcccaaatgaaagcttagatgagaataatcacgatttaccacaaaatcaaactgatacacgaacaaatataaatgaagatgtgaatgattatcatgatgctcaacatagaggtgaggattaa

SEQ ID NO: 1161 - DNA, 123 bp, S.epidermidis
aacttaataagtaacaaaacaaaagtgtacgttaaggacgtttatcagcgtgatcacgtgcactttttaactatgaataaagttgatttaaaaattagaaaggaggaacaacgacgatgctaa

SEQ ID NO: 1162 - DNA, 1761 bp, S.epidermidis
aaagggaggctatttgtaaaaatggcacaaattaaagcaaatgaagcattagttaaggcattacaaacctggaatattgatcatttatatggtattcctggcgactcagtagatgctgttgttgatagcttacgtacggtcagagatcaatttaaattctatcacgtacgtcatgaacaggtagcgagtttagctgctgcaagttacacaaaaatgacagggaaaattggtgtagctttaagtatcggaggacctggtattgtacacttattaaatggtatgtacgatgctaaaatggataatgtacctcaacttattattgctggacaaacaaatagtacattattaggtacaaaattcttccaacagacaaacatttctaaaatggttgatgatgttgctgtatatcaccaccaaattcaaaaaggtgataacgtatttgaaattacaaatgaagcaattcgtacggcatacgagaaaaaaggtgtctctgttatcatttgtccaaatgacttattaactcaaaaaattaaagacactacaaatcgtgcagttgatacaactaaaccaaaaccagcttcaccaaaattcaaaagtattaaaaaagcagctaaattaattgataaagctaaaaaaccagtaatgcttattggtttaggtacacaacacgctaaagatgaattacgtgaatttattgaagctgcaaaaattccagttattcacacattacctgcaaaaacaatcttacctgacgatcatccttatagtattggtaacttaggtaaaattggtactaaaacatcttatcaaacaattcaagatgcagacttattaattatggctggtacgaactatccgtatgttaactatttacctaagaaaaacattaaagctattcaaatcgatacgaacgaagaaaatattggtgcacgctttaaaattaatgtaggtattttaggtgatagtaaagttgctttccatcaactaactgaaaacattaagcatgttgcaaaacgtccattcttagataagacattagaacgtaaagcagtttgggataaatggatgaaacaagatttgaataatgacaattcaccattacgtccagaacgtttaatgaaagcaatcaatgctaacttaaaagatgatgcaattatctcagcagatgttggtacttctacagtatggtctacgcgttacttaaacttatctgtaaataataaattcattatttctagttggttaggtactatgggctgtggtttaccaggtgcgatggcagctaaaattgcttatccaaaccgtcaagcagtagctatcacaggtgacggtgcgttccaaatggtaatgcaagactttgctacagctgttcaatataacttaccaatgacaatcttcgtattaaataacaaacaattgtcattcattaaatatgaacaacaagctgctggtgaattagagtatgccattgatttttctgatatggatcatgctaaatttgctgaagctgctggtggtaaaggctatgttgtgaaagatgtaagtcgtcttgacaacatcgttgaagaggcaatggctcaagatgttccaacaatcgttgacgttcatgttgatcctaatgctgcaccattaccaggtaaaattgtaaacgaagaagcatttggttacagtaaatgggcttatagatcaattactgaagataaaaacttagactttgatcaaatcccaccaatctctgtagcagctaaacgtttcttataa

SEQ ID NO: 1163 - DNA, 327 bp, S.epidermidis
gaaggtgtaagaatgaaaggtaaagaaaaggttaaagttacaacaatgaatgaaatgattcctcaaataggcaaaaaagtagttgtaaacgaaaaagaaataggtatttttcttacagataatggtgatttatatgccattggaaatatatgtccacataaagaaggaccgttgtctgaagggactgtaagtggtgattatgtttactgtccgttacacgatcaaaaaatagctttaaaaactggagaagtacaacaacctgatacaggatgtgtagaaacatatgaagtagaagttattgatggagatatttacttatgtctataa

SEQ ID NO: 1164 - DNA, 156 bp, S.epidermidis
catgttacaagttatctgacaagtatttttcggaaaattctttcttttataatgaaatctttctacgttcttaattatcaattttcaattaaaataaaaacctcttgcaaagtaactaatactttacaagaggcatatattattgatcagtattaa

SEQ ID NO: 1165 - DNA, 147 bp, S.epidermidis
acaaatcaaagtatcaatctttgttcacctaaagattatctaataattgcaattgctagatttcatatcatttctagatttgagagtaactatttttctgagcgtatacctgttgtaataaatattgaccattttctaataagttaa

SEQ ID NO: 1166 - DNA, 711 bp, S.epidermidis
attatagaaaggaagtttttatttatgccaaaattaatactatgtcggcacggacaaagtgaatggaatgcgaaaaatttatttacaggttgggccgatgtcaaactatcaaaacaaggaattgaagaggcgcaatcagcaggtaaaaaaatttacgacaatcaaattgaaattgatattgcgtttacctctttactcactagagctttagaaacaacacaatatattttagcaggttctgaccaacagtggattcctgtttataaaagttggcgtttaaatgaacgacattatggtggtttacaaggtttaaataaagatgatgcgagaaaaaaatggggggaagatcaggtgcatcaatggagacgctcatatgatgtacgtccgcctagagaaagtgaagaacaacgagaagcatatttaaaaaatcgtcgttatcaacatattgatcaccgtatgatgccttattgtgaaagtttgaaagatacattagaacgagttgttccgttctggactgatcatatttcacaacacctattagatgataaaactgtacttgtttcggcccacggaaattccattcgcgcattaattaagtatttggaaggtttatcagaagaagatatcgtcggatatgaaattaaaacgggtgcaccgctagtatatgaactcacagatgatttagttgttaaggataaatattatttataa

SEQ ID NO: 1167 - DNA, 903 bp, S.epidermidis
ggagtggaaagtatgaataaagaacaattagaaaaaatgactcatggtaaaggattcattgctgcattagaccaaagtggtggtagtacacctaaagcacttaaagaatatggtgtgaatgaagaccaatacagtaatgaagacgaaatgttccaacttgttcacgatatgcgtacacgtgttgtaacttcaccttcattttcacctgataaaattttaggtgcgattttattcgaacaaactatggatcgcgaagttgaaggtaaatacactggagactatttagcggacaaaggcgttgttcctttcttaaaagtcgacaaaggtcttgctgaagagaaaaatggcgtacaattaatgaaacctattgatgatttagatgaaactttagatcgtgcaaatgaacgtcatatcttcggtactaaaatgcgttctaacatccttgaacttaatgaacaaggaatcaaagatgttgttgaacaacaatttgaattcgctaaaaaaatcatcgctaaaggtttagtacctattatcgaaccagaagttaatattaatgctaaagataaatctgaaattgagaaagttttaaaagctgaaatcaaaaaaggtttagattcattaaacgatgatcaattagttatgttaaaattaactattcctactgaagctaacttatataaagatttagctgaccaccctaatgttgtacgtgtagtagtattatcaggtggttacagccgagatgaagctaacaaattgttaaaagataacgatgaattaattgcaagcttctcacgtgcattagcaagtgacttacgtgctagccaatcacaagaagaattcgataaagcattaggcgatgctgtagattcaatctatgatgcgtcagtaaataaaaactaa

SEQ ID NO: 1168 - DNA, 855 bp, S.epidermidis
caaaaaggaagtatcactatgcataaacgacttttcatcactttattaggttttatcattttactagctggatgcgattattctaaagaagagaaccaaactggtatattttataacgtttttgtaaaatctatggatggatttcttcattttcttggcagagtctttcaggataactatggctttgctattatttctattgtactcatagttcgtttcatcctattacctttcatgttaatacaagttaagaatatgcatatgatgcgcgaaaaaacaaaagtcgtccaaccagaattggatgctataagagataaaatgaaacacgcaacatcacaagaagaacgtaatgcagccaatcaattgcttatgaaaaagtatcaatcgtatggaattaatccattaaaaaatatgttagggtgtcttcctgttcttatacaaatgcctatattaatggggctttatatgagtttgaagtacccttcgagtcacggaattactgaatacccacatttcttatggtttgatttaacgcaacctgatttgattatgacaataatcgcagcaatcatgtattttgttcagccacttgtaaactcaatccattatccaaaagatcaaagaaaaacatattactttatgatggtattttcaccgatattcataacatatgcgtctctacattctgctgcagctttgggcttatattggagtataagcgctgcttttctaatagtgcaaatgcattttgctcactctcattataagaaagtggcactacatgaagctaaaaaactcaaacaaaaattagagcaaaataaagacaatagtgagttattaaccgaagagtcataa

SEQ ID NO: 1169 - DNA, 1362 bp, S.epidermidis
aattcgttgagagtttacaaatataatcatgccaaatgtatttatatttactacataattacatttttaaatatctcaaataattcatatttagagaggatttcatttatgaaaaaattgattactcttattgtcatgatatcttttgttttagcgagctgtgggggcacatcaagtacagacaaagacaccctcaatgttgaaatacctttgaaaactaaatcaattgcaccttacgaaactgatatcccagttaaaacaggtgccttggaatcgctttttaaaatgtcgaagaatggtaaagtaaaacctttattagtcaaaaattatcatcaagtatctgacaatcaactagaactcactttaaaagataatattaaatttcaaaacggtcatcatttaacaggcgaagctgtaaaacgcagtctcgaagaaggaatgaaaaaaagtgatttgttaaaaggatcacttcctattaaatcaatcaatgctcatggacaaaaagtcacaatcactactaaagaaccttatccagaattaatgtctgaactcgcaagcccatttgctgctatttacgacacaaaagctaaaaacaaagtaactgatcaacctgttggtacgggtccttataaaattgatcagtataaacgttcgcaaaaaatcgtactaaaacaattcaaagactactggcaaggtacgccaaaattaaaaagaattaatgtcacttatcatgaagatggtaatactcgtgttgatcacttattatcaggcaaatcagatttgactactgatgttccaattgaacgcgttgatgatgtaaaaaaatctaacaaagcaaacattcaaagtacatcaggctttagaacgcatttaatgttatacaatcatgatagtaaaaaagttaataaaaaagtaagagaagcactagatatgattattaatcgaaaagacattgctaaaaatgtttctaaaaattatgctgagccagcatcaggtccttttaaccatcgattaaaatcattagaaaaagaggaaattcaatcacaagacatcaagcgtgcaaaagaacttttagctcaagaaggttattccaaatcgcatcctcttaaattaaacatggtcacatacgatggcagaccagaattgcctaaaattggacaggtgatacaatctgaagctaaaaaggcaaatgttgatatacaattacgcaatgtagatgatatcgaaggatatctcaaaaacaaacagagttgggatgtttcaatgtatagttatttaagtgtgccacgtggtgatacaggttatttctttaacactgcatacttacctgatggagcattaaataaaggtaattataggtaa

SEQ ID NO: 1170 - DNA, 1431 bp, S.epidermidis
gggcacatgaggtatcgtatgacattgcagaatcatttaaaacatcgcatattgttgatctatggagacaactcattgaagaggtgctatatgattaatttattcgaaaattataatcaagaaacacaggaattacatcaatctcttaagcgtgctggttacaatcactttacgattgtaattaatgatgatggatttttacctgatgatgtgacatcgccgtatcgttttttcacagcatatcaaatttatgaagatgatacccctgctttttttaatgatattgatacgccgcctttttgggaaattaaaggagatgcgacaatggctaccattacagatatgggtgagcttagaggtaaaatcttttataaggaacattataagacacgtgtagttagccatgtagagtggcttgattcaaaacagcgtttgcgttcggttgattattatacaaaagaaggatttaaatttgctgaaacagtttacgatttgttaggtaatgcaatattaaaaaagtatatgacacgtgaaggtaaagaagtgatttatgagaattatgtaactaacgatgtagttgtagaatatgaagggaaatcttatttttttgagtcatatacagagtggattaaattttacttgagtgaaatgggcattgagataaaagaagttatatttaatactttatcaacaccatttttagcaatttatcatttgccgacattgaaaaaaggtattttattttggcaagaacaatctcagggttatgtcccaggaaatatgaaagtcatgttatcaccaaaccttcaaagtcgctttgccgttattgtccctaatcagaatgaatacaaattgatcaaggaacaactatctagggaggaacaacaggcagtatatgcatctggttacttatatgacacgtataaacggaatcattattctaagaatgtattaacattaacaaattcagatcaaataccacatgttgaaacgttggtacgtttgcataaagattatcaatttcacataggcgctaaaactgagatgtcttcaaaattattaagtttatcgcaatatgaaaatgttaaattatatccaataattaaagaacaaacagttcaaaccttatatcaacaatgtgacatctatttagatattaatgaggggaacgaaatagggaatgctgtaagaagcgcatataatcatcaattgttaattatgggatataaagaggttgttcataatcaagatttcgttgcaatagaaaatcagtttcttgtaaatgatataagtcagttgagtaacgctttgaaagagataggaaatcatcgtggtcaatttgaaacacgtttagcactacaacaacgtcatgctaatgctgtgccggtatcaacatttaaatacgcattagtacaagcattaagtggttaa

SEQ ID NO: 1171 - DNA, 783 bp, S.epidermidis
atggtaatgagtaatacagcactttgtctgacagcacttttattactaatccctatctttatttcttataaagaaggattgcatattatcaaagatttagttattgctacaattagagcaaccatacaactattgattttaggctttttattacattatattttcgaaattaatgaaaaatggttattagtgctatgtgtgttagtcattattatcaatgcatcttggaatacaataagtcgtgcttcacctgtcatgcatcatgttttttggatatcatttgtggctatatttgtgggaacagcgctaccattggcagcaactgttgctacaggtgcaattaaatttacagcgaatgaagtgattccaattggaggtatgttagctaataatggtttaatcgcgattaatctcgcttatcagaatttagaaaaagcatttgttcaagatgtttctgatattgaatccaaacttacgttagcagcgacacctaagctcgcatcaaaatcatctattagagaaagtatacgcttagcgattgttcctacaattgattctgtaaaaacatatggtctagtttcaattccaggtatgatgacaggattgattatcggaggcgttgacccacttcaagcaattaaatttcaattgcttgtcgtgtttattcatacaacagcgacgattatgtctgcactcattgcaacgtatatgagttacggtcaattctttaatgctcgtcatcaactcattgctagaacgcaacgcacaagacaaagtagttaa

SEQ ID NO: 1172 - DNA, 831 bp, S.epidermidis
agagaaatgaggattgagaagatgaaaataggtactatttctgacctacacattgaccgtcatccacacttaaatcctgaaatatatttagaaaagctttgtcaggtgattaaacaaaggtctattgagttacttatcatagcaggggatatatctaatgactataggataagttacgattttattcaaagcattcaagaattaagcgggatacctacttattttgttccgggaaaccatgatttatggtctgaccaagcagataaaacttcaacagaaatactatcattctttcgctcaaaagaggaatgcttgatcggcaatccaatcattattaatgatcaatatgcaattgtaggccatgtcggttggtatgattatagctatgcagatcatcgtttttctcagcaaaaaatagcaagtggtaaacattatggtgcaacttggcaagataaagtgagaacagattggtcattatcagacccgaaactatcccttttagctgctcaagaggtggaaaaagacattaacaatgtaagcccacgtcaaattattttagttacgcacgttgtaacacatcctcaattcgtagtaccaacgcctcatcgtatttttgacttttttaatgcatttattggtactcatgattttgatactatttatagaaattatcctattcgatttagtataatggggcatgttcattttagaaaaaaacttgttgaaaataacatattatatatatgtccgtgcttaggatatcaaagacaatggatgacagatgatatagcatatgaaataaatcatgctttagtcgattttgatatttag

SEQ ID NO: 1173 - DNA, 375 bp, S.epidermidis
gtaggagtgagtatgttgaagaagttattagtcggggttagtgtactaactttattattagcaggttgcatgagtcacgagtacgcagacaaaatagataaagcggttaaactacaagagaaaaagcaacaaaaaattgctaaaaacgattcaggtgatgaagttaaacattttgataaaaaagatgccaatatttatgtgtttgacaaaggaaaatatgttgtattggagtataaaccacttagtgatgatgctgaagcgcgttactatacttatgaatttaaagataaaaaagcatattataataaagactttaatgcaaaagcatactaccaatctcatgagcctgactataaagaagagaatatgtattaa

SEQ ID NO: 1174 - DNA, 474 bp, S.epidermidis
agaaaacagaggggaatggttattttggaacaaacgcatctcgttaaaaacaaaacggttgataacaagaagtcaatgaaatacagtatttttcaacaagcattaacgattgcagtgattttacttatatcaaaaattattgaatcatttatgcctattccaatgccagcttcagtaattggacttgtactattatttatcgcattgtgtacaggcattgtgaaattaggtcaagttgagactgtgggaactgcattaaccaataatattggattcctattcgtaccagctggtatttcagtcattaactctttaccaatccttaagcaaagccctattttaattattttacttattattatttcaacacttttattattaatttgtactggctttgcgtcacaattattagtgacgaaatcacttttcccttctaaagagaaaaatgaagaaacaagtcacgtaggagggtaa

SEQ ID NO: 1175 - DNA, 1491 bp, S.epidermidis
agaacagagaggtcaacaatgaattacttaaaacaatatgaatcatttttttggttaataggaatttttatcttttatcttataatggcaattctaacaccattatcaactacggattggcatgcatataaagttaatctaagtcaatatttgactcaagaaaatggtcgttatttaggacatttatttgaatgggttgccgtacataatatcataataagagctttaatatatgcgataacttcgtttttagttatctatttagttgcttatatggttcaattacatacgaatcgtttttattttattttgagttttgtgttaatggttactgtacctaatacaatttatagcgaaacttacgggtggtttactggattttttagttatatacctgctacagtcctatcactttttattctttttactgtagttaaaatgattgagtcgcacgatacagtttctgaaatgcaattatgggtatttttattagtaagtttgtttggacaattcttcttggagaatctttccatcgctaatagcttaattattttaataggaatggtagtctatttctttgttaaaaaaagactcagttatttcttaattgtaggatttatgcttagttgtataggtaacattataatgtttttaaacttcaattattttttaattaaggatggattaaatacgcattattcaatttccgatagtcatggaatgatacataaagcaggtgtgacgttatttaagcttgtaccagaatatatgtttattaatcaaatgattattcttaccgtgatatcaatagtaagtatagttttacttaagcaaaataaaagcctgaagcatatgagagtttatattaaaataccactactcttaggtttaattactttacctatttataagatcttcgtttacaatcaatttcattttgaattatataaagcttcattttctatagccgttttgaatacaacgatttgcttcatttacatgataagtgtgatatacgttgtgtttaaaatgatacagcaaagatacataagaatgattgtgatggggagttttatagctatggcttcatctgttttgccacttttatttgtgacgcctataagttatagaaatttttattttatttatactttatggatcgtgatattactttgtttaattcagcaatgtgatgtgctatttaaacaacttgaacatataattaaaatatttgcgattatcatcagcatcattatgatgattggatttacttttatacatattagtagtgtgcacagaatagacttcattaaagaacaaataacacaacatcatcgctatcagaaaataacattggaaagattaccatttgagcgatatactcatatgactacaccaaagtcgaaggaacaacttcaagatttcaaacactattatgatttgcccaaagacatcacatttaaagtagtcccatatggtacaaaacaataa

SEQ ID NO: 1176 - DNA, 525 bp, S.epidermidis
aaaggatggaggatatacgctttgaaaaaattttcagctacaatagtagtaatcattcttatatgcgcattgggcttttcattatatgcagctattaaccaccatacgaattctaataagaatgataaaaaaatagaacacaatcgcaaaaataaacaaaatgatacttcaaatcagaatcgtgatactaatcaacaccaagaccaaactcaaccaacaaataatgactataacaacgataatcaatcagatactgaacaaccagcacaacaacctaactatcatcaatacccaaataataatcaacagtctggttcaaataaaaataactcttcagaaaataacaaacagaaaccgaatcagaacaaaactaatcaatcagattatcaaccatcacaatcaacaccacaacagtcgtcacaacctaataataatcaatctgattcacaacaaaatggcaactcaaataataattccaacaatcaaaatcatggaacaaatgataatcagaataaaaatcgttaa

SEQ ID NO: 1177 - DNA, 1356 bp, S.epidermidis
ttcataaggagaattgatatgaaagtcaaaagtatttcacggttcttttcaatgaagaaagtgacgctaagtttcgttactttatttattggagtagggacaataggttcatacaatcagtatgctgatgcaagtatgaaaacgcaacaaacacatgtaactaagtcatctccaactcaaaagacgacgtccaattttaaacgttcagttaaagatacgtctgttaaatctagagctacatcaataaaaagagctacatcaaccaaacaagctatatcacccaaaacgtcatcaactaaaaaaactacaatagcaaaaaaatctaccacagtaaataaaacgcgcacaacaaccaagactcagcctaccattcgtaagagttcaacaacttcaacacgttcaaaaacaatgcctacttctgtgaaacgcacaacttctcataaagcaactactgtgtcgccaacttctaaagctaaaatatcaacaaagacacaacaatcaactaaaagtcatacaacttcagttaagaaaaacactacacaactaagtaaaacaaaatctccgtcaacgtcaacaaaatctaaaacagttcaatcctctacgacaaaggcacaacctactttatcgactcaagttagtacaactactaaagcaaagcaattttcaacgccaactacttctaaaactgatagcagtaaatctttagtaagtttagcatctacagaacgtaaaatagataaataccaatcgatgactcagttagaaaaagaaacaactgaaggtgtacattggagaaaagatacgaaaaacacagggaatcaagtactcattgtggctccacatggcggaagtattgaacaaagtacaacagaattaactaaaacattagcagataaaggtaattatgattattatgcacttgaaagcattcgacctaaaaacaactctgaattacatgtgacgtctacacattatgatgatccgacattaaatcaaatgattaaaaaccgtactgcaactatttcgattcatggcgcatcaggtactgaggagattatctatcttggtgggccccgttcagatttaagaaatgctatagagaagcaacttgtaggatgtggatttacagttaaagttccaccagagtatctaggtggtcaaaataataaaaacttcattaataaagaagacaataacactggcgttcagttagaattaacgactgctttaagaaaagcattctttaaaaatggagatactagtacaaaaaatcgtaccaataaagaaaattggacaccaacaatggaagcatttattaatgcattatatgaaggtatcaatcaaacgtattcataa

SEQ ID NO: 1178 - DNA, 489 bp, S.epidermidis
ttgctaattgggaggaataaatgtatgaagggtagcaaaaaattaaatgagttactagaagataatcagaagaaactaaaaaaattatttaagtacgatcataaaaaggctttggcgtttacaccagaggatagagaaaaagttaaggataagtttggtgtctatgtgattttcgatgagaaaaaaccagtgtttgtaggtcaaactggaggatattcatccacacatcaacctataaatagtgatttgtatacaaaattaggacaatacaattcacgttcagaaacaggtacaactaaatttagaaaagcttatgctcaaaataaggacttaaatccaaatcatttaaaagacattactgcagataaatacggcttcacttttcaatatataaaagtaaaagacgaacctgcgtttattaatgttttagaaattctcgcattagaatatgcaaaaaataaagggtatgaactttataattttcaataa

SEQ ID NO: 1179 - DNA, 6414 bp, S.epidermidis
gaaaactatggggagtttattatgacaaagaaagaaaaggattataaaaaaagtcttgagcaacaaaaaacacgggtaaaaatatacaagtcaggaaaaagctgggtaaaagcaagtattaatgaaatagaattgttaaaaacaatggggctaccatttttaagtaaaaacgaaatacaagaaaatgtgactgaaaagacgaaaggtcataaattaaaaaaaagtgcagctaaaacaacagccctagttggtggagcatttacatttaatatgttgaataatcatcaagcatttgctgcctcagaaacaccaatcacctctgaaatttcatccaatagtgagacagtagccaatcaaaattcaactacgattaagaactcacaaaaagaaacagtcaattctacaagtttggaatctaaccattctaatagtacaaataagcaaatgtcttcagaagttacaaatacagatcaatccagtgaaaaagctggaattagtcaacaaagtagtgaaacatcaaatcaatcatctgagttaaatacatatgcctccacagaccatgtagagagtacaactactaacaatgataatactgcacaacaagatcaaaataagtcttcgaatgtaacctctaagtcaacacaatcaaacacgtcatcctcagaaaagaacattagctccaatttaacccagtcaatcgaaacaaaagcaaccgattcattagcgactagtgaagcacgtactagtacaaatcaaatatctaatctgacatcaacatctacttcgaatcaatcgagtcctacttcctttgcaaatttaagaacatttagtagatttactgttttgaatacgatggcagcaccgacaacaacgtccacgacaacaacttcaagtctgacatctaattctgttgtggtgaacaaagataactttaatgaacatatgaatctgtctggatctgcgacgtatgatcctaaaacaggtattgctaccttaacgccagacgcatatagtcaaaagggtgccatatctttaaacactcgattagattcaaaccgtagcttccgttttacaggtaaagttaaccttggtaatagatatgaaggttattctcctgatggtgtaacaggtggagatggcattggctttgcattttcaccaggccctttaggacagataggtaaagaaggggctgccgttggaataggtggtttgaataatgcctttggttttaaattggatacgtatcataacacatcaactcctaaatctgatgctaaagcaaaagcagacccacgtaatgttggtggtggtggcgcttttggtgccttcgtaagtacagatagaaatggtatggctaccactgaggcatcatctgcggctaaattaaatgtacaacctactgacaattcattccaagattttgtcattgactataatggtgatacaaaagtgatgacagtgacgtacgctggacaaacttttacgagaaatcttacagattggattaaaaacagtggtggtacgacgttttctctatctatgactgcctcaactggtggcgcaaaaaacttacaacaagttcaatttggaacattcgagtatacagaatcagctgttgctaaagtacgctatgtagatgcaaatactggtaaggatattattccacctaaaaccattgcaggtgaagttgatgcgactgtgaatatagataaacaattaaacaacttgaaaaattcaggttacagttatgttagtacagacgctttacaaaactccaattattcagaaacatcaggtacacctacacttaaattaactaactcaagccaaacggtgatttataaattcaaagatgttcaaggtcctcaaattagtgttgatagtcaaactagagaagttggaaagaccattaatccaattacaattactacaactgacaatagtaaagacgtattaactacaactgtgacaggtctaccttcagggttatcttttgatcaaacgacaaatacaattactggcacgccaagtgaagtaggaactacaactgtgacagttaatactactgatgctactgggaacgtaacatctaagcaatttacaataacgattcaagatacaatcagccctgttgtaaatgtgacgccaagtcaagcatcagaagttttcacgccgattaatccaattacgataactgctacagataatagtggcaaagtggtaacgcatacagtaactggattgccacaaggacttaaatttgatgcatctacgaattcaattgttggaactccaactcaaataggaacaaatacaatcacgattgagtcaacggatgcgagcggaaataaaactacgactaaaattaattatgaagtaacgagaaatagcgcaagtgactctacttccactagcatagtaaatagtgtttcaacaagtataagtaatagtacatcgctaagtgatagtgtaaaagcgagtcaatcattatcaacaagtaagagtctctcagagtcgttaagtgcgtcgacgtcgaatagtacgtcaatccaagcgagcgaatcagcaagcacaagtaaacaattatcagaatcagcgagtacgtcgacatctgatagtgcatcagagtcagcaagaaagagtgagtcaacgagtaaaagtacgtcattaagtgaatcgacaagcacaagcgtttcagattcagcaagcgtgtcaacgtcagaaagtgcgtcaacatcaacaagtgtgagtggctcaacaagtacaagcatttcagactcaacgagcacatcgacgtctgatagcgcatcaataaaagcgagcgaatcagcaagcacaagtaaactattatcagaatcagtgagtacgtcgacgtctgatagcgcatcaacgtcaacgagcgtaagtgactccaatagcgcaagtacgtcattaagtaaatcgacaagcacaagcgtttcagattcaacaagtacatcgacatccgacagtgcgtccacatcaacgagtgagagtgagtcagacagtgcaagtacgtcattaagtgaatcgacaagtacaagcgtttcagattcaacgagtacgtcgacatccgacagtgcatcaatgtcagcgagcgagagtgaatcaaacagtaaaagtacgtcattaagtgaatcgacaagtacgagtctttcaggctcaacgagtgcgtcgacatccgacagtgcatcaacgtcaacgagtgagagtgagtcagacagtacaagtacgtcattaagtgaatcgacaagtacgagtctttcaggctcaacgagtgcgtcgacatccgacagtgcatcaacgtcaacaagcgagagtgactcaacaagtgaaagtacatcgttgagtgaatcattaagcacaagcgtttcagattcaacaagcgcgtcaacgtcagaaagtgcatccacatcaacgagtgagagtgagtcaaacagtgccagcacatcgttaagtggatcattaagtacaagcatttcagattcaacgagtacgtcgacatccgacagtgcatcaacgtcaacgagtgagagtgagtcagacagtacaagtacgtcattaagtgaatcgacaagcacaagtctttcggactcaacaagtacgtcaacgtcagaaagtgcatcaacgtcaacgagtgagagtgactcaacaagtgaaagtacgtcattaagcgagtcgacaagcacaagcgtttcagattcaacaagcgcgtcgacatccgacagtgcatcaacatcaacgagtgtgagcgactcggaaagtgcaagtacatccataagtgaatcattaagtacgagcgtttcagattcaacgagtacgtcgacatccgacagtgcatcaacgtcaacgagtgagagtgactcaacaagtgaaagtacgtcattaagcgagtcgataagcacaagcgtttcagattcaacaagcgcgtcgacatccgacagtgcgtccacatcaacgagtgagagtgagtcagacagtgcaagtacatcgttaagtggctcgacaagtacgagtctttcagattcaacgagtacatcgacatcagacagtgcatcaacgtcaacaagtgagagcgactcggaaagagcaagtacatccttaagtggctcgacaagtacgagtctttcagattcaacgagtacatcgacatcagacagtgcatcaacatcaacgagtgtgagtgactcaaacagtgccagcacatcgttaagtggctcattaagtacaagcgtttcagactcaacaagtacatcaacatccgatagtgcatctgcatcaacaagtgagagcgactcggaaagagcaagtacatcgttgagtggctcaacaagtacaagcatttcagactcaacaagtacatcaacatcagacagtgcatcaacatcaacgagtgtgagtgagtcaaacagtacaagcacatccataagtgaatcattaagtacgagcgtttcagattcaacgagtacatcgacatcagacagtgcatcaacatcaacgagtgtgagtgactcggacagtgcaagtacgtcatcaagtgaatcagtaagcacaagtgattcagaatcaacaagcacatccacatcagatagtgcatccacatcaacgagtgtgagtgagtcaaacagtacaagcacatcattgagtggctcaacaagtacaagcgtttcagactcaacaagtacatcgacatcagacagtgcatctgcatcaacaagtgagagcgactcggacagtgcaagtacgtcatcaagtgaatcagtaagcacaagcgtttcagattcaacaagcgcgtcaacgtcagaaagtgcgtcaacatcaacgagtgtgagtgactcgaatagtgcaagtacgtcattaagtgaatcgacaagtacgagtctttcagattcaacgagtatgtcgacatcagacagtgcgtcaacatcaacaagtgagagcgactcggacagtgcaagtacatcgttaagtgactcgacaagtacgagcgtttcagaatcgacaagtacatcaacatcaacgagtgtgagtgcctcaaacagtacaagtacgtcattaagtgactcgagaagtacgagtctttcagactcaacgagcacatcgacatcagaaagtggatcaacgtcaacaagtgagagcgactcggacagtgcaagtacatccttaagtgagtcaacaagtacaagcatttcagactcaacgagtacatcaacatcagatagtgcatctacatctatgagtgtaagcgactcaaacagagcaagtacgtccttaagtgactcgacaagcacaagcgtttcagattcaacaagcgcgtcaacatcagaaagcgcatcaacgtcaacaagagagagtgaatcaacaagtgcaagtacgtcattgagtgaatcgacaagcacaagcgtttcagattcaacaagtacatcgacatccgacagtgcgtcaacgtcaacaagtgagagtgactcaaacagtgaaagtacatcgttaagtgagtcgacaagcacaagcgtttcagattcaacaagcgcgtcaacgtcagcaagtgcatcaacatcaacgagcgtgagtgactccaatagcgcaagtacgtcattaagtggctcaacaagtacaagcgtttcagactcaacgagtacgtcgacatcagcaagtgcatcaacatcaacgagcgagagcgactccgatagcgcaagtacgtcgttaagtggctcaacaagtacaagcatttcagactcaacgagtacgtcgacatcagacagtgcgtccacatccacatcagaaagtgcatccacatcaacgagtgtgagtgagtcagacagtgaaagtacatcggtaagtgaatcatcaagtacaagcgtttcagattcaacaagtacatcgacatcagaaagtgcatcaacgtcaacaagcgagagtgaatcaacaagtgaaagtacatcggtaagtgaatcatcaagtacaagcatttcagattcatcaagcacgtccacatcaatgagtacatctgaaactttcacttctcaatctcctataaatagtgaaagtcaatttattggtgatagcttgtctgaagatacaatcgtgactcaatcaaaaaatacgaatatgcttaataaaactggaaaagattatgatttacaagaacaaagaggttatactgattcagaacaacacaatgaaacacaaagtaatcaagctgataatcactcaaacaacctcgatttacttcatcaaaatcgtttacaagataaagtcgttaaacaaccgactaaaggagaagatggagttgtaagcaacggttttatagtagcagtagcaatagtattggctatcttcggtttggcaaaaaaatctagaaaagacgatgatgatcaagatggtagtaaataa

SEQ ID NO: 1180 - DNA, 1137 bp, S.epidermidis
gaaaggagtggtctactcatgcatgatgtactaatcattggttcaggagttattggtatgtcaattgctagacacctcagtgcaacacacttagatgttgcagtcatagatagagatgtacctggaaagcatgcgtcatataaagctggaggtatgcttggcgcacaaaatgaatttacagaggatagtgacttgtttcaattagccatcgaatctcgtgctatgtttccacaattaagtaaatcattattagatgaaacaggcatagacattcaatttaaaaattcaggacttatcaaaattgctaatgaacacgatgatatctcatctataaaacgacaatatcaatttctgaatagtcaagaccgtagtgtcaaacaattatcagatgatgatttgctacaacttacacatggtgaagttaaaccttcatacgcggccattcacataccacacgatggtcaaattaatgcacatcattacacactggcattattagaatcaatgaagttaagagatattaagcgttatgagtctacagaggtcacttcaatagaacggcataatggctattattcagtgaaaaccgatcaatcttcaacaattgaagcgcacaaaattatcgttgcaggtggcgcatggtcttcgcaattattaacacaatatcatctacaacgacaagtgattggcgttaaaggtgaagttatcttattagaaaataacgatctttcacttactgagacattatttatgactaatggttgttacatcgttccaaaacaacccaatcgttttttaattggtgcgacgagtgaatttaataattattctgtcggtactacagatgaaggtatggattggcttcttcgccatgcatatcatcgtgtacctcaactaaaagacagtcatatactgaagaaatggtcaggagtaagaccatacacagaaaaagaaatgccagtcatggatcaaattgatgatggcttatacgtgataagtggtcattatcgaaacggaatattattgtcacctattatcggtcgtgacattgccaattggctactttctggtattaaaccatcacgttattcaagttttacagttacaaggaggaataatcatgaagtgtatcattaa

SEQ ID NO: 1181 - DNA, 831 bp, S.epidermidis
gggaggggtggcttaagtatgaacaataccatcatttcaatgaaagaaaaggaattacgttttttaaagttttttcatcaacaaaaatataatgttgtagattttaacttaattgaagaattggattggcaacgattgactcatgaagatttgcaacaaatggatgaaagaagcttttggcaacaaaataaatctatctatgcattaagaaatgattttaccgatcaattattcagatattattcgaactatccaacacattttaaaaaagtagcttatgcaggggatattatcagagataacagagttataaagcaagtcggcattgagaattacgagccacaatttgataatatcactcaaaatttcttagatttccaatattttattcaaaacgtacttcatgatgacattcaatttatcattttaggtcactatcaattgattgatgcacttttagagaaaaatcatcaaactagagaagttatggagatgatagaagaacgtaatttatcagggcttattcaaacactaactttcaatcatcccatcattcaaattcttaaagagaacacattaaatcaacttaaaatactctctcattatttaccagagcgacaccctgcaatggtggcaattcaatcttggtcacaatggtttactgatcatgggattactgaaatccaccttgatgtaactgcacaagcgcctagatcttattacaaaggtatttttataaaatgtcatcttaaaaatactgctcatagcgttttgacaggtggatattatcacggttcactagaaggttttggtttaggattaacactttaa

SEQ ID NO: 1182 - DNA, 162 bp, S.epidermidis
aaatacattttggactatgtttatatagattattattgttgttcaactgctcaaatgacaaatttgcctaaagtcaaaattattttacttcttttttatgtgagccaacacaatatttaccgtatgactcagaacatttgtgaagcactgctatttgaataa

SEQ ID NO: 1183 - DNA, 156 bp, S.epidermidis
aataacagcggtaattcccttattaatcttatcaaggaattaccgcttcttttatgttatctatcaatgaagaacaaaggcattcaattcatcagtctagatgaatacgacaatgattatttcttgtatttattaagcaatgctggaggaacatga

SEQ ID NO: 1184 - DNA, 1584 bp, S.epidermidis
atattggtagggaggaggttttggaatatgaaacgatttataccagcttggtatagccgtaacagatggtgggaaagtacctcaagaccattctatctaaaaaaacagtatacagattttgacgatatgattagtttaatgacaatgcatagttcgaataatgtggattatcaattgatagttttaaattttagtccatatcttagaacattcctccatcgatatgatttgtatgaaagtcattattggtctgtatttgatgagatacagggcgttggacatcaaacgcctcaagctattgattatcgcgatctttcatggccagaaggcactgaatttatttttactccctttcaaattcaagcgattacaggtgataacacgttttctaaaattcacttcagccaagaggggtacctgatgtgggtagaggattacaagtatagtacaattcaaagacgatttgtattcgatgacagaggatttatatcggcagtgcgtacttatacacctgatggtgataacaataaaaaacactatttttcaaaagatggggaagaaatatttgttgaagacttaaatgttaatacagtaacgattaataaaaatttccaatcaaaatttaaaagggttacgtattcatctatggctgagttgatagaagagaaattccaatcatatgtagaaagagaattgaatgaagatgattctgttatagtggcatctgatgaacgtcataattcaatgatggcacgcactattgatgcatcgtctttatgtttttctatttttactgagcgaaataaagtggtgacacaagatttatatgactctatttctagagcatattattgtctcgttgatacacaagctaatcaaaatatgattgaacactacgcaggattgaacatgaatgatattaatcttttaagggtaacgccttttgatgcgaagtcattacctaaccaaagtagtcaattgtatgacacttatattggattatggatagatggtttggacgagattgaaatacgagagattgtaaacagcttatttcaatatattcaacataaagatggctataagttgaaaattttaactaagagtagagataatcttacggaaaatcttatagatgaagttgctcatctcaatgatttatatcaccaagagaaaaaggaaataagtgatgtaattgaagacgtgatacagaataaaaaagaaacaatcattgatattgaaacagtaccgtttgaagaagatcttgtaagcgttatttcaaaattaagagttgtagtagatttatctttagagccgaaactttttttacaaatctgttgtattggcgcgggtataccacaaattaataaaaagagaacagattatgttaaacatatgcataatggatatattattgatgacatatcgcaaactgtagaatctttagattattttttggcacatttaaaaaattggaattattcttatgcatattccatgagattaacggatgattttagttcaattaatattattcatcaaattaatcagttatttaaaggtgatgtttcaagtggcacgtaa

SEQ ID NO: 1185 - DNA, 1257 bp, S.epidermidis
cgaaaggtaggtgaaaaaatgcatgtatttaactttttacttttctatccaatttttatgtcaatttactggatagtaggatcgatttactatttttttattaaagaaaaaccctttaatcgatcattgttagtaaaatctgaacatcaacaagttgaaggcatctcctttttattagcttgctacaatgaaagtgaaacagttcaagacacgctttctagtgttttatctctagaatatcctgaaaaagaaattatcattatcaatgatggaagttctgataatactgctgaaatcatctatgacttcaagaaaaatcatgattttaaatttgttgacctcgaagtcaatagaggtaaagctaatgcactcaatgagggaatcaaacaagcatcttacgaatatgttatgtgtttagatgctgacactgtcattgatgacgatgcgcctttttatatgattgaagactttaaaaagaatccaaaattaggcgcagttacaggtaatccacgtattcgtaataaaagttctattttaggaaaaatacagaccattgaatatgcaagtattattggttgtatcaagcgaagtcaatctcttgcaggagcaatcaatactatttcaggtgttttcacactatttaaaaaaagtgcactcaaagatgtaggttattgggatactgacatgattactgaggatattgctgtttcatggaaactccatctttttgattacgaaattaagtacgaaccacgtgctctatgctggatgttagtgcctgaaactataggtggtttatggaaacaaagggttcgatgggctcaaggcgggcatgaagtacttttaagagacttttggccaacaattaaaactaagaaattatcactatatattttaatgtttgaacaaatcgcatcgattacatgggtctacatcgtactatgttatttatcttttttagtaatcacagccaacatcttagattacacatatttaaaatatagtttttcaatctttttcttttcatcctttacgatgacctttatcaatatcatccaatttacagttgccttatttattgacagtcgctacgaaaagaaaaatatagttggcctgatatttttaagttggtatccaacgttatactgggttatcaatgccgcagttgtcattatggcatttcctaaagcattaaaaagaaagaaaggtggctatgctacatggtcaagcccagacagaggcaatatccaacggtaa

SEQ ID NO: 1186 - DNA, 888 bp, S.epidermidis
ataggtaaaggagtttatagattgaaaaagataaaaaaagcaataattcctgccgctggtttaggtactcgttttttaccagcaactaaggcgatgccaaaagaaatgttaccaatattagataaaccaacaatccaatatattgtagaagaagcttctaaagcagggattgaagatattattatagtgactggcaagcataaacgtgcaattgaagatcactttgataatcaaaaagaattagaaatggttcttgaaaataaaggaaaagcagacctgcttgaaaaagtacaatattcaacagatttagctaatattttttacgtacgacaaaaagaacaaaaagggctaggacatgcaattcatactgcaaaacagtttatcggtaacgaaccatttgcagtgttattaggagatgacattgtagagtctgatacaccagctattaaacaattaatggatgtttatgaagaaacaggccattcagtaataggtgttcaagaagtaccagaatctgatacacatcgttatggtgtgattgatccttctgctaaagggggaagtcgatatgaagtacgtcaatttgtagaaaagccgaaacaaggtactgccccgtctaatttagcaatcatgggtcgttatgtattaacaccagaaatttttgattatcttgaaacacaacaagagggtgctggaaatgaaattcaattaactgatgcgattgaacgaatgaatagcaaacaaaaagtgtatgcatatgattttgagggtaatcgttatgatgttggagaaaaattaggatttgttaaaacaacgattgaatatgctttaaaagatccagaaatgagtcatgacttaaaagcattcattaaacaactagatatttaa

SEQ ID NO: 1187 - DNA, 699 bp, S.epidermidis
gtaatgaaaggtaatttgttacattcaatcatcgaatattactcactgaactgggcctttcttctagaactgttcttcaaacatctattaatgtcggtatatggtgtgttgtttgcatgtataattggaattcctattggtattttcatagccaagtataaacgtttatcgtggccggtaattacaattgcaaatattatacaaactgttccagcaatcgctatgttagccatacttatgttggctatgggattaggaccaacaactgttgttgtaactgtattcctatattcgttattacctattattaaaaatacttatactggtattgtagaagttgatgaaaatattaaagacgctggtaaaggtatgggaatgacggggaatcaaatattaagaatgatagagttaccattatctttatctgttattattggtggtgttagaattgcacttgttgttgctatcggaatagtagcgattgggtcatttatcggtgctccaacactaggtgatattattattcgtggtacaaattcaacagatggaacaacattcatcttagcaggtgccataccaattgctttaatagcaattatcatagatataggattacgttatctagaaaaacgtttagatcctactcgtaaaaacaaaaaagattcaatgcaaaaacatcaagtacaaaaattacattaa

SEQ ID NO: 1188 - DNA, 132 bp, S.epidermidis
tattgtgaagggtatcaaattattgatgatatagtaagacagaatgaacagagtaatcaagttgataatatggaacctgatacatcaatcataggtacaggttcttttcttattttgattgtaattgaatga

SEQ ID NO: 1189 - DNA, 681 bp, S.epidermidis
agagaggaaggtatgattatgaatcagatgaatcaaacgattattgatgcattccattttagacatgcgacaaaagaatttgaccctacgaaaaaaattagtgatgaagattttaatacgattttagaaacaggtagattatctccaagttcactaggtttagaaccttggcactttgtagtggttcaaaataaagaattgagagaaaaattgaaagcctatagttggggagcacaaaagcaacttgatacagcaagtcactttgtattaatttttgctcgtaagaatgtgacggctcatacagattacgtgcaacatttacttcgtggcgtcaaaaaatatgaagaaagtacaattccagcagttgaaaataaatttgatgatttccaagaaagtttccatattgccgataatgaacgaacattatatgactgggcgagtaaacaaacatatattgcattagcaaacatgatgacaagtgctgcattactaggtatcgactcatgtccaattgaaggatttgatttagataaagtgactgaaattctttcagatgagggtgttttagatacggaacaatttggtatttcagttatggtaggctttggttacagagcacaagaacctaaacatggcaaagttagacaaaacgaagacgacatcattagttggattgaataa

SEQ ID NO: 1190 - DNA, 780 bp, S.epidermidis
tacagtagaggagtgacatatatggctttaataacaatgaattacaattcaccaacgataggaatgcatcaaaatttaacgattattttaccggaggatgtaacattctttggtagttcaacaacagcgaaacatttgaaatcaatgttgttattacatggattgtctagcgatgaaacaacttacataagatatacaagtatcgagcgttatgcaaatgaacatcaacttgcgattataatgcctaacgtcgatcatagtggctatgcaaatatggtatatggacatagttactatgattacatattagaaatttacgaatatgtacatcaaattttaccactatctagaaaaagagaagataattttattgcaggacattcaatgggcggttatggaacgattaaatttgcgctaactcaaagtgataaatttgctaaagctgcaccactttcagcagttttcgaagcacaacgtttcattgacttggattggactgatttttcccctcaatctatcacaggcaacaatactcaaattaaaggtacagaactcgatacgtactacttacttgatcaagccatcgatgctaatgtagatattcctgaattgtttatcatgtgtggtaaagaagactttttatatcatgataaccttcaatttattgagacattaaataaaaaaggggtttcttataagtttgaagatggtccaggagatcatgattatgcttattgggatagagctattaaacgtgcgattaagtggtttgtccagtaa

SEQ ID NO: 1191 - DNA, 999 bp, S.epidermidis
ataaagagagggattcaatcgatggcaaatcaaaaattaccaacattaaaatatactggtaaatcagaaagtgcagtgccaattgtgtcagaaagtgaattgcaaacggtaacagcagagccgtgggtgaaaatttcagataaagggttacaactagaaggacttaattttaatcgcgaaggtcagttattcttattagacgtgtttgaagggaatatttttaaagttaatcccgcaacaaaagaggttacaacaaaatttcagtctgttaaagataatccggcagcgattaaagtacataaagatggtcgtttatttatctgttatctaggtgattttaagacaactggaggcatatttgcgacaacagaaaaaggtgaacaaatagaagaaattatttctgatttaaatacagaatattgtattgatgacatggtttttgacagtaaaggcggattttatttcactgattttagagggtattctacacaacctttgggcggtgtttactatgtagatccagactttaagacggttacgccaattattcaaaatatttctgtggcgaatggtattgctttaagtacggatgaaaaagtgctatgggtaactgaaactacaactaatcgacttcaccgaatcgcattagaggatgatggcgtgactattgcaccatttggagcgacaataccatattattttacaggtcatgaaggaccggattcttgttgtattgatagtaatgataatttatatgtggctatgtatggccaaggacgtgtattagttttcaataagagaggttatcctataggtcaaattttaatgccaggacgtgatgatggaaagatgttacgtacaacacatccacaatttatacctggtacaaatcaacttataatttgtactaatgatattgaaaaccattctgaaggtggatctatgctttatacagttaatggttttgctaaaggatatgagagttatcaatttcaataa

SEQ ID NO: 1192 - DNA, 1542 bp, S.epidermidis
tttataggaggtaataaaatgaagaatttttctaaattcgcacttacaagtattgctgcattaactgtggcaagtcctttagtcaatacggaggttgacgctaaggataaagtatcagcaactcaaaacatcgatgcgaaagtaacccaagaatctcaagcaactgacgcattgaaagagttaccaaaatctgaaaatataaaaaagcattacaaagattataaggtcactgatactgaaaaagataacaaaggatttacgcattacacattgcaaccgaaagtgggcaacacgtatgcaccagacaaagaagtaaaagttcatacgaataaagagggtaaggtagttcttgtcaatggtgatactgatgctaagaaagttcaacctacgaataaggtatcgataagtaaagaaagtgccacagataaagctttcgaagcaataaaaattgaccgtcaaaaagctaaaaacttaaaaagtgatgtcatcaaaaccaataaagttgagattgatggagaaaaaaataaatatgtatataacatagaaattattacaacttcaccaaaaatctctcattggaatgtgaaaattgacgctgaaactggtcaagtggttgataaattaaatatgatcaaagaagcagctactacaggtacaggtaaaggtgtactaggtgacacgaaacaaattaatattaatagtgtcagtggtggctatgcactacaagatttaactcaacaaggtacactttcagcttacaattacgatgcgaatactggtcaagcttacttaatgcaagataaagatagaaattttgatgatgatgaacaacgtgcaggtgtagatgcaaattattacgctaaagaaacgtatgactattataaaaatactttcggccgagaatcatatgataatcaaggcagcccaatcatttcactcgcacatgtaaataatttccaaggtcaagataacagaaacaatgcggcttggattggtgataaaatgatttacggtgacggagatggacgtacatttacagcgctgtctggtgcaaatgatgttgttgcacatgaaattacacatggtgtaacacagcaaactgctaatcttgtttaccgttctcaatcaggtgcattaaatgaaagtttttcagatgtatttggttacttcgttgatgatgaagatttcttaatgggtgaagatgtatacacacctggtgtaggcggagatgccttaagaagtatgtctaatccagagcgttttggacaaccatctcatatgaatgattttgtttatacaaattctgacaacggaggcgtacatacgaattcaggtattccgaacaaagcagcttacaacacaattcgtagtattggtaaacaacgttctgaacaaatttattatagagcattaactgtttatttaacttcaaattctgatttccaagatgctaaagcatcattacaacaagcagcacttgatttatatggcgacggtattgctcaacaagtaggtcaagcatgggacagtgttggtgtgtaa

SEQ ID NO: 1193 - DNA, 777 bp, S.epidermidis
attctgggagggattatcttgattaaaaaaagagtgattccatgtttagatgttaaagatggacgcgtcgtaaagggtatccagttccagtcattaagagatatcggtaatccagttgatttggctctttattataatgaagccggtgcagatgaactagtctttcttgatatttcgaagacggaagcaggacatgatcttatgatagaagtgatagaagcaacggcaaaacaattatttatccctttgacagtaggaggagggattcaaaatttagatgatattacacaactattaaatcacggagcagataaaatatcactcaattcaagcgctttaaaacatccagaattaattcgacaagcaagcgagaaatttggtcgtcaatgtatttgtattgctattgatagcttttatgataaagacagagaggattatttctgtactacgcacggtggtaaaaaactaactgatgtcagtgtatatgattgggtacaagaagtagagcatttaggtgctggggaattgcttataactagcatgcatcatgatggaatgaaacaaggttttgatattgaacatttagcaaaaattaaacaattagttaatattccgattatcgcctctgggggtggaggaaatgcacaacattttgttgaattatttcaacaaacagatgtttcggcaggtttagcagcaagtattttacatgatcaagaaactacagtggcagaaattaaagataaaatgcgtgaaggaggtatcctcgtgagatga

SEQ ID NO: 1194 - DNA, 771 bp, S.epidermidis
ctgtcaatgggttggaatgagtctcattttttaatcatttatattgagggagggttaatggtgtcttcggagtataaaaaaggaatatttttagctttaggtgcttatattttatgggggattttacccatatattggcgtttaattgatgaaataggcgcttttgaaattttggcattccgtattattttttcagtgatatttatgatttttgtgctcattataggaaaaaatcaacggaacgcttttttaagagatgttaatcagttggtatcgcatcccgtgcaacttattgccatcatagttgcagggtatgttattacagtgaattgggggacatttatttgggcagtatctaatggtcacgtgctacaatctagcctaggttactacattaacccactagtgagtatcgtcttggcgcttatatttttaaaagagagatttaataaattcgaatggttagccatcatttttgcattaataggcgtactttatatgacaataaaaatcggtgaatttccatttatttcacttctgttagcattttcttttggtatttatggtttattaaaaaagattgtgcatatcgatgcgataagtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaa

SEQ ID NO: 1195 - DNA, 801 bp, S.epidermidis
acgagagggggagtggttcatatggggaaagtatatttagttggagctggacctggtgatccagaattaataacgttaaaaggtttaaaagccattaaagaagccgatgtcatcctttatgaccgacttgtaaataaagaaatacttaattatgcttctccttctactaagttcttctattgcggtaaggatcctcacaggcactccttaccgcaggaagaaacaaataaaatgatggtaaccttagccaaaaaagggcacatagttacacgtttaaagggtggcgatccatttgtttttggacgtggcggagaagaagcagaggaattagcatgtcataatatccactttgaaattatacctggaattacatcgggaattgcagcaccagcatatgctggaattccagtaacacatcgtgattatagttcttctgtagcatttgtaactgcagtgaataaacctggtatggataaaggcaaatactggcaacatttggccaatggtcctgaaactttatgtatttatatgggggttaagagactcagtgaaatttgtgagttgttaatacaatatggtcgttcgtcagaaacaccagtagctctcgtgcatatgggaacgtcaaaacagcaaatgacagtgactgggacactcgatacaattcaagaacgagcacatcatattcagaatccagcaatgattattgtaggcgaagtggttaagatgagagaaaaaattaattggtttgtagaacaggcaactgttcaaaatgaaacgttaacggaaatgtcatcaacttag

SEQ ID NO: 1196 - DNA, 147 bp, S.epidermidis
cttcaaattttcattttgagtcaccttcacttaccacctttattttttgctaatattagtatgaattatcagttccacaatgacaacgtttttttatttctacattttttatattcctcatctaattatttcattagatatgcctaa

SEQ ID NO: 1197 - DNA, 1065 bp, S.epidermidis
ggggtttttattatgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcgtagaaaatgttggtaaaaacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacatactgacaacggtgtagatgtgtcatttgaagttgctggtgtaggtattactttacaacaatctattgaagtaacacgtccacgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagataatattgttgaaagtggcttcaatcaacttgtaaacgataaatctcaagctaaaattttagtccgtttaaatggtgaccaaaaataa

SEQ ID NO: 1198 - DNA, 396 bp, S.epidermidis
cttttctttataaaagaagggtgtttgttgatgagtcaaatcgaatttaaggatgttagtaaagtgtatccaaatggccatgtgggattaaaagatattaacttaaatatagaaaaaggtgattttgcagttattgttggactgtctggagcaggtaaatcaacattactacgatcggttaatcggctacatgatatttccaaaggtgatattactatcgaaggtcagtcaataactaaagcacgtggtaaaaaattattagaaatgcgtcgaagtataggtatgatttttcaacattttaacttagttaagcgttcaacagtgcttagaaatgttttgagtggccagggtaggataccatcttacttggaaaatgatactgggtctttttcctaa

SEQ ID NO: 1199 - DNA, 234 bp, S.epidermidis
ttatactttatcattttattgttgaaaattataagaatttttatgtcgtttgtgacaaagtacgtaaacatacattcaaatttaaaattaatctatttatttaattatcattttatctatatttcctttttattgttagtaggttttatatcattattactatgcggtcacacttacgctagacaaaccgtagccttacctcaaggtgcaataaggagctttgtatttttttga

SEQ ID NO: 1200 - DNA, 891 bp, S.epidermidis
aggtgtcttatggactttatagctattttaatcggattagggccactattaggttggggattatttccaactatcgcttctaagtttggtggacgtccagtcaatcaaatctttggtgctactgttggtactttgatcttcgcaattgttctagcactatttaaaggtataggtttaccaggaggtatggcattagtattttcgctcatatcaggtgcaggatgggcatttggtcaaattattacttttaaagcgttcgaattagtaggttcatcaagagcgatgccaattactactgcatttcaattacttggtgcatctttatggggcgtttttgcgcttggcaactggcccggtataacaaacaaaatcattggatttctagctttactcgtaatccttataggtgcacgtatgactgtatggactgaaacaaagcaacaagaatatagtaaaaatctacgaagtgcagtgatcttattacttgtaggtgaaattggctattggatatattctgctgcacctcaagcaacggatattggtggatttaaagcttttttacctcaagctataggaatggtcattgtggctgtcatctatgcgttgatgaatatgtctaaaggtaatgcttttaaagagaaagtaagttggcaacaaataatatccggatttttctttgcgtttgctgctttaacttatttaatttcagcacaacctaatatgaatggtttagcaacaggatttgttctatctcaaacatctgtagtattagcaacgctaacaggcatttttttcttaaatcagaaaaaaacatcaaaagaattaatgattacaattgtgggattagttcttattttagttgcagcatcaatcacagtgtttattaaataa

SEQ ID NO: 1201 - DNA, 141 bp, S.epidermidis
aacttacttatatacaaggagtcaattttagtcctcgttgctgagagaacaacgaatgctgtctcactctttctaattatattattagatttggattacataccccaagcagataaaccttgtgctttatatgctttataa

SEQ ID NO: 1202 - DNA, 123 bp, S.epidermidis
cgcatacttatatacatggagttaatcatctcgtacctgagtgagattacattttatttgaatgtagtctcactcttttttactcaaacgattattacgataaaaatatgtatatttcattaa

SEQ ID NO: 1203 - DNA, 126 bp, S.epidermidis
atatggcttatacatttttatacgcttatcaccttgaatacacacaaccagattgatatcttaggtaaattagtcattataaaatatgaccttttctcaaaaaaaatatatttattctacaaataa

SEQ ID NO: 1204 - DNA, 324 bp, S.epidermidis
gtggtcattatcgaaacggaatattattgtcacctattatcggtcgtgacattgccaattggctactttctggtattaaaccatcacgttattcaagttttacagttacaaggaggaataatcatgaagtgtatcattaatggcgacctcttcactttcgatcagaatcaatcgatacaagaggttttacattcacttgaattagacccaaaacgagtgattgttgaactaaacaaagaacttatcaagcaagacaaatatgaagaatatactgtaagagaagacgacagattagaattactagaaattgttggaggcggttaa

SEQ ID NO: 1205 - DNA, 150 bp, S.epidermidis
caacccattattaaaataatcaacaaaacgatattcacaaatatatctgaaaatgaacttaatcgtctaacgtttttgatggatagtcgtcttaaagttagcaacaacattcctattaatgttattataccaaaaacactacctatataa

SEQ ID NO: 1206 - DNA, 195 bp, S.epidermidis
ttcattgttattaaagccatatatgtcactcctctactgtattatctattattttacttattcttttcattaatttatagaaaaaacgcaactttgactatagattatataaatttctatactttccaatgcggaactaaaattttattctctatattaaacaagttgattcagtatcgattgtctaacctttaa

SEQ ID NO: 1207 - DNA, 201 bp, S.epidermidis
ggtaaccctattgataataatatagatccaatgattgcaccaagaaaattagcaacattgaaaatagaagctgctaacgtacttgcaagaagtggtgcttcttttgcacttaagataattttgctattaagtaacggtgttgtaccaaatgtaccaaaaccgaataagaagcaaatgattaatgctaatattgaattttga

SEQ ID NO: 1208 - DNA, 480 bp, S.epidermidis
ggtacatatatgacgatagaaaaaaagaaaaataagattatttttactagaacttttagtgcaccaattaataaggtatttgatgcttatacaaagcgggaactatttgaacaatggtttcatcctcaagacgcatctgtcacagtttatgattttaatgctacgaaaggaggaaacgctttttatgctattcaagctcctcagatgacaagttatactattgctgaatatctgcaagtggatgcaccatattatatagagtatttagactattttgctacgtcaaaaggggaaaaagacacaagtatgcctggtatgcatatcactttgaattttgaagaagtaaaaggaaagactactgtaacatcgacatcgacttttccaactgaaagtgccgctcagcaagcgatagacatgggtgtagaaacaggtatgaattcaacacttaatcagttagagaaattactaaatcaaaagtga

SEQ ID NO: 1209 - DNA, 630 bp, S.epidermidis
atacatcatatatcatcaattcgaaatggggttatcaatgtgaaaaagatttctctaattgcaacgactgtattaacaggattattattatttccaagtgtcaatgacacaacgacacatgcagccgaagtaacatctcatgatgcacaagctgtagcaattcaagctatgaaaaatagtggtggcaatccggacttacaaaatttcaaaaaagttaaggataaaggggattatttcacaattgatataaataataaatctggtgcaggtgtcggtacttataaagtatacaaaaatggagtggtgctatataaaagtggaaattatggagaatatagtcaactcaatacacgacaatgttatgttgcacaagatattgctacaacatcttcacaagtaaaacgacactctactcaacagacacaagcagtggatagtacacgtgagctcaattcatactacgtaggtcaagttcaatcttctgacttaccacaacaaagttcatctgatatgctaccgaatactggtatgaaagataaaaatttcaatacaaatggtataataagtctatttttactcactgctggtttcattacactttaccatcaacctttacgtaaaatgtcatag

SEQ ID NO: 1210 - DNA, 192 bp, S.epidermidis
cttaatcatatatttttctttcatataagagaagcatcgataattacaacagtgcctgtttctatagcaataaaatctgtcactgttaaatttaggataaacaaaaacggttatccaccttttgttaaggtgaataaccgttttttaatttatctttctaagataagaacaatacaacatgttttcctgtaa

SEQ ID NO: 1211 - DNA, 141 bp, S.epidermidis
tatatacatattgctcatcgtcaattttatattcttattattatacaattcacgtatgatttccattttaattatcaagatttctttagtttaatttcatttttggatagaataaatataaaccaattgtttaggaagtga

SEQ ID NO: 1212 - DNA, 621 bp, S.epidermidis
  unsure (509): Identity of nucleotide sequences at the above locations are unknown.
aggatacatattatgaagataattttaccagtaaagcctataagtcagctattccctatcccttttgtaatggggtgtgagggagtatccgcagcgatgctattacaatttaataattacgatattaaagcaacacaaattatgagtcattggcctaaacatccaaccaatccctacaaaggctatgttggtcatcctttgttagttaaatttggccatcatcaaacaatatttcctgatgcttttgcgccatttcttaaacaatatgattctcgaattgtagatggtacaggtacatcattaaatcaacttgaaaaatttatcgacaaaggtcagccagtgatcatttatcatactagtttgggttctaaaccgcttcgacgtgtatttcatttcgacaatcaaccaacaaaactagtctcaaatattcacgttactttattaatagggtatgatgatgactattattattatattgatccgttatggagtcgtttatcaaaatttgntattttcccatctattattcctaactctaaacaattcattaaaattaaaaagcacactttggaaaatagttataatgccccaggaaaaaaatgcatatatatcgataattaa

SEQ ID NO: 1213 - DNA, 135 bp, S.epidermidis
acacttaatatcatttttatttcgtttgtaaaatttaattttttaacacattgttcaagtcaatcatcaacaattcttttcactttgttacttgctcacatttcatctaaatataatttttcatgttatagttaa

SEQ ID NO: 1214 - DNA, 2022 bp, S.epidermidis
gtgactaatatgactttcaagattttgtggaaaatgattaaacaaaattttgttaatcaacgtcatatcattgttccatttattagcgtaataagtattttattcggtattgaatacatattgttatcgttaacaaccaacatttactttaatgagcatcatcctgaattaaaaatatctgcgattattggaatagtgtttatgacgatgttattattcatatttttaatttatgcaaatcactttgttatgaatcataggaaaaaggaatttgccttaaatatggttcttggtatggagaaaaaacatctaagactcatcatcttgattgaacttttcattcagtttattatatctgcaatattgagcattgttggaggttacttatttggtgagctcttttttatgttatttaataaactagttaatacgcatcaacctcagttgtctgattatccatttgatgttttatcaatgaaaatcacattaaccatgctactcagtttgatgatcatattgtttgttattaacaattttaaaatatcatttaaaaactccttacagttattgcttaaaaataaaagtaagacgcatgaaaagtcacgtgtacggttaataatatttttaattttaggattaatttttatagggattggctattatttagctataaaacctaacacagctatcggttccttggggattatattttttgcgattttgtcaacgcttattggtacctatttgctctttgttagcttaggatcaatagttttagaaatgttacaaaaattagattattattattataaacccaatcattttttctttattgcaggactcaaatcacgcgtaaaatctagtgcgattggtttagctaccatttcatttatgtgtacatttctgattgttacgttaagtatgacagtctcaacttatagaaatatggatcataggtttgaatttgcatttaaaaatgattacgcaggttattatattggtgattttcataaagatagcaaacttcaacgtaagatagaaaatttaaaaaaagatattcgccaagaagttccaactggtcaatttaaaatttatgcacgaggtatggttggagccgaattgcagggaggcttaaaacataaaaagctaaaaagacaaactgtatcgagtggtttatttaatttcggaaataagcaaaaattcaactcttttatttctatatataataaaagtgattataataaaaacaataaaaaaataaaattagatgatgatgaaattgcaataagtacaagtgtgtcattatttaaaaaaatgaaaacgctcaatatatttgggaaaacatatagagttaaatatattgagtctacaaatatagataacttactctatgcagatggtataactttaattgtgaatcaacaacaactgatggatcgtatcgttaatgaatatcgtaatcacaatgatgaaaatttaatcatcactcctaatcaagtccaaactgccgttgaatttaatgtattaaaagaaaaggataagttgaatcatcgtattaagaaaataggtgttcaacacgatattgaatttcaagtgaaaaaacaaaacctattgatgtggaaacaagtcaactcaagtttagtttttgttggaagtgttgtatctctagttttattgataggtatatttcttatgatgtattataaacaagtttcagaaggacatgaagatagagatgcatatataacgatgaaacaactaggattagatgaaattttaatcaaaaaaacaattaataaacaagtaatatgggtatttctcattcctgtaattgttgcaatcatacatacgttagctgcttttcgcatcatatactctgtattaggaatcgttggtcaatatgacttgggactgtatgctacaagttatgtcggtgtgatagttgtatttattattttttattcaataatgtactggattacttctagaatttattatacgatgataaacggtaagcattaa

SEQ ID NO: 1215 - DNA, 1626 bp, S.epidermidis
cggatgattttagttcaattaatattattcatcaaattaatcagttatttaaaggtgatgtttcaagtggcacgtaaatttagagtacttcaagtaggtggtcatgatttaggttctttatttaatcaaaaaagtaatgtcgaatgggattattttgatgttggtttgtttgattttgaaagtggctatcaagatgttgtagtacatattttagatgaaaaaggacaatttgattttgtttttgtacgtgaaaaatattctgattcattaatgaaacttttatcattagtcagtacaccgtataatactgtgattgacaatgagtattgggataatcaataccaacaagataagacaatacaacgtaattttataaaaccactcatttatgaaaatgaagaacaattacaacaaaaactagaggcagttacatttcctgggcaatatggagataaagttaaacctattcattgtcgcgttagtattcattttgatggttcttatcaatttaatggaaatgagtctattgaagtatcaggacgatttggggaatcataccaacccctcattacatggagtcaaaatatcattgctgatgccaataaggtgaatcaaatatggccagaatttaaagttgaaggtgatgctaaaatccaatatacattgagattgacgcctgtttattcaactgatcaaccagtagaaaagctaatatatgaacaagacgatttagacactcccatagaactacctgctcgtccttatcaaacatatgtgagtgtatcaatcaaagctaaaggtaaaggaacattatttataggtgctattcataaacgttggtcacgcttggaattagggcagttcatattaggcggaaaacgatatagtgatgaaaataagcaagaatttatacattacttccatcctggagatttaaaaccaccactcaatgtatattttagtgggtatcgtactgctgagggctttgaagggtactttatgatgaaacgtatgaatgctccatttattttaatagctgatcctagaatcgaaggtggtgccttttacctagggtcagagaattatgaacaggcaatccgtaaggtcatccaaaatgctttggattatttgggatttgcgaacaaccaattaattctttctggattatcaatgggatcatttggcgcactttattacgctacaaaattaaatccagcggctgttattgtaggaaaacctttgataaatctcggtactattgctaataatatgaaactcgttcgtccaaacgattttggaacgtcacttgatattttgcgattgaatcaaaatggcataactaacaaagatgttgttcagttagataatcatttttggaagcaaattcagcatagtgatttgtcaatgaccacatttgcgattgcttacatggagcatgatgattatgacaaatatgcatttcaagatttattgcctgttcttacaaaacaacatgcacgtgtgataagtaaaagaattcctggtagacataatgatgattctgctactgttactcattggtttattaatttttatcatttaatcatggaagagcgatttgggagggtaacacatgcaagaagatag

SEQ ID NO: 1216 - DNA, 711 bp, S.epidermidis
ggtgacaatatgaaaagaacagataaatatagagattcatacaaatatgatgaccaatatcaaaatcatcgtaaacgttcagaagaagatatgtatcgacaacatcaagagtcccaacagagagcaaattcaaatcgtgcaacacaaagtgaaaatgatagagagtatgaaaatcatcctgaacgttattacaatggaagagactatcgacgtgagcagcaattggaagaagaaaatgaaaaatcaagcaaaactaaaaaatggctgattgcaatcatagttattttactcattattgtagctatctttatcacgcgtgcaattatcaatcataataatgataaagtaagtaatgaccctaacgtttcacaaaactataaaaaagaagttgaaaatcaaaacgacgacattaatcgacaagttgattcagccaaaagcgatataaaaaataaaaaggacacccaatcccaaattgataaactacaaaatcaaattgatcaattaaaacaaaatgaagaaactaatgcggattctaaattcacaaaattttatcaaaaccaaatcgacaaactgaaaaatgcaaataacgctcaacttaataacgaaaatcaaagtaaagttaacaacatgcttgaagacatcaatacaaaatttgatagtattaaagctaaactagaaaatatcttgaatggatcaaattcaggaaactaa

SEQ ID NO: 1217 - DNA, 1044 bp, S.epidermidis
gtggtaaatatgttggagcaaactgatttaagtttagagcaattacttaagaattattatgaaaccacgaacgagaaaattgtatttgttaatagacaaggcaaaattattgctatgaatgacgcagcaaaagatattttaactgaggaagataattataatgctatgacaaatgcgatttgtcatcgatgcgaaggatactctaatgaatatgatgtacaatcgtgtaaagattgttttttagagacaacgcaattacaacattccaatttccaagtatttatgaagacaaaagataatgaaattaagccttttacagctatgtatcaaaatattgatgaacaaagaggtattagtgcatttaccttacagaatgtggcgcctcagattgaaaggcaagaaaaaatgtatcaacaaaaaatgttacatcgttcaattcaagcacaagaaaatgaacgaaagcgtatttctagagaattacatgatagtgtaatacaggatatgctcaatatagatgttgaactaaggcttttgaagtataagcacagggataaggtgttagctgaaacatctcaacgtatagaaggcttattatcacagcttattgatgatattagaaatatgtctgttgaattaagaccttcttctctcgacgatttaggcattgaagcagcttttaaatcatattttaaacagtttgaagaaaattatggtatgcatattaaatatgattcgaacattaaaggcatgcgttttgataatgaaattgaaacagttgtgtatcgtgtagttcaagagggtgtatttaatgctctaaaatatgctgaggttaatgaaattgaggtaagtacgcatagtgatggcaagcagcttgtagcagaggttgtggatcgaggtaaagggtttagtttagatcatcaccctaaaggctctggacttggattgtacggaatgagagaacgtgcagaattagttaacggtcatgttaatatagagacacatattaatagaggtactataattacattagatataccgatttaa

SEQ ID NO: 1218 - DNA, 534 bp, S.epidermidis
gaaacaaatatgaaagaaaaacgtagtaatgttcgttggtattttgcaatagggttcttctttattggggttattgcttacatggatcgatctaacatatcttatattgcagtaccgatgatgaaagatttggggttaactaagacacaatttggtttattagcatcatttttctccctaggatatgcattaatgcaagtaccttcggggatgttagcagagaagtttggaccacgtaaaatgattactgtcgctttagtttggtggagtgcatttaccatcttaacagggatgattaaacatcatggtttactttactttattagattcttatttggtgttggtgaagcgccaatgtatccatccaatgcagtttttaactctttttggttcgctaaaaatgaaaaaggtcgtgcatctagtgcgttgttagcaggatcttattttggtccagttttagcacctatcatcactatagccattgtcaatgcttttaactggcaagccgttttctatattttcggggttgtatga

SEQ ID NO: 1219 - DNA, 591 bp, S.epidermidis
aagtatgatattaacgagatgggtgacaaaatgtataaatatttaaaaagaaatcgattctcaacgcagacttcaattataaaaaatgacgctcagcaacctgttggtatgatatcgaaagtgtataaaaattttattcaaaaatgtattggttatttgaccttaggtttaaaattaaatcaatatgagatatgtgatgtgaataataatagtgtagcttatattaaggtatcgcgatatatggagaaaaaacattttaaagttgaatatcatgattcaaaaggtaggcagtgtgaagcgttatttgataagcaaagtaatggttatgaggagacgtatggaatattaaaaattgacggtataatattaaatattcatgctaatgagaaacatcatactactatcaaagatataaagcgagatacacaaattgcgagttggaaacaaattggtgattatgcttatgcagaagggaatgatgggctatttaaagaacatcaattactctatattcttatcatgcacgcttttgctaatacatatgtgagcaaacgtcaaacgagcttgatgttcccagggccacctgtttaa

SEQ ID NO: 1220 - DNA, 144 bp, S.epidermidis
atcttcgatataaagtgcaggctttctctctacatacatctttctcaacctccgatttctcttcaaacccattatagcgaattaaaatttaatatagaaactttatgtcatattacagttgtatcatatatcatttatagataa

SEQ ID NO: 1221 - DNA, 141 bp, S.epidermidis
gacatcgatatttgtctcaggtgttttgtatattggaagttaatggctgaatttaaaatgtgccgaagtaaatctttatattataaattctttaaaaaggtatacgacggtagatattttaatcaattactatttttttga

SEQ ID NO: 1222 - DNA, 1149 bp, S.epidermidis
gtaaaatgtattttttcacaaaaattatatatatccattcaacaaacgtggtataattattgtgaaaaatttcacataataaatggaggtattgatatgaaagcttatgaatacttaaaacctggtcatgcacaacttacggataaagagaagccaactattacgagcagtactgacgctattattcgcatagttaagacgacaatatgtggtacagatcttcatatcataaaaggagatacacctgaagttaaatcacatacgacactaggtcacgaaggtattggaatcattgaagaaattggtgacaacgttaacaacttcaaagttggagataaagtgattatctcttgcatttcatcatgtggcaaatgctactattgcaaaaaaggtatctatgcacattgtgaaaacggaggaggatggatattaggacatttagtgaatggtactcaagcagaatatgttaaagttccttttgcagataattctttatatcacgccccttcaaatttaaaagacgacgcccttgtaatgttatcagatatacttccaacaggttatgaaattggtgttttaaaaggtaaagttaaacctggctgtacagtagccattgtaggcgctggtcctgtaggtttagcagcattacttacagcacaattctattcaccttcaaaaattattatgattgatttagatgataatagattagaaaccgctaaagaactaggtgctacgcatttaattaactctaaagagactgaaaccgcaattaaaaaggtaaaatcgttaaatccacgtggtgttgatgttgctattgaagctgtcggaattccacaaacctttgatttatgtcaaaatttaattggtgtcgatggtacgattgctaatgttggtgtgcatgggttacctgtacaacttgatatagataaattatggattaaaaatattaacgtaactactggtttagtttcaggaaatacaactgaagaattacttgaagcgttaaaaagcaaaataatacaaccagaacaactcgtgacacattatagtaaactgagtgaaatcgaaagtgcctatgatttatttagaaatgcaacagatcataaagcgattaaattaatcatagagaatgatatcacaatttaa

SEQ ID NO: 1223 - DNA, 162 bp, S.epidermidis
ctcaaacgtatgatttgggtgtatattaattatggagtgaaaataaatgtcggctatgcgagggtattatccatggatcaaaatttaaaaagacaactggataatttgaaaacgtttggtgtgaaaaacatttacagaaaaacagtctggggaatctattaa

SEQ ID NO: 1224 - DNA, 201 bp, S.epidermidis
aggaggcgtatcatgttttctactggtaataaagctaaaaagactatatttggagctatgacttgttcaaaatgtggtaagacactcaataatgatgaaaatattaccatcaaaatcaatactaaagaattaaaaggttatactcacttatcaagttgggctgatgcacagtataaattgtgtgaaaactgctcagaataa

SEQ ID NO: 1225 - DNA, 126 bp, S.epidermidis
tataaaagtatagcgtattgtgcttgcttaacagtttttttacaatttcttacgatttattataaaaaatttataattttaattaaaattaaatacccatcacttataagatatgctaatctataa

SEQ ID NO: 1226 - DNA, 270 bp, S.epidermidis
attatattcatatttaagttatttttatcgttaaacttgaaaacaaataaatatgtatataaaatttataatttaatacacacaaaaaagcaccttaaatgttttcattactcatttaaggtgcttattaaattaaatatttattttaacggttacctacatcatgaccgacatctacagtatttttatctttatcataaacagcaccttggacactgccaaagtttggatcattatgcttttcttcaacaccataaccaagacttttaa

SEQ ID NO: 1227 - DNA, 336 bp, S.epidermidis
gtgtatatcatgtatgagaatatacaaaatattgaagatttttaccgatttataaatgcacacgctttagctgttgttcatattatgagagataattgtacagtatgtcatgcagtattaccccaaattcaagatttactaaaggactatccgaaagcacaattaggtgtgattaatcaatctaatgttgaagctattgccggagaactttctatttttacagtacctgttgatttaatttttttgaaagggaaagaaatgcatagacaagcacgttttatcgatatgcaatcgtttgaaaaacaattgtatatgatgcaaaatgccatcgattaa

SEQ ID NO: 1228 - DNA, 1566 bp, S.epidermidis
ggagtaatcatagagatgaaaatatttaaaactttaagttctatactagttacatctgttctttctgtgactgtgattccctcaacatttgcatcaacagaatctactgctacaaatcagacacaacaaacagtactttttgataattctcatgctcaaactgcgggcgctgccgattgggtgattgatggcgctttctcagattatgcagattcaatgagaaagcaaggttaccaagttaaagaactagaaggagaatcaaacatttctgatcaatctttacagcaggcgcatgtattagttattcccgaagctaacaatccatttaaagaaaatgagcagaaagcaatcattaattttgttaaaaatggtggtagcgtcattttcatctcagaccactataatgccgatcgtaatttaaatcgtattgattcttcagaatcaatgaatggttatcgacgtggcgcatacgaaaatataactaaagatatgaataatgaagaaaagaattctaacgttatgcataacgttaagagttctgattggctctcacaaaacttcggtgttcgctttagatataatgcacttggagatatcaatactcaaaatatcgtttcaagcaaagatagttttggtattactaaaggtgtacaatcagtttcgatgcacgcaggttcaacattagcaataactgatcctaataaagctaaaggtattatttatatgccggaacatttaacgcatagtcaaaaatggtctcacgcagttgatcaaggtatttacaatgggggtggcatcaacgaaggaccttatgtagccatttcaaaaatcggtaaaggtaaagctgcatttattggcgatagctctctcgtagaagatcgttcacctaaatatcttcgtgaagataatgggaaacctaaaaaaacgtacgatggttttaaagaacaagataatggaaaattattaaataatttaacaacgtggctaggcaaaaaagaatctcaaccttctatgaaagatatgggtattaaacttgataataaaacaccgctacttaactttgagcaacctgagaattcaattgaacctcaaaaagaaccttggactaccccaatagaaggttacaaatggtatgatcgttcaacatttaaaaaaggtagttatggaagtaatcaacggggtgctgacgatggagtagatgacaaaagctcttctcatcaaaatcaaaatgccaaagttgaattaactttacctcaaaatatccaaccgcatcatccatttcaatttacaatcaaactcacgggatatgagcctaatagcacaattaacgatgtaagagttggactttataaagatggaggtaagcaaatcggtagcttttcttctaaccgtaaccaattcaatactcccggctatagtcctagccaatcaattaaaacaaatggagcgggtgaagcctcattcacactcacagctaaagtgacagatgaaattaaagatgctaatattcgtgttaaacaagggaaaaaaattctattaactcaaaaaatgaatgaaaatttttaa

SEQ ID NO: 1229 - DNA, 624 bp, S.epidermidis
gaggaaatcatcatgaatatgcccttaatgattgatttaagtaacaagaaagtcgtcattgtaggtggaggtaaagtggcaacacgtcgtgctaaaactttattagcttatacaaaacatattcatgttgtaagtccaacaattaccgatacattacaaaaatatctagaaacgaagcaaatcacttatgaaaagaaacacttcgaaccacaagatgttgagaatgctgatgtggtcatcgcggctactaatcaatctgatgttaacaacgatgtgggggcagctttgtctaagaacgtattatttaatcatgcaggacaagcagacctaggtaatataacgttccctaatttcttaaaaagagataaattaacaataagtgtatcaactgatggtgcaagtcctaaattaggtcaacgaattattaaagatttaaaagatacatacaataaagactattcaatgtatattcagtttttatatgaaagtagacaatatattaaatcacttaaaattgagccatctgataaacaagcgttactcgagcaaattttgtcagacaaatatttagatgagaagaagcaacaagatttcatccgatggctaaaatcacaagtcaaatga

SEQ ID NO: 1230 - DNA, 123 bp, S.epidermidis
gatgactccatgtattctaacgctaaaagtcatgtttgtaaaaaattagtcacaattaaaaaaggagcggaactgaattcatctaaaaattctatgtcccgctctatcgctcttattgactga

SEQ ID NO: 1231 - DNA, 435 bp, S.epidermidis
agtagtcccatatggtacaaaacaataactgttcaaaggagaaatattatgaagttaacccgaatacattatgagattataaagtttatcatagttggtggaattaatacctttaactactatataacatacttatttttgttaaaggtgttacatgtgaattatatggttagtcacattgttggatttattgtaagttttattatttcatattatttaaattgttattttgtatataaagtaaaacctacaatagaaaagtttttaagatttcctatcactcagatagttaatatggtaatgcaaacgttattattatatatattcgtaaagtggttgaatatcgcttcagaaattgcaccttttgcgggtctaatcattacaatcccagtgacattcatactttctaagtggttacttagagataaagtttaa

SEQ ID NO: 1232 - DNA, 207 bp, S.epidermidis
tttttatacataagacacctcgttaatttagtttattggtatttattaaattatacgaaaggtccttatttttcaaagtattttaatataaaattacatatatgcacaaagtattttggcgagactcttgagggaacaggacaagctgaagactacaggctgaagctgtcagataagaaagcgagccaacaatacgaagtattataa

SEQ ID NO: 1233 - DNA, 1707 bp, S.epidermidis
ttattcaacatatacaaaggagtatttatgaaaaataatagcaaatcaaaaagtaataagataagtctttctcaactcgtcctccttggtcttggttcactaataggatcaggttggttatttggagcgtgggaggcatcttcaatggccggtccagccgccattatttcctgggttatcggtttcttagtaattggaacgattgcctataactatattgaaataggaactatgttccctcaatcaggcggtatgagcaactatgcacagtatactcacggctcattacttggttttattgcagcatgggcgaactgggtatcattagtaacaattattcccattgaagctgtgtctgctgttcaatatatgagttcttggccttgggattgggctaaaccaatgggatctttaatgaaagatggctcaatcagtacttacggtttgattgctgtttacatcattattgcaatcttttcattattaaactattggtcagtaaagttattaacatcatttacaagtttaatttctgtattcaaattaggtgtccctattttaaccataattatgttattagtttccggttttgatacaggtaattatggacactctatcggtacatttatgccttacggaagtgcacctatttttgctgcaacaacaacatctggaattatcttctcatttaatgcattccagacaattattaacatgggatcagagattaaaaatccagagaaaaacatcgcacgtgggattgttatctcacttacattaagtgctatattatatatagttttacaaagtacgttcattacatctatgccaagctcaatgttgcacgagcatggatggagcggtatcaatttcaattctccatttgcagatatggcaattttattaggtcttaactggttagcaatattactttatatggaagcagttgtgtcaccgtttggtactggggtttcttttgttgccgttactggacgtgtgttacgcgctatggaagaaaatgggcatattcctaaattcttaggtaaaattaataaaaagtataatatcccacgtgttgccattgcatttaatgcaattatcagcatggttatggtgacattgttccgtgactggggtacactagctgcggttatttctactgcaacattagttgcatatttaactggtccaactacggttatttcattacgtaaaatggcaccaaaaatgactcgtccattcaaagctaatattttaaaatttatggcacctttatcctttgttttagcatcattagctatctattgggcaatgtggccaacaacagcagaagttattttaattattattttaggtttacctatttatttcttctatgaatataaaatgaattggaagaatactaaaaaacaaattggcggaagcttatggattattatctaccttattgttctcgcatttttatcatttattggaagtaaagagttcaaaggcttaaattggattcactatccatgggatttcttagtcattgtaatcgttgctttaatcttctatcaacttggtacaacaagttactttgaaagtatttatttcaaacgtgcaaacaagttgaataagaaaatgggcgataaattgcgtaaaacacgcaaaaaagcgcgtcataaagattggaaagaacgcgatcgacaagagcaaaatcaataa

SEQ ID NO: 1234 - DNA, 1542 bp, S.epidermidis
gaggcaaacatggaagaaagaattggtttgatagacattggttccaacacgattcgacttgttatatttggctacaataaaaaaactgggctcaatgaaatactgaatataaaaacacctgcacgattaagtcaatatctcactaagtccaatgaaatgaatgatgaaggtattcatgttttaaaagagacattaagcagttttagaaaagttgcggataaatttaacgttgatgcattatatcccatcgcaacagctgctatccgtcaatcaaaaaatcgtgaagctatcattaaagaaattaaacaagatattcatatcgaaattcaaattgtacctgaagaagatgaagcattttacggttactatgcgattacacatactactgatattgaaaatggaatttctgtcgatatcgggggcggttctaccgaagttacccttttcaaagacaagcaacttaaagaggctcatagctttccattcggcgtggtatcacttaagcgtcagttttttggtgataaagcacacaatgacaaaacagccattaaaaatatggaacagtttttacgtgagcaatttagtcagttagactggctatccaaccaacatattgcgcttgtaggagtaggtggttctgcacgtaatgttgcacgcattcatcaatcagcacatgcataccctatcggtggcgttcataactataagatgacttcgaaagatattaacaatgtttatgatttaatccgtaaaagttctcgcgatgaacttacaaatttagacggtttaagccgcgatcgcgtcgatattattctgccagctatctccgtctttaaaacacttttcaaaaaaattgacgccacacaattcaccttctcaagaaaaggaattcgtgaaggatttattatgaaccacatcagcaaacgatatcctgatgagtttaataaaagtaacgtacgtaaagatgcattacgtcatttagcgaatgaatatcatattgaagaaacgagtgctaatcgtcgtgtaaaattagctcaatccttattgaatcaaattataagtgaacgatcacttaatatttcagcaatggaaaaagaattatttattgaaggttcctacatttattacctaggtagtttcattgattcagactcaagttcaccacatacgtattacttaatcgcaaattcaatgattaacggcttttcacataaagatcgtgtgaaattagctttgttagctagttttaaaaacaaatctttacttaaattttattgcaaagaaacacagtggtttagtaataaagaaatagatacaatacaagctttaggggggattattaaatttgcaaacaccttgaatatctcacatactagttttgtagaggaagttaaactaaaagcaaagaaagatgacaaatacgatttattagtttattacaaaggttcacctattgcagaagaataccaagcaaatcgtcagaaaaagcatattgaaaaaattttaaaaggtaaggtttctattatatttacaaaatcttaa

SEQ ID NO: 1235 - DNA, 174 bp, S.epidermidis
cgcttacgcatattcaaactaattgaagacatcgataatgaaccaaatgttgaaccatggtatgcattagtaaaacttatgatgtatggacgtcctgtatacgctcgtgcaaactttataatcccatcattagcatcagagccacttaatccgaaagtaactcttttctcataa

SEQ ID NO: 1236 - DNA, 1080 bp, S.epidermidis
aataggagcatttatatgtacaaattagttaagcctttattattcaaattagatcctgaacgagcacatggtttgaccatcaatgcgttgaagtgtgttcaaaaatgttcacccattttacctatcgttaataagttatttacttataacaatccaatattaacgcaacacattcacggtatttcttttgataatcctatcgggttagctgcaggttttgataaatcttgtgaagttccaaaagcacttgaaaacattggcttcggtgcaattgaactcggcggtataacacctaagcctcaaccaggtaatccaaaaccacgcatgtatcgtttactagaagatgatgcactcatcaatcgtatgggattcaataataagggtatgaataaagcactaagtaatttacgtaatcattcatgctcaataccagtaggattaaatgttggtgtgaataaaacaacttcctatgaaaatcgctatcaagattacattaaagtgattgacacatttaaaaatgacgtctcattctttacagtgaatattagctccccaaatacagaaaatctccaaaactttcacgacgaagatgaattttcgatgttatgtgatgctttaaattcatttaaagctaagaacaatattaatgtacctatctttttaaagttaacatctgatatggaattagatggttttaaaaaaatcttgccttcaattacagatacattcgatggggttatgttggcaaatacgacacgacaacgcgatggattaaattcaaaaaataaaatacaaaaaggtggcttgagtggcagaccattattccaaagaaacttacaactggttaaatatgcctatcaacaaacacgaggtaacttcttaattattggaactggtggtatattcagttctgaagatgctatcaaaatgttaagaaacggtgcatcattactacaaatatactcttcattagtcattgaaggaccaggtttgactaagaaaatgaataaagaaattgcgcattatttaactcgacatggttatgctaatgtaagtgatattattggtttagatgcataa

SEQ ID NO: 1237 - DNA, 318 bp, S.epidermidis
aacaacttttttcccaaattttttcattttaacgaactccttcataataaagttacacaaataactgtgttagcttatttgtataatatttctattaaaataactagaattttacttcagttcagatataaaaaattcattttaatgacaatttttcaacacttttctgaagcaatcaattcagcgactaactttattacgtttattattatagtacgtgacaaagtattaataaaatacataataacgatgttaaccattcataaaaggaataggtttcctatagaaaaatgtaatactttgtttattcatatatga

SEQ ID NO: 1238 - DNA, 141 bp, S.epidermidis
tcgcttttaatgatgatgcaaacagataattttgcattatttacaaaagaggttaaaataggtattacattaagtaaacgcttacattttattagggataagcgattacttcaaatatcactaaaaaaggatgggttttaa

SEQ ID NO: 1239 - DNA, 1185 bp, S.epidermidis
attattttaatgaggaggcatagcatggaaatgtcagaaaggctagcttcaattcctgatagctactttggcaaaacaatgggccgtatagttgaacatggtcctttaccacttataaatatggcagttggaattccagatggagaaacgccaaagggtattatcaatcatttttcagaggcgctatgtattccagaaaatcaaaagtatggtccatttcacggcaaagatgcctttaaacaagctattgttaacttctaccaaagacattacgatgttgaattagacaaagaagatgaagtttgtattttatatgggactaaaaatggtcttgttgcattacctacttgtgttgttaatcctggtgaaattgtacttttacctgatccgggatatacagattatttagcgggggtcatgttagctgatgctaagccactccctttaaaattgtcgccaccaaattatttgccgaattggaatactataagtgctaaagttcttgagaagactaagctaatttatttaacatatcccaataatcctaccggttcgacagcgacacaagatgattttgatgaagcgattcatcgttttaaaggtactcaaacaaagatagttcatgactttgcatatagtgcttttggatttgacgccaaaaatccaagcatattagcttctaaaaatgcaaaagatgttgctatcgagatattctctttatctaaaggttataatatgtcaggctttcgtgttgggtttgctgttggtaataaaaaaatgattcaagcgttaaagaagtatcaaactcatacaaatgcaggtatgtttggagcacttcaagatgctgctacgtatgcactcaatcattatgataagtttttagaaaagcaaaatgaaatatttagacgtagacgtgataattttgaatcacaactaaaacatgcacatttaccgtttgttcactctaagggaggtatttacatttggttacatacacccccgggttatgatagtgaagcattcgaacagttgttattaaaagaaaagtcaattttagttgcacctggtaaaccatttggtgaaaatggtaatcaatatgtgagggtttcattggcgctcgatgataaacaattagaagaagcggcgaatcgcttaacacaattacggtatttgtatgaaagataa

SEQ ID NO: 1240 - DNA, 147 bp, S.epidermidis
tgttgtttaatgctttttttatttctaataagtttagtatcaataagttttgtaattgctgtgtatcaaatgttagaatttctaaaaaatggaacgcaatattatgctgtttggacgaccgatacattttttgatatggttcactag

SEQ ID NO: 1241 - DNA, 144 bp, S.epidermidis
gacgtattaattttaaataaaaatctcgggagtgagaccatggatgaagcattattcattggtctcactctcttttttaatataatgaatgaaatgtttatgaatgagaacgatgtgtttcttctattatatagtctaaaatga

SEQ ID NO: 1242 - DNA, 135 bp, S.epidermidis
atcacattaatgtcctattctctaacaaaacgttatgataaagttgttcaaaataattctatgataaggagtaatgatgtatggcaaaagttaaagagaaagttgcagtcgttacaggtgcgagtagcggtatag

SEQ ID NO: 1243 - DNA, 135 bp, S.epidermidis
ctggaattaataaaaaaagtcccttattcaagctatggcttatgtatgtgcttgaataagggattttatcttactatagtttcacattatgaaaataaattttttaatattctgtataaagagcctaataattga

SEQ ID NO: 1244 - DNA, 180 bp, S.epidermidis
gtaaagttaattctagagaatttaacatttctagaattaacttttttaagtataaaatataacaatcttccatcctgtaaaaataacttaagctatttaaggtgctttaacttattagaaaatggtcaatatttattacaacaggtatacgctcagaaaaatagttactctcaaatctag

SEQ ID NO: 1245 - DNA, 123 bp, S.epidermidis
atgtgtctaatcaatgatcatattgtgtctaaaatattacaaaatggaataggtagtattataaatatgtatttttgttatatagcctatcgtcttataataggaatcagcgcaataatttaa

SEQ ID NO: 1246 - DNA, 447 bp, S.epidermidis
attacgctaatcacaataattatagcttatcatagttgggtcataataaatttacttataatttacattagattaaaacaacgatgttacattatatatgaaagatattacgactttaggaggagaggtatggagaagtcagttaaacttgctgttggcatctatctagcaattattttaattatttgtagtatttacctcgcatttatacttattggaagcttaaatggtaaagacatgagtaattctgttctagatactgatcactctcgtatcaacaatacttcaagaaacagtaacgaagatgttacgtcatcaaataatgagtcaaacaatacaaaagcgcactcatttgcaaactctgaatataaagctattaacataaacgaagcatttaaaaataataagcaaattaaaaaagcgaattcgagttatcaatactattga

SEQ ID NO: 1247 - DNA, 744 bp, S.epidermidis
ttcgctataatgggtttgaagagaaatcggaggttgagaaagatgtatgtagagagaaagcctgcactttatatcgaagatttacgagacgaattcaaaaatagcttaaaacattttaaagatgatgatgaagcatttaatacattagttggatttgtggaactggaccacctatattcttcagcacttaaagaaataagtacaaaattaagtattttagatgataactttaactatcaatataaacacaatccaattcatcatatggaacgacgagtaaaagagatgcacagtttagttaaaaagttgaatcgtaaaggatttgaagtgagtgcacaaagtgctaaagataacattatggatattgctggtatacgggtcgtatgtaactatttagacgatgtttatgtcattgaaaaaatgttattaagacaagaagatgttaaattattaaaacgtaaagattatatcacacatcctaaagaaaacggctatcgaagtttacatatcgtcgtatctattccagtgtttttagcagattcagtagaagtaacaccagtagaaatacaaattcgtacaatcggcatggatatgtgggcaagtttggaacacaaaattcgttataaaaatgatacagacactgaaaaatataaaggactattagaacaatgtgcatcagaaattacaaatgtagaaagtaaaatgcaacaaatacattcagaaatttcaaatcgagagaagtag

SEQ ID NO: 1248 - DNA, 417 bp, S.epidermidis
atggctataattaacttatctcatcgtggtgatacttcttttgacaaacttctcggacatctccctagtgttcaagaaaaatggaatgcattggaagatatattaaaaaatgaggggcaattatctgttgatttaaaagaagaaattaggaaaatactagctcaaaacagtggttgtctatactgcaaatctaaaggaaaacccaataagaaatttaccgatgaaaaatctttagtttgcataggatttgttgatgtttatgtgtcacaaaatggacgggttccacaatctacaatacaggttttaacaaagacactaactgatatagaaattgtagaattgttagcattcatatcatttacccactgtcaacaagaatttggtgccatgatgaatttacaacctagcaataactga

SEQ ID NO: 1249 - DNA, 1257 bp, S.epidermidis
agaaatataatgaaatttgtaaatttaacttctgaagaattcgagcaatttacttcagaaaatttctcgcattatacacaatccagtatacattataataatagatcgaaaacaaaaggtgacgtacatttagtgggagttaaagatggtcaagaagatgtcattgctgcgtgcttattaacagaggcacgttctttaaaattctttaagtatttttacacacatagaggaccagtcatggactttaacaatttagttttagttcgcttcttttttaaatcacttactgcttatttaaaaaaacacaattgtttatatgtactcgttgacccttatgtattagaaaatttacgtcaacctaatggagaaatcattgaatcctttgataatcgcgcattgattaaaacaatggaagaattaggttacaaacaccaaggatacactgtaggttatgatacaatgagtcaaatccgctggttatcagtacttaaccttaaagataaatctgaagatcaattattaaaagaaatggattaccaaacacgtcgaaatattaaaaagacttatgaaatgggtgttaaagttaaaacattacccattgaagaaacaaatacattttttgaattattcaaaatggctgaagaaaaacatggctttaaattccgtgaagagccttactttgttgagatgcaaaaaacttatgaagatcatgctatgttaaaacttgcttacatcgatttacaagattatttagatacgttgcaaactaaacatcaaaaccttaatcaacaactaaaagatgttgaaaaaacattagaagaaaatccaaattctaagaaaaataaaacgaaacatacacaagtcaaacaacaattcgatagtaatgcgcgtaaaatcagacaaactaaagagaaaatagcagaagaaggtcaagttcttcatcttgctgcagcattatatatatataatgatcacgaagtgtattacttatcaagtggctctaaccctaaatataatgcttatatgggagcatatcgattacaatgggatatgattcaatttgcaaaagaacataatatcgatagatataatttctacggtgttaccggagactttagtgaaaatgctgaagatgctggcgttcaaaaatttaaagaaggatttaacgctaaaatttatgaatatattggtgattttatcaaaccaattaaaccactattttataaagtaaaacaagaattagaaagtcgtagataa

SEQ ID NO: 1250 - DNA, 2661 bp, S.epidermidis
tatgacataataaaaaataagaggtggtcaagaatgacacaattcgtttatgcatttaatgaaggaaatatagctatgaaagacttacttggtggtaaaggtgccaatctttcagagatgaagagactcggactaccagtaccagatggttttacaattacgactgaagcttgtattacatatttaaaacaaaatgaagaactacctacagaagtaaagacacaattaattgatcatttagcagctttttctaaacgaacaggaaaagccttttcctctgatgataacttgttattagtatcagtacgtagtggtgcaaaaatttccatgccaggaatgatggatacaattcttaatttaggacttaatgatgataatgtaaaaaagcttgttgacaaaacaaatgatgcacgatttgcatatgattgttaccgtcgtttactacaaatgtttggagaggttgtttatggtattccaatgacagctttcgatacatattttaatgattttaaaacaaagcatcgttatcaaaatgatgctgaaattccggcagaaggactacaaactatatgtgaaaaatataaagaaatctatgtagaagaggcatataaaccttttccccaagaaccgttaaagcaattagaagaagcaattgaagcagtatttaaatcttgggataatgatcgtgcacgtgtatatagagatttaaatgatattccacatgatattggtacagccgtaaatattcaggaaatggtatttggtaatagtggtgaaaatagtggtacgggtgtagcatttacaagaaatccagttactggagaaaatcatttattcggagagtacttacttaatgctcaaggtgaagatgttgttgcaggcattcgtacccctaaggatattgacactttaaaacaacaaatgccagatgtacatcaagagtttgttgatgtaaccaaacaacttgaaaaacattacaaagatatgcaagacatagaatttacaattgaaaatggtaaactttatttattacaaacacgtaacggaaaacgtactgctaaagctgcaataaaaattgctgtggatttagttcacgagcaattaattacacgtgaagaagcagtatcaaaagtagaagtaaaatcaatagaccaattattacatcctaattttaatgaagaatcattaaagcaagcgacagtggtttctaaaatgggcttaccagctagtcccggtgcagcaacaggaaaagtagtcttctctgctgaagaagcaaaacttcaagctgaaaatggtaataaagtagtgttaatgcgaccggaaacatcacctgaagatattgaggggatggtagcaagtgaagcaatcgtaacaactcatggtggtatgacatcacacgctgctgttgtagcaagaggaatgggcaaatgttgtgtgacaggatgttcgaatgtagagatagatacagtgaacaaaacagtatattatcctgaaggtgaattacatgaaggggatatcgtttctgtagatggttcagctggtgatttatatttaggagcaattgaaacagtcaatgctgaacatagtgaagagttcgatcaatttatgacttggtctgaagagattgcaagactgcaagttagaatgaatgctgaaacaccacaagatataaaagctggatataattttggttctaaaggaataggtttagttcgtactgagcacatgttctttggccctgaacgtttaatagaaatgcgccgttttatcttagcttcaaatcatgacgaacgtgtacaagctttagaaaaaattaaaacataccaagtagaagattttgaaacaattttcagattatctcaagatagacctacgattgttcgtttacttgatccaccgttacatgagttcttaccatcatctgaagaagatataaacaatgtttctcaacagctgaatgtatcttcagagttcttacgcaagcgaatcgttgacttaaatgaggtcaatccaatgcttggtcatcgtggttgtcgtttggctgtgacttatccagagttatatgagatgcaagttgaagctatcattgaaagtgttattaagcttcaaaaagagggcataacgtgcctaccagaaattatgattcctctcgtgtcaacagtagaagaatttacaactttaaaagaacgattagttaatacaattacacatttagaaaaagaatcacaacaagatatacaatatatgataggtactatgattgaaacgcctagagcatgcttgattgcgaatgaccttgcgaaacattgtgatttcttcagttttggtactaatgatttaacgcaattgacatttggtttctctagagatgatgcaggaaaattcataaatgtgtatactgaaaataacattttacagcttgacccattccaaactttagatagagaaggtgtaggacgactaattcaattagctgttgaacaagctaaaaatacaaatccagagataaaaattggtgtatgtggtgagcttggtggcgatgcaaaatcaattcgtaaatttaaccaatgggaaattgattatgtttcatgttcaccatttagagttccgggtgcaattttagctacagctcagagtcaagcggaggaaagcgagcgataa

SEQ ID NO: 1251 - DNA, 645 bp, S.epidermidis
ggattaataatgaaagcattcttacaagaatacggtagtcaacttttatcaaaagcagtagaacatttttatatttctatgtttgcattattgttagcgattgtagtagctgtccctttaggtattttattatcaaaaacgcaacgcacagctaatgtggtattaacagttgctggcgtgcttcaaaccattcctactttggctgtgttagctatcatgattccaatatttggggtaggaaaaacaccagctattgttgcattatttatctatgtattattaccaattttaaataatacagtattaggtgttaaaaatatcgataaaaatgtcattcaagctggtcaaagtatgggaatgactaaatttcaattaatgaaagatgtagaaatgcctttagctttaccacttattattagtggtattcgtctatcaagtgtatacgtcattagttgggcaacactcgcaagttatgtaggtgcaggtggacttggggatcttgtatttaatggattaaatctctatcaaccacctatgattattagtgcagcgattgttgttactttattagcattagttattgactttatactttcattagttgaaaaatgggttgtacctaaaggattaaaagtatctagataa

SEQ ID NO: 1252 - DNA, 138 bp, S.epidermidis
catgaaataatgtcgcagactttcttcacttataaagagggaatctctaaattttataactgtttaaataatgtcaaaggcccaataaaaagagattatagaaaaatcgaacagattaagccagttgcacgacgatga

SEQ ID NO: 1253 - DNA, 2889 bp, S.epidermidis
aaaagaataatgataattaggagtgtgaaaatgaaaaacgcactaaaactttttatcacggatttaaaaagagttgctaaaacaccaggtgtatgggtcatcttagctggtttagcaattcttccttcattctatgcatggtttaacctctgggctatgtgggatccgtatggtcatacaggacatatcaaagttgccgtagtgaatgaagaccaaggtgaaaaagttcgtggtaagaatattaatgtaggaaataaaatggtcaaaactttaaaaaagaatgatagttttgactggcaatttgtgagtagagaaaaagccgaccatgaaattaagatgggaaaatattatgcaggtatttacataccgaagaaatttacacatgaaatcactggtactttaagaaaacatcctcaaaaggcggatatagattttaaagtaaatcagaagattaatgccgtagcagctaagttaaccgatacgggatcgtcgtttgtgattgataaagcaaataaacaatttaacaaaaccgtagcaaccgctttactttctgaagctaataaagtcggactatcaattgaagataatgtacctacaatcaataaaattaagagtgctgtatatcaagctaataattcattgcctaaaattaatcaatttgcagacaagattattgaactaaataaacatcaagacgatttggatgcttatgctaatcaatttagaagtttaggaaagtataaagggaatgtattagacgctcaagaaaaacttaatgctgttaattcgtctattccggcgcttaatgaaagggctaaattgatacttgcacttgatagctacatgcctaatattgaaagaattttaaatgttgctgctaatgacgttccagcacaatttcctagaatcaataggggtgtcgatattgcaagtgaaggtattgatgcagcgagtggtcagttaaatgatgcaaaaggttatttgactcaagctaaagcgagagtgggagactatcaagaagcagctggccgcgctcaagatgtgaacaaccaagcaaatcaaaatctaagaaatcaaacatcaactacaccccaaagcgctataaagtcatcgcattcggaagggaagagtcattcaagtattaaaacagtacctgtgagtcaatcaggtgagaatcaacccgtttatggtgataacattttatctaacagtgatgtaaaatcaatgaatacagctttaacagaagctttattatcattatctaatcaaacagatcaacaagcacaagctacccaacaagacattaagtcattaaaaaatatagcatatggtgttatcgcttcagataaaccatcagagtttaaagaaccattaaaaaatataaaatcacgcttagaaaacgcatctaagtataatcaacaatttatagatatcttgtcagagttggaaaaaagtgaacatgttgatctatctaatgaaattaagcaagtgaaagaagcaaacaatagcattaatgataatttaaaaagtactaatcaattaatagatgcattgtcaaatggtagctccggacaattagaagcagtcaatgtattacgtgacttacctaacttaaataaaaggttagatacattacgaaattacattaaaaaagaacttaatcgtaatttactagctgtttctaatgagattactgatcaacttaataaaggtcaaaatacattatcgacaatccaatctaaattaaatactattaaccgagtgattaacgctggtcaagatattttaaatagcggtaaaaagagaattgatacgattcaaactgcattgccagcaatcgaaaacgcatatataaatgcaatgcgaactgcacaagcttacttcccaacagctaaaaaagatgtcgcgaaagctgcagactttgtacgtaatgacttgcctggattagagagagaattagctaatgtaacacagtctgtaaaccaaaaaataccatctttatttagtcgttatgataatgctgtagatttattaaacgagaaacagcctcaagcaaaagaagcacttgcttcgcttgccgatttctcagaaaataaattgccagatgttgagaaagacttgaaaaaagcaaataaaatcttcaaaaagttagataaagatgatgctgtagataagctaatagatacattgaaaaatgatttgaagaaacaggcagatattgttgctaaccctattaataaaaaaacgacagatgtgttcccagtaaaagactatggttctggtatgacgccgttctatactgcattgtctatttgggttggaggattattaatggtcagcttattatctgtagataacaaacatgaacacttacaacctattatgacgaagagacaagtgtatcttggtaaatctggtttctttttcttattaggtatcatacaggcattaatagtatctatcggtgatttagttatccttaaagcatcgatagaatcaccgatattatttgtctctattgccgtgtttagttctctcgtatttaattcgattatttacacatctgtatcattgttaggtaaccctggtaaggctgttgctattatcttacttgtgttacaaattgctggtggaggaggtacattcccaattcaaacaacgccagaattcttccaagcgatatctccatatttaccattcacgtattctatcgacgcattacgtgaaacagttggaggtatagttccagagatactgattacgaaagtgatcattttaggtttattcggaatcggattcatggttgtaggttattgcttgaaacctgtgactgaccctattatccgtaaaattgctgaaaaagctgatgaaagtaaagtaactgaataa

SEQ ID NO: 1254 - DNA, 234 bp, S.epidermidis
aaattgataattaagaacgtagaaagatttcattataaaagaaagaattttccgaaaaatacttgtcagataacttgtaacatgttagtgtattactacatttttactttaatgtattatcgaactaaagaattcggcgtgagggaggggtggcttaagtatgaacaataccatcatttcaatgaaagaaaaggaattacgttttttaaagttttttcatcaacaaaaatataa

SEQ ID NO: 1255 - DNA, 138 bp, S.epidermidis
aaaaatgtaatactttgtttattcatatatgaaataaacgaatatgagttaatcgcggtctttttcgtcaataaagacatcaattcaatgcctttattaaaagactacctactaggccatacccacctctatgtataa

SEQ ID NO: 1256 - DNA, 759 bp, S.epidermidis
ttattcgtaataatgataatacaaaagggtgggataattatgataggtaatattctagtcgctcacggcatgagaaaaggaaatcagaatgaagctttagaagaatttatcggaactttattaaaagatgagcaatattattatgagttagcatttttagaaagtgaaacacaaaatcttgaaatcataatggagaagatgattaagcaaggaattacaaaatttcgtattgtacctttactcatttttagtgcaatgcattatatcagtgatattccacaaatacttaaagagatgaaagctcgatatccacaaattgatagtaaaatgagtgcgcctcttggtacacatccatatatgaaaacattagtagaaaatagaattgctgatgaaaaagtcagtgaaggttcaaccaaagcaactatagtaattgcccatggaaatggaagtggacgttttacgaaagcacatgatgaattaaaagcatttgttaaaacgcttgatagtcatcatcctgtttatgcaagagctttatatgggacattagcatttaaaaatgatttagataaaatctcagagcaatatgacgagttagtcattgtcccattatttttatttgatggtagattggtgaataaagtaaaacgtcttttaggtgaaatgacattgcatagtcaattacacattacgccatcgattaactttgatccaattttaagattaattattagagaaagacttgaagcgttagatatttaa

SEQ ID NO: 1257 - DNA, 1569 bp, S.epidermidis
aggaggtcaattggcttgaagattaaagcgcaagttgcaatggtattgaatctagacaaatgtattggttgtcatacttgcagtgtgacatgtaaaaacacatggacaaatcgacctggtgcagaatatatgtggtttaataacgtagaaacaaaaccgggtgtaggatatccaaaaagatgggaagaccaaggacaatataaaggtggttgggtgctaaataaaaaaggaaagcttgaattaaaatctggtaacagatggtcaaaaattgctttaggtaaaatcttctataatccagacatgccactcattcaagattattatgaaccgtggacatataactatgaacacttaaccaatgctaaacaaggacagcactctcccgtggcgacagctcactctttaatttcaggtgatagattgaatcttaaatgggggccaaactgggaagatgatttagctggaggtcacattacaggaccagaggatccaaatattcagaaaatagaagaagatattaaattccaattcgatgagacatttatgatgtatttaccaagactatgtgaacactgtttaaatccaagttgcgtagcatcttgtccatcaggagctatgtataaacgagatgaggatggtatcgtactcgtcgatcaagaagcctgtcgaggttggagatactgtatgactggatgtccgtataaaaaagtatattttaactggaaaacgaataaagctgaaaaatgtacattttgtttcccacgaatcgaagctggtatgccaactgtttgttccgaaacttgtacaggacgtatgagatatttaggtgttttattatatgacgcagatcgcgttcaagaagcggcttcagctaaagatgaaaaagacttatacgaaaaacaattagacctattccttgatccatttgatgaggaagtcattgcacaagctgaaaaagatggaataaatcaagaatggattacagcagctcaaaactcaccagtgtataaattggcaatagaatataaaatggcctttccattgcatcctgaatttagaactatgccgatggtgtggtattgtccacctttaagtcctattatgagttatttcgaaggtgaaaatgcaggtcaaaatccagatatgattttcccagctattgaggaaatgcgtttacctattcaatacttagcaaatttattaactgctggcgacacaaaacctgttaaagagggcttacaaaaaatggcgatgatgagaagttatatgcgttctcaaataacaaaccaacctttcgatacttctaaattagaacgattaggacttactgaaagacagatgactgaaatgtatcgcttactaggtattgctaaatatgaagatcgttttgttgtgccttcttcccataaagaaacatatttagatacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaa

SEQ ID NO: 1258 - DNA, 210 bp, S.epidermidis
acaataccaatcattttacctctgttttttgctgatgtgagcatcgctgtgagtgctaaaactttcacaataatgagtgaagctgcggcagaagataaaatacgtcctacaactattattccaaaatgtggcgcaatggcaatcataccattcccgaagataaagacaattaacgtccataataatactgatcgcgaagaaaaccgatga

SEQ ID NO: 1259 - DNA, 201 bp, S.epidermidis
acaagtgcaatggcctgtgtttttttagcaggaggtgcgactgtcgcagcaacactcatacacacaccgaagaatggcgcatgcattgccgcagacatgagtcttgataataacaatacattaaaattcggtgctaacattcccactaaattacttattataaaaatcgctactaaaattggtaacagacggtgggcgtga

SEQ ID NO: 1260 - DNA, 231 bp, S.epidermidis
accaggcaaatagtgcggtttataagttttgttgagacgtctataattgttctcgttcattcaattacactccgtttaatttttaaaatacttgctcttaatattatcacaattacatcctcaattgcattgacatgtcatctttttactttaatattatactttaacaaattaaataggtatacatttattagagcatcttcatataagttgtgtaggcaagcaatttaa

SEQ ID NO: 1261 - DNA, 141 bp, S.epidermidis
cgaattaaaatattaaagacttatcgctcacttttaatggcgatgagtctttttattatagtcaattataaggaaatgaaaaaaataattatatttattaacagtaaatacaattttgtcgaagaaaagttcaaaaattga

SEQ ID NO: 1262 - DNA, 135 bp, S.epidermidis
tatcctaaaatggttttaataacaaatcctgtaatgacggatactgttataacaaaaaatcctggtatcataaagctcgtaggtcttgttctacctgtttcatctagttctacagcaaataatagtgtcggttga

SEQ ID NO: 1263 - DNA, 186 bp, S.epidermidis
aatcataaaatttttttcgaaatgataggtagacaagtcgccattaaaatgatgaaaaaaagatgtgcaactaaccaccatgcaaattcgttccaactaaaggaaaaaaatggacgttgcgcaagaaaaacgagaagtggatacatcaaagtaaatatcaatactaaaggtaagtatgctagatga

SEQ ID NO: 1264 - DNA, 249 bp, S.epidermidis
acatgtaaaataatctataataggtatcataattattgggggctagagaccctaagagaaggtgagacaatgatatttgtaatgttatctccaatattaattattttgtttattgtactaagcgtattagaagaaaaacgtagaaagaaaaattcaaaagaacaaaattcgaatcatgtagatcagcaacaatatgattataccgacaaagaacaacaacaaaataaaaattcaaatgatgataaataa

SEQ ID NO: 1265 - DNA, 141 bp, S.epidermidis
aaactcaaaatacttgaagtagaatggaatcgaaggaataagaaagcgcttacaaatgtaaaatttcttattcctcatgcaaatgaaattgggatggcacaacgtactattggtgaaaggaggcatttattatatgagtaa

SEQ ID NO: 1266 - DNA, 1209 bp, S.epidermidis
ggtgaaaaaatgtttaagaaattcgaatataaaatcttatataaaagaatattttttacatgcttaattttagttatatatattataggaagtaatatttcaatcgtaagtaatgaaaatttaagaactcataaagactccttttttaagttagctattactaatgtaggtggggatttacatacattaaatatattttcactaggacttgggccgtggttaagttcgatgattattttgacactaataaaccacaaaagtaatgataaggttaaaacacaaactcgtagggaacgacatttcaaagagcgagcgttaacacttatcattagtgctgctcaaggattttacattattcattcatatattaataaacatgcgattaaagatagtaatatgctcattttattattagtcttaattacaggaacgttgttaatggtgtggttagcagatcaaaatacaacgtatggcatttcgggacctatgccaattgttttaatgagtcttgttaaatctatatttaatacaccttttcctaaattaaattcaagcgcatctttaattactatgattattgtcttattagtgctggacttatttatactcttctttattgagttaacagaatatcggatagaatataatgatattatgaatatttctgctaaagatataccatcatatttatcatggaaacttaatccagctggtagtatctctatcatggtgagtttgtcattatttatgttaacgaataatatcgttaatttcataggacgctttatcgtgaatcataattttgaaacacatgtctttaattttacaaatccagttggaattactatatatcttctgttacaaatgattttgggttactttttatcaagattattaattaatacgaaacgtaaatcaaaggaatttcttaaaaatgggaattacttcgagggtatacaacctggacagcagacagaaaaatttctagggagtaaagcacgtcgtatttgttggttcggttcaatagtagtagcgattgtactcgctataccaatgtattcagcgctgcttgtcccccacttacttaaagaagtttactttacaactcaaatgattgtatttgtctatattggaattaatatcgctgaaacaattagagcgtacttatactttgacagctataagcaaattttaaataaatattggtag

SEQ ID NO: 1267 - DNA, 1116 bp, S.epidermidis
attgttgaaatcgctttctttagggtgtacgataactatggcctaaaaataaagaaagaaggttttggggaaatggatattattttaggagtagggactttagtactcgttcttattatcatgacgcttttcttaaattttgcgccatatggtaaacaaggtttacaagctttatcaggggctgcttgtgccacgtttttaccacaggcgttcttaagttacgcaattggtggcgtattccatgttaaatttttccaagaaattggtgatctagcagggagtttaagtggtatagctgttggtatattaacttgtctaaagttagaagtgtctccagtatttgcagtcattgtaggtttagtattacatgactcaaaattattacctgcgtttatcgcagcgtatgttgttgcatttggaatcaagtttgttgagaaaaaagttccagagggactagatttaattgttgttattttattggctccagcagttacatttggtcttgcaaacttaatttctccaggggttattgcagtacttaaacaaattggtagtgcaatcacttcagtaggtgataacaacccatatgcattagcagtcattttaggacttgttattcctgtaactggtatgacgccattaagctcaatggtgcttacaagcttattaggtttaactggtattccaatggcaattggtgcattaacatgtacaggagcatcttttgttaatggaatcttatttagcaaattaaaaattggtaataaaggtaatgccttcgcggtatttgtagaaccgttaactcaaattgacttaattgccaaatatccactacaactgtttggtgcgaatgccattattggtgttgtaaatgcttgtattgtcacatacagtggactaattattgatattaaaggtatggcaacacctatagcaggtgctattgtactttatggctttaacgacgctgtaagatctacaattacaattatcgcagtagcaattgcaagtgtgatattagcgtacgttattagtgctattattaataaatttaacttgatgaatgtcggattcaagttaccacgtagaaaaaaccaagttaaggagagtgtttaa

SEQ ID NO: 1268 - DNA, 537 bp, S.epidermidis
gttgggggaattgaagtgaaaatagttatagcggatgaccatgcagttgttaggacaggattttcaatgatattaaattatcaagaagatatggaagttgttgcaactgcagctgacggggttgaagcttatcaaaaagtgttagaacatcgaccagatgttttaattttagatttgagcatgccgccaggagagtcaggcttaatcgcaaccagtaaaatttctgaaagttttcctgatactaaaattttaatacttacgatgtttgatgacgaagaatatttatttcatgtgttaaaaagtggtgctaaaggatacattttaaaaaattcacctgatgagcaattaatattggccgtacgtacagtatatcaaggtgaaacttatgttgatatgaaattgacgacgtctttagtcaatgagtttgtcaatcaatcacaaacggatgaagtgtcatcatcttcagatccatttaaaattttatcgaaacgagagttagaaatattacctcttatagcaaaagtgctatggcaataa

SEQ ID NO: 1269 - DNA, 459 bp, S.epidermidis
aataaaatgataggttcagaattatatttctccttattcgtaggtgtcgtactcagtttgatatttgctgagaaatttgggattaatccagcagggttagtcgttccaggttatttagctttgatttttgatcaaccgatcatgttgttatcagtattaatcattagttgcttaacttattttatcgtaagcaacggtattagtaagtgggttattttatatggtagaagaaaattcgctgccatgatactgacgggaatggtgattaaatttatatttgatctcttgtacccattgaccccatttgaaatggttgaagtttcaggtataggtgttgtcattcctggtattattgcgaatacaattcaaaaacaaggtgtagtcattacactttctacaacaatgttattaacatgtattacatatatcatcttatttttatatagttttattaattaa

SEQ ID NO: 1270 - DNA, 1878 bp, S.epidermidis
ttaatcgtgattgatagacaaatcaaactcatcaaattgttattaaattatacagatacgtatataagtggccatgatattgccaaacagttaaatgtatctaatagaactatacgtaatgatattaaaactatacatactacatttctaaatgaattaattttaagtgtacaatctaaaggttatatgctaaatacatgtctttatacacctgatgagatacaatctgctttagagtcagttattgtaaaagagaataaattgcttatcacaattgcttataggttatttatggaaaagcatacattcactatcaaagagctatcttcaacttaccatttaacaaaatcaaaagtgattgattatgtaacacgtatacaaacgtgggctataaaatttgatatttatttatcaataaaaaagaagcaaggtatcatgatcgatgcgagtacaacgagtatcagtaatgctgtacttcatatcaatcaacttacagacgatgactttaaagttgaaaaccttattttacaagagttacctcaagcccatactagaaaaataaaacaaattatctcaaagcatatagataatcatcaattatcaacttctgaaaataaaatacaacaattacttgtgcatctaattttaattatcaaacattctcaaccagaggaagaagattggagcactgatacagaatctttaactattgcgaaaaagtgtataaaagatatcaatgaaacccttggatatcaacttaacaataaaacaagtgaatgcttttccttttttattagctaccatttcaataagtttgatttagggatccaacaactatttattcaaagttatatcgatcgactcattgaattaatggagcaacatattggttttcccttttcacaagatacaattttaaaagataatatgaacgtccactttagtcgtacatatttgcgattaatgagtcatgtttatctaaataatccattaacaagtcaaatcaaacgactatatccctttgtctttaatacactatatgatagtattcgacaattatcacaagataccaatatccaattaagcgaagatgagattgcctttttaactatacattttcagtcttctatcgaacgccataagtcatcacatattcatgttgtaattgcttgttattatggcttaggcatttcaacgttgcttgctgagaaaatcaaacaacttaatcatgcaatacagatcgtagatacattaaaacttgaagatattaacaactatcattttgaagggattgacttattaattactactcacgactttgatacaagtcaacttttacaaatacctaaagtcatacaagtatcacctttattttcagatgaagatgctaaaaaaatcgaattctttgtaaaagacatgcaaaacccattatcaaaagatgatatattatcaaaaattcagttgagtgttgagtccaatttcaaaatgaatcattcaaatcacattcttccaatttttgagaaatccaaagaaattttagattatcatcatgcaactctagatggctatatagaaagtgccatagatcgcgaaaaacaatcttcaacatatataggtaaagggatagcactcccacacggcaaccctgaaaaagtactgaaatcacacatgattatatttaaaccttctcaacctataacatggaaacaacatgaagttaaacttgttttctttttagcaatgagtaaaaaagatttaaatattaaccgtaaaattatacaaacaattgctcaattagaagaagatgacatccatcaattatgtcttttagatgatttacaactaaaaaacactttgtatgcacgttttaaagaataa

SEQ ID NO: 1271 - DNA, 222 bp, S.epidermidis
aaaggagtgataattatgacacaaaaaatcataaaagttgaaggaatgagttgcgaacattgtagaaacgccgtagaatcggcactagctaaactaaatggcgtatcaagtgctgaagtaaatttagatgaaaatcatgtacgcgttgagtataatgattcaaaagttacatttgaaaatatgaaagaagcaattgaagaacaaggttatgatgttaaataa

SEQ ID NO: 1272 - DNA, 366 bp, S.epidermidis
attgaggtgattaattgtatggaaaattttgataaaagttatcatgataaaacgggtgatgtattaggggctttaagttatctaagtgtatttttcgcacctgtattgtttccattaatcgtatggattgttggacaaccaccagcatctacgtattcaagaaatgcattatttaaccatattttgagttgggtgtgtttggtattaggacttatatcatttgctgctggactatccttgattgattcgacaaatggagtcgctgtactagtgataggagtaattattggaggtattctacttatcgcttcgcttgtattatttattattaatattgtgaagggtatcaaattattgatgatatag

SEQ ID NO: 1273 - DNA, 579 bp, S.epidermidis
atgattgcgattattgattatggattgggaaacataagtaacgtcactcgagcaattcaacatttaggatatgatgtgattttgacatgtgatgataaagacgtgcaaaaagctgaagctatcgtacttccaggtgttggacattttcaggatgcgatgcattctatagaagaaaaaagcattaaagatatgcttaaaaatatacatgataaaccgataattggaatatgtttaggtatgcaattactttttcaacatagcgcagaaggtgacgttagtggattggaacttgtcccgggaaatatagtgccaatccaatcatctcatcctattcctcatttgggttggaatgaattaaagagtacacatcccttactgcaaagtgatgtgtattttgttcattcatatcaagcagaaatgtcagaatatgtagtagcttatgctgactatggtacaaagattccgggagtcattcaataccgaaattatataggtatccagtttcatcctgaaaaaagtggaacgtatggattagagattctaaatcaagcgcttaaaggagggtttattaatgattga

SEQ ID NO: 1274 - DNA, 504 bp, S.epidermidis
ggaattgagatgattagatttgcgcgactagaagatcttcaaggtattttgacaatttataatgatgccatccttaatacaacagctgtttatacgtataagccacaacaattagatgaacgtcttcaatggtatcaatctaaagcaaaaataaacgaacctatatgggtttatgaaaaagaagggaaagtagttggttttgccacttatggttcctttagacaatggccggcctatttatatactattgaacattctatatatgttcatcaacagtacagaggactaggtatcgcttctcaattattagagaatttaattcgttacgctaaagaacaaggttatcgcactattgttgctgggattgatgcatcgaacatggatagtatcgcattgcataagaagtttgacttctcacatgcaggtacaattaaaaatgtaggttataaatttgatcgatggctcgatttatcattttatcaatatgatttatctgattcataa

SEQ ID NO: 1275 - DNA, 405 bp, S.epidermidis
ttattggagatgactatattgattagaacatttatgaactcaaaaatccatagagctagagttacagaatctaatttaaattacgttggaagcataacaatagatgccaatatattagatgcggttgatattttacccaatgaaaaggttgctattgttaataataataatggtgctcgatttgaaacatatgtcattgctggagaacgtggtagtggaaagatgtgtttaaatggcgcggcttcaagactagttgaagttggagacgtcattattattatgacatatgcacaattaaatgaagatgaaatggtagatcactcaccaaaagtagctgtgttaaatgaaaataatgaaattatagaaatgataaatgagaaagaaaatacgatatcaaatgtataa

SEQ ID NO: 1276 - DNA, 1593 bp, S.epidermidis
atgaattggatatcgattattttatttattatggtcgtaggtggcatttctttttatgcttatttgcaatcaagaaaaattaaaacgagtagttcagatggttattttatgggaggaaatagccttactggatttacagttgcctctacaattatcatgaccaatttgtcgacagaacaaattgttgggcaaaatggtcaaagctatgcacaaggaatggaagtaatggcttgggaggttacggctgccgtagcagttgtattgttggcttgggtctttcttcctaaatatctaaaatacggtgttaatacaatttctgagtttttggaattacgttatgatacatttactaaacgttttgtctccattttatttatctttacctatgtcgtatctttcttgcctgtagtattgtactctggttccctagtgttcaataaaatgtttaaagttgatgaatatttaggtgtaagtagttcaactgctgtcatcattatttcatctattattggtataattggcattatttacttatttataggtggtttatcgttaagtgcttttagtgattcaatttatggcatggctttaatcataggtggacttgcgattacaatattaggtctaggtcaattaggagatggcaacttcctacatggcttcgacaaaatcgtgcaagacacacctgagaaattgaatggttttggtaaggtggactcggatgttgtaccttggccaaccctattcttcggtatgttctttaacaatttattcttctggtgcgcaaaccagatgatagttcaaaaagcactcgcagctaaaaatttaaaagaatctcaaaaaggtgcaatatatttaagcttatttaaagttttcggaccattaattacagtcttaccaggtgtagtagcatttaactattttaatggtagtattgacaaatcagataacgcttaccctgcacttgtaacttcagtattaccagaatgggcatttggcttatttggtgcggttatttttggtgcaatattgagctcatttgttggctcattgaatagtacaactacactattgacactcgatttctataaacctatttttggaaaaaataaatcagataaacatattgctcgagtaggccatattgctactgtagtcattggagttattgttgtagcacttgcaccagtcatctcattattccctagtggtctttatgcagtagttcaacagtttaatggtgtgtatagtatgccagtgctagctttgattttagtggctttcttttctaaacgcacatctaaattgggcgctaaagtgacactcttcacacatataattttatacgctatcatcagctttgtatttacagaaattaattacctatacacatttagtgtattattctttgtagatttaattattattttgatctttaacaaagttaaaccatctagtgagtttgatttaagcacgcaccaaccgaaagtagatatgacgccatggaaatatcgttacgttgcaggtattattgttcttgcattagtagtagtaagttatattatcttctcaccactcgtgttagcaaaataa

SEQ ID NO: 1277 - DNA, 1602 bp, S.epidermidis
gacatagtttttaatttatatatcataaaactatgtctcttccccgtacttgaggaggttaattcaatgtcccaaattgctttctatatccttagtgatgtccacggttttatattcccaacagatttttcatcaagagaaaaagatttacctatgggtttgttaaaagctaatcatctaatcgaacaagactgcgtgcactatgacggcagtgtaaagattgataatggagacttcttacaaggttctccattatgtaactacttagtatccaaattaaagagtagtctcccattaacatcaatatataatcgtttagggtttgattttggaactgttggcaatcatgaatttaattatgatttaccttatctaaagcaggccatcaatcaacttcattaccctgttttgtgtgcaaatataattgaaaatacacaaccattcactggccaaggtattcattattttaaagtaaatggtttaactataggaactattggattaaccactcagtatatccctcactgggaacaacctgattacattaaaacactcaattttaacagtgctatccacacattaaaatctgagttacctacacttagggaaaagagtgatattgtagtagtaagttatcatggtggttttgaacgtgatttagatagtggcctcccgactgaggcgcttactggggaaaacgaagggtatgatattctaagacagtttagcgatagtatcgatgtgttgataaccggccatcaacatcgtgatattgcgacaatcaagaaccaaacagccatcattcaaccaggttcaaaaggtacaaaagttggaaaaatagttattgaatatacacatgataaaaaagtattaattaaagaatgtaacttaatgaatgttcataacagtacctcctttaagccgaatgacgaagatatcgctttacgtaatcaattggaagattggcttgatactcaaatcgcagaactcccctacgctatgagaataaacaattcatttgaggcaagaaaatcaccgcatgcatttgttaaccttcttaattatattttattagaaaaaagtggtgcagatattgcatgtacagcactatttgattccgcaaatggctttgatgagaaagtaaccatgcgcgatatcatcaataattatccttttcctaatacttttaaagtgatagaacttagtggaaaagatattaaacttgcaattgaacgaagcgcaagttattttgacattgttaatcataaaatcacagttaataaagagtttctagaacctaaacctcagcatttcaactatgacatatttgcaggtatccaatatacaattcatgttagtcatccttacggtgaacgtgttagtgatttactaattaatgatgcaccactacaaagtgatcaaatatatacaatatgcgtaaataattatagagctgttggtggcgggaattatgatatgtacgttaacaaacctgtgataaaagatattcaaatcgaaggtgctcaattgttaatagattacttgtctcacaatgatttatctcaaatcccacaagtgattgatttcaatgttgttaagtaa

SEQ ID NO: 1278 - DNA, 1509 bp, S.epidermidis
aaggtggggattaaaacaatgatatatacagtaacaagcacattacccttagtgcacggaggaagaactaaatcattattaacaagaattcgatttcttgataaagaaatgggcattcacaataaaatattaacaacgaattataacgccaattataacgaagtttatcaaaagttcgaagagaatcaactcataacgaaaaatacgcaaatcgaaaacatatatgattggttatctgatttcaaattactttcaatacctaaaagtagatttaagaaaaaaacgctttactctgaaaaagatagagacatagaaggtttaacttctaaagcattcaatgatggcaatgtgatgagatattatgatcaagaaacttatgttttatatcggaaattttatgaagatacaaatatcatagaatttgaagacgtgatgtcaccaatttctaagaaaaaaattgaacgtagagaatataatcacttcggtcaattgcatagaaagatttacttctcaagccgtacatatcacaaaattttggaagaatattttgacactgagggaagtatttactgtaaaaaattcttcaattcacaaaaggcaaatgaattagattttattcaaatttttaaaaatcaacgtatcatgaaggcttttaaaaacgaaaaagatctctttaaatattatttcgaacatcgctttaaacaaaatgatattgtgtttaatgatgctagacttttagataaaccacttttaaataactgtatgaacacaaaaaatgtgcttgtatttcataatagccacatcgatggcgataatattaaatcttcatacaaaattgcattggaaaattctgataaagtagctcaatacctcttgctcacacatatgcaaaaagacgatatacaacatgcatatggtattagcgatgaaaaaatatcgattgtacctcactttattaaaagctatggacaaaaagatactcatcacaaagaggatagattcgtatttattggtagactaggcaaacaaaaacaagtggaccatttaatcaaatcttataatcaattcttaaaaaatggacatcaaacgaaattagcgatttatggtgcagatgaacaaaatcaaaaacaagtcatactagatttagttaaagaatatcaaattgaagataaagttgatttaaatgattttaccaagcatcctcttgaagaatttaaaaaatctaaagcctcactattaactagtgaatacgaaggttttggtttaaccgttatggaaagtattgaagtaggttgcccagtcatttcttatgacgtaagatacggtcccggtgaaatcatagagcacggtgaaaatggctatcttgttgagccagataacattgaagcattcgcagcttatatggataaaataattaaaaatccactcaaacatgttaaaacaaaagaaacattaaagtatgaacaagcaaagaataactatcaaaagttgtttgagagagtaaagtaa

SEQ ID NO: 1279 - DNA, 138 bp, S.epidermidis
acggcagtttttgtatcaacaattccaaccaaaatcatgattgtaaaaccaatgattgatactgcacctatagtcataggttgggtaatacaagcaatgatggttgacacaaaaatagcaaacataaaccaagcttga

SEQ ID NO: 1280 - DNA, 792 bp, S.epidermidis
ggagtggttttgttgagtaactcaaaaaaagtagccgttgtcacaggtgcagcacaaggtattggcttgaaaattgctgagcgtctatttgaagatggatatagcatcgcgcttgtagactttaatgaagcggtagctaaagagtcagctgaaaaattatcaaaagaagggcaagaggcagttgcttttaaagcagacgtttcaaatcgcgatcaagtatttagtgtgttaaatcaagtcgttgaacactttggcgatttaaatgtcctagttaataatgctggtcttggaccaatgacaccaattgaatcagtaacacctgaacaatttaatcaagttgtaggtgttaacgtaggtggtgtattctggggtatccaagctgcaattgaacaatttgataaattaggacatggcggtaaaattatcaatgccacatctcaagcaggtgttgaaggtaatgcaggcttatctctatacagcagtactaagtttgctgttagaggattgactcaagtagcagcacgtgatttagctgagaaaaatattacagtcaatgcatttgcacctggtattgttgaaacaccaatgatgaaaggtatcgctgaaaaacttgctgaagaaaacaaccaaccaatggaatggggttggaaacaatttacagatcaaattgccttaaaacgcttatctaaacctgaagatgtagctaatgtagtaagcttcttagcaggtagcgattcagattatattactggccaaacaatcatcgttgacggtggtatgagattccactaa

SEQ ID NO: 1281 - DNA, 177 bp, S.epidermidis
aactttaactttatcaatgtaattacaacttcaatcctacaatgtatctcgtgtatttatattaataccattacaatacttatatacaattcattattaaagtcatctcttatatttaattattataacaagcataatggttcagtcatgacatcatgcttagacgttaaacgataa

SEQ ID NO: 1282 - DNA, 126 bp, S.epidermidis
aatgaatttgtgattggtactttgtttataattttgttttatattattaattttgacctcttattaagctctcacaaagtaccaatacaccttataattaaatcagatgaaggtgaattaaaatga

SEQ ID NO: 1283 - DNA, 132 bp, S.epidermidis
ttggttattgtttcattgttagacattataatcaaatctccttttccaattaattatatttgtttactcggcttttcttataagaaaaagacaatttcttgtttcgaacgacttgaaaaacaagcaaaataa

SEQ ID NO: 1284 - DNA, 138 bp, S.epidermidis
ataactgttgtcaactatatttttaatctaaaaaaatatgtaatacaaatccttttgaaatctcgaatttgttacatactagttacaaaaattatttttttaaaaatacatttaacagtgaatatacttggtctttaa

SEQ ID NO: 1285 - DNA, 183 bp, S.epidermidis
gtcttggttgttgtgcgcgttttatttactgtggtagatttttttgctattgtagtttttttagttgatgacgttttgggtgatatagcttgtttggttgatgtagctctttttattgatgtagctctagatttaacagacgtatctttaactgaacgtttaaaattggacgtcgtcttttga

SEQ ID NO: 1286 - DNA, 3780 bp, S.epidermidis
tataatgactttgtgaaaaaatgtacaataaagataagacacaatacctatgcattgagaaaggatataaccttgtatggtgggaggattaataaaatgggaaaatttggattgaatttctttaaaccgacagaaaagtttaatggaaattggtcggtattagagcataaaagtcgagaatgggaaaagatgtatagagaaagatggagccacgacaaagttgtaagaacgacgcatggtgttaactgtactggatcatgttcatggaaagtatttgtcaaaaatggcgtaattacatgggaaaatcaacaaattgattatccaagttgtggacctgatatgccagaatttgagccaagaggttgtccgagaggtgcatcattttcttggtatgagtatagtccgttaagagttaaatatccttatattagaggtaaattattagatttatggaccgaagcgcttgaagaacaaaatggaaaccgaattgcggcatgggcatccatcgtagaaaatgaagaaaaagccaaacaatataaagaagcaagaggtaaaggtggacacgtcagagcaaattggaaagatgtcacagatatcattgcagctcaaattttatacaccataaaaaaagatggaccggatcgtattgctggatttactcctattcctgctatgtcgatgattagttatgcttcaggagcaagatttattaatttgttaggtggagaaatgttaagtttttacgattggtatgctgatttaccacctgcatctccacaaatttggggtgagcaaacagacgtgccagaatccagtgattggtacaacgcctcatacataatgatgtggggatcaaacgttccattaacacgtacacctgacgcacattttatgactgaagttagatataaaggggcgaaagttatttcagtagcacctgattatgctgagaatgttaagttcgccgatcattggcttgcaccacatccagggacagatgcagcggtagcacaagcaatgacacatgttattttacaggaatattatgaaaatcaaccgaatgatatgtttattaactatgctaagcaatattctgatatgccgtttgttattatgttagatgaagatgagaatggctataaagcaggtagattcttgcgtgcttctgatttagggatgtcaggtgaaaataatgaatggaagccagttattcaagacaaattgagccaacaattacttgttcctaatggcacaatggggcaacgctgggaagaagggaaaaaatggaatttgaaacttgaaacagaggatggtacaccaattgatccaatgttatcaatggttgaaagtgactatcatgttgaaacgattcaatttccatattttgatagcagtggtgatggtatctttgagagacctattgcaacgagaactattcaattagctaacggagaagaagttaaaattgctacggtttatgatttaatgacgagtcaatatggtgttcaacgttttgaacatgaactagaagctacatcttatgatgacgcatcttctaaatatactcccgcttggcaagaacaaattacaggtatcaaaaaagaattagtgacgaaagtggcaaaagaatttgcacaaaatgctattgatactggtggacgctcaatgattattatgggggctggtatcaaccattggtttaactccgatactatttatcgttcaattcttaacttagtactattgtgtggttgtcaaggcgttaacggtggtggttgggcacactatgttggacaagaaaaatgtcgaccaattgaaggatggaatactattgcatttgctaaagattggcaaggtcctccacgtttacaaaatggtacaagttggttctatttcgctacagatcaatggaagtatgaagaatcaaatgtagataaattaaaatcaccattagctgaaaatattaagcatcaacatccagctgattacaatgtaacagctgctcgtatggggtggttgccttcatatccacagtttaataaaaacagtctattatttggtgaagaagctaaagatgaaggtgatgattcaaatgaagccatcttacaaaaagcgattgaatcagttaaaaataaagatacacaatttgcgatagaagatccagatttaagaaaaaaccatcctaaaacattatttgtatggagatctaatttaatttctagttcagctaaaggacaagaatactttatgaagcacttgttaggtgcgcgctctggtttaatggcagagccaaatgaagatgataaaccagaggaaattaaatggcgcgaggatacagaagggaaacttgatttattagtatcacttgatttcagaatgactgcgacgccattatattcagatatcgttttacctgctgcaacttggtatgaaaaacatgatttatcttctacagacatgcatccatttattcatccatttaacccagcgatcgacccattatgggaatcgcgttcggactgggatatttataaaactctaagtaaagctgtttcagaaatggccaaagattatcttccaggtaaatttaaagatgtcgtaactacaccattaggacatgattcaaaacaagaaatttcaactgaatacggtattgtaaaagattggtctaaaggagaaattgaaggtgtgccaggtaaaacaatgcctaatttttctatcgtagagcgagactatacacaaatttacgataaattcgttactgttggtccaaaactagaaaaaggaaaaataggtgctcatggtgtgagttatagcgttagtgaagagtacgaagaacttaaaagtatggttggaacttggaatgatgataatactacttcagttaaaaatgatagaccgagaatagatacagcgagaaaagtagcagatgtcattttgaatatatcctctgctacaaacggcaaattatcacaaaagtcatatgaagatttagaaaatcaaacaggtatggaacttaaagatatttctaaagaacgtgcttctgaaaagatatcattcttaaacattacttctcagccaagagaagtgattccaactgcagtattccctggctctaataaagatggaagacgctactcaccgtttacaactaatgttgaacgtttagtgccatttagaacgctaacaggacgtcaaagttattatattgatcatgaggtattccaacaatttggtgaaagtttaccggtatataaacctactttacctccaatggtatttggtgctcgtgataaaaaagttaaaggtggacaagatacattagtgcttcgataccttacacctcatggaaaatggaatattcattcaacttatcaagataatgaacgcatgttgacattgtttagaggtggaccagttgtatggatttcaaatgaagacgcagctgaccatggtattaatgataacgactggttagaagtatacaacagaaacggagttgttactgccagagctgtaacatctcatcgtatgcctagaggcacaatgtttatgtatcatgcacaagataaacatatagagacacctggttctgaaattactgatactcgtggaggttctcataatgcacctactcgtattcacctgaaacctactcaattagtaggaggatatgcacaaattagttatcactttaactattatggaccaattggaaatcaaagagatgagtatgtagctgttagaaaaatgaaggaggtcaattggcttgaagattaa

SEQ ID NO: 1287 - DNA, 504 bp, S.epidermidis
ttaccgcctgtgccttttatcttgttaatgtctaatcctttatcctcagccatattacgtgcgaggggtgagataaagattctttctcgtgctgcgcttttaggcgaattatctttattatcggaagacggttgtgatgtatctttaacttcttgcgtttccttctcatgctcgttgtcttcttttactttttctgatgctaaatcatcttcatctttatcaatagcttccccttcttctccaattatacctaataccgctttaacctctgcatcttctccggcttgcactttaatttctaacaatgtcccactcgccggcgcttcaacatcgttggttaatttttcagagcttattgtaacaatactctctccttgttttacggtgtcaccctctgatttaaaccactcttcaacagttccctctttcattgtcattccaagctttggcataataatattttcactcattgtgatacacctcctatgcgttagccttttttaa

SEQ ID NO: 1288 - DNA, 135 bp, S.epidermidis
cactacgctgtacctcatttcactactttttcacgtaaaagtaatagtcacattatcttatttctcatgtacaaatcacataatattcataatttcattttgattacaaaacacttaccaatgttttacgaatga

SEQ ID NO: 1289 - DNA, 705 bp, S.epidermidis
atgactaatgtattatatcaacacggaacattaggaactttaatggcaggtttattagaaggaactgcttcaattaatgacttattagaacatggtgatttaggtattgctacgcttacaggttctgatggagaagtaatttttgttgatggtaaagcttatcatgcaaatgaacataaagaatttatagaattgacaggcgacgaaatgacaccatatgcaactgttacaaaattcaaagcagactcaagttttaaaacatctaataaaaatcaagaagaagtattcgatgaagttaaaaaacaaatgaaaagtgaaaatatgttctcggcagttaaaatttcaggaacgtttaaaaaaatgcatgtacgtatgatgcctggtcaagaacctccatacacacgtttaattgattcagctcgtagacaacctgaagaaacacgtgaaaatatcaaaggttcaatcgtaggtttcttcactccagaattattccatggtattggttctgcaggtttccatattcactttgcaaatgatgatcgtgattttggtggtcatattttagactttgaagtggatgatgtgactgttgaaatacaaaactttgaaacatttgaacaacacttcccagtagatgctaaatcatttactgatgctgacattgactataaagatatagccgatgaaatcagagaagctgaataa

SEQ ID NO: 1290 - DNA, 1773 bp, S.epidermidis
gaaagagatgttaacaaacaaagaaaacaaatcaatttttggaggtctttaacgatgagaagaaaacgcgattcatacgattatgtcatcattggtggcggtagtgcaggttcagttcttggtgcacgcctttcagaggataaagataaaaatgttttggtattagaagctggacgtagtgactatttctgggatttatttattcaaatgccagcagcattgatgttcccatcaggtaatcgtttttatgactgggaatatcaaactgacgaagaaccacatatgggacgtagagtagatcatgcgagaggtaaagtattaggtggctcaagttctattaacggtatgatttatcaacgaggtaacccaatggactatgaaggatgggcagaacctgaaggaatggacacatgggactttgcacattgtctaccatacttcaaaaagttagaaacaacatatggtgcagcgccatacgataaagttagaggccatgatggtccaatcaaattaaaacgtggaccagctactaatccattatttaaatcattctttaatgcaggtgttgaagcgggctatcataaaactgcagacgttaatggatacagacaagaaggttttggaccatttgatagccaagtacatcatggacgtcgtatgtctgcttcaagagcgtatctacgcccagcattaagacgtagaaacttagatgttgaaacacgtgcattcgttacaaaattaatttttgatgaaaataatagtaaaaaagtaacaggcgtgactttcaagaaaaatggtaaagaacatactgttcatgcaaacgaagttattttatctggcggtgctttcaatacaccacaactattacaattatcaggtattggtgactcagaattcttaaaatcaaaaggtatagagccacgtatgcatttaccaggtgttggtgagaacttcgaagatcacttagaagtatatattcaacataaatgtaaacaaccggtttcactacaacctagccttgatgtcaaacgtatgccgttcatcggtttacaatggatttttgcacgtaaaggtgcagcggcgtctaaccactttgaaggtggtggctttgtaagatcaaatgatgatgttgattatccaaacctcatgttccatttcttaccaattgctgtaagatatgatggtcaaaaagcaccagtagcacatggttaccaagtacatgttggaccaatgtactccaactcaagaggtagtttgaaaatcaaatctaaggatccatttgaaaaaccaagtatcgtgtttaattacttatctacgaaagaagacgaaagagaatgggttgaagcaattagagtagcaagaaatatcctaaaacaaaaagctatggacccatttaatggtggcgaaatttcaccaggaccacaagttcaaacggatgaagaaattctagattgggtacgtaaagatggagaaactgcattacatccatcttgtagcgcgaaaatgggacctgcatctgacccaatggcagtagtcgatccattaactatgaaagtacatggtatggaaaatttacgtgtcgttgatgcttcagcaatgcctagaacaacaaatggtaatattcatgcacctgtattgatgttagctgagaaagcagcggacattattcgtggtagaaaaccgcttgaacctcaatatgttgactattataaacatggtattgatgatgaaaaagcaggtgcaatggaagatgatccattctaccaatattaa

SEQ ID NO: 1291 - DNA, 138 bp, S.epidermidis
gaagcatgtgtcaatatcgtctcattcttactatgtgcgatttctcgtgttgttattgaaattatcgataaaatagtcatcaaaaaaatgacaacaatgacaaacagttttatcttcattgagcatcctctactttaa

SEQ ID NO: 1292 - DNA, 132 bp, S.epidermidis
agcaaatgtgttaactcacttttcaatcataaagaattcaaaataaatctctcagttcattcaattacaatcaaaataagaaaagaacctgtacctatgattgatgtatcaggttccatattatcaacttga

SEQ ID NO: 1293 - DNA, 462 bp, S.epidermidis
ggtgaaagtgtggaaccagaatctttaaaacataatcaacatttacaaatgaatttagataagttgagagcacaagagggttatgattttggtggtatcgctttatatgattatcatcacacttcatcaccaattaaatggcaatatgtttcaggtaacacaaatgatagatataaacttatcattttgagaaagggtagagggcttgctggaatggtgatgaaaaccggtaagcgtatggttattgctgatgtagatacagctttatctccagaagagaaagttaaatttccaatcattcttagtgagtcattgacagctgtagttgcagtccctttatggttagaaaattcaatgtatggcgttttattattaggtcaaagaaatcatcagccgttacctcagtcattggaccaacttaatattgaaaaacaaatcggtatttttacagaaataaactag

SEQ ID NO: 1294 - DNA, 246 bp, S.epidermidis
ttagagagtgtgaacaatatgattagtgtaaacaatggggtaaaaaataaaaaatataaagtgaagcatatagggatttcaaataaaaatatgttgtatcgtttaggggcattaggcttaaacattggaagtgaaattagcatcaaacagaaatgtttactcaacggtcctagcgttgttgaagtaaatggtcaacatttaagtttacgacaacgtgatgcacgactcataacattagaggagtag

SEQ ID NO: 1295 - DNA, 615 bp, S.epidermidis
atcaggagtgttaaaatgagtgaatcaaatcatattacatggcatgactcagaagttacgaagaaacaaagacagcataaaaatggacacaaaagtgctgttatatggtttacagggctatctgggtcagggaaatcaacggtctctgttgccttagaaaaagaattatttaatgaaggaaaacaaacataccgtttagatggtgataatgtgcgtcatggtcttaataaaaatttagggtttagtcctgaagatcgttcagaaaatattcgacgcattggagaagtagcaaaattaatggtagacgctggagccttaacagttactgcttttatctccccatataaagaagacagagaaggtgttagagcattactagaggataatgagtttatagaagtatatacaaaatgtagtgttgaggaatgtgaaaagagagatcctaaaggattgtataaaaaagcacgatctggggaaatacctgaatttacaggtataagtgcaccttatcaagcacctgaaaaccctgaaattactatagatactgaacacgacactattgaacaatcagtggtacaaattatacgttatcttaaagaacacgaatatatttaa

SEQ ID NO: 1296 - DNA, 150 bp, S.epidermidis
aggaatttcgtctgtatatgtacatccagaaccctatactacaaaagacgaagtaaaataaaatatataagaagtcaatcattacctgaccataaggtagtggttgactttttttattttaaaccagaatcattaccgggaaattactaa

SEQ ID NO: 1297 - DNA, 219 bp, S.epidermidis
ggaaaaatcgtagatattttatttattttcggtttgctcggtggtgctgcaacatcactcgctctaggcgtgccgatgatctcagctggtattgaacgattgactggtttagatggatctaatatgattttacgttcaatcatcttactaactattacagtttattttcgcaatcagttcttacacaggtttgaaaaaaggtattcaaaaattaagtga

SEQ ID NO: 1298 - DNA, 915 bp, S.epidermidis
gaaacgaccgttgcttataaacaatttatacgttttgcacaacatcatttacattttcatcatctagggaggcattttatggttatttcaaaaaaattatcacttatcactataggtatcttaataagtattcttttaatttctctacttattgatcaaactatctcacatcaattcatgaatcagaattcaattttcggtactttatttcaaaactacggtttatttccgcctacgctcatattaattatttcaactgtaattttaaattattatattttcactacatttcaaaataaattagctaaaatattaacattgcttatatctttcatattcaccctaattaaaaccaatgaattcgtgtcagaaactgctcaatatatgctatcaacttcagcaaacataaaaaatcataaaccaatggggatggcaaataatgaaggaaacgctggaaatgctttatctttaggaatgagtttctttatttctttgattatacttataattatcacttttatttgttatcaattttggttaaaacatacaaataaccaagaactttatcatttattcaaagtttcacttattagctttatgattttatttattggattagaactcgttgatagcttgaaacatttatggggacgttttagaccatatgaaatcactgacaaagctggacatttcactcactggcttacaataaatggaaatactggacatagttccttcccttcaggacacactggaaatggtgcatttctaatgtttatcgcattttactttaaaaaattacgcactcaaaaaatagtgtttagtatcggattatgttatagcattttaatggcattgagcagaattcgtattggtgcacatttcactaatgattattgcagattttatcattaa

SEQ ID NO: 1299 - DNA, 1050 bp, S.epidermidis
atgaacaacgttaaagaatccatcattgttgccttcgcctttgtaggcgttgtagttggagcaggatttgcaacaggtcaggaaatctttcagttcttcactagtcatggtatttacagtattggcggtatttttattactggacttatcttaactcttggaggaatattcgtattaaatactggctttcgtcttagatctcaaaaccactccgaatctattcgttattatttacatccaacaatagctaaattatttgatattatacttacagtatttttattttctctagcaattattatgacagccggcggagcatcgactataaatgaaagtttcggcttacctttttggttaagttctttcattttagtgatacttattttgataacattatttctaaagttcgatcgtcttatcgctgttttaggaggggtaacaccatttcttgtggcagtcgtagtaatgattgcagtgtattactttattaccggtgatttaaactttagtgatgtcagtcaatattcaaatcaaaataagtcgatttcacctggttggtggtttgacgcaattaattatgctagcttacaaattgctgctgcatttagctttttaactgtaatgggcggtaaactacgatatcaatcgtccacaatttatggtggacttatcggtggtattattgtgactttactattacttttgattaattttggtcttgttacagaatttaatcaaattaaagaggtagcattaccatcattgctacttgctaagcagatttctccatccattggtattatcatgtctgtcattatggttttagtcatatacaatacagtagtaggtttaatgtacgcctttgcatcacgctttagtcgaccgtttacgaaacgctattatattcttatagttatgatggcgataataacatttgcttgtacttttgtgggattcatttctctcattggtaaagtgttccctatcatgggactttttggttttatcttattgattcctgtgatatacaaaggaattttacgaaaataa

SEQ ID NO: 1300 - DNA, 732 bp, S.epidermidis
atcaagcgcttaaaggagggtttattaatgattgatttatggccagctattgatttaattaattcaacaagtgttcgattaacagaaggcaaatatgattcaaaagaaaaaatggaaaaatctgtagaagacagtatccgattttatagtcaatttaaatgtgtgaaacgtatacatattgtagatttaattggggctaaagcaaaagaggtaaaagaattcgactacatccgttccttaagaaagttgaccactaagcctatagaagtgggtggcggcattcgttcaaaacaaacaattgaaaattatattcattcaggaatagactattgtattgtaggtacaaaaggtatccaagatatagagtggttaacacatatgacacatcaatttccaaataaactctacttatctgtagatgcttttggagagaaaataaagattaatggatggaaagaggatgctaaactcaatttatttgattatgttgccaaaattgagcatttacctttgggtggtgtgatttataccgatatttcgaaagatgggaaactttctggacctaattttgatttgacaggtcgtctcgcactttatacatcgttacctgtgattgcttcaggaggtattagacatcaagaagacttgtttcgattagaatcgttaaatgttcatgctgctattgtaggaaaagcagcacatctggatgaattctgggagggattatcttga

SEQ ID NO: 1301 - DNA, 138 bp, S.epidermidis
aatgtaagcgtttgcaaatatataagcttacatagtaaaataatacaaaggttatggcgaagaaaaatctttaaaataaaagaagatgacaagtcatacctttatgcacaaaggatggtagaaatgataaattcatag

SEQ ID NO: 1302 - DNA, 147 bp, S.epidermidis
agcagtttagtattatgctcaaaatgtaataagaattattacatcacattaaagactgatattcatattttacagtcaaatttatatttaaggggtttttattatgaaagcagcagtatggtatggacaaaaggatgtacgcgttga

SEQ ID NO: 1303 - DNA, 147 bp, S.epidermidis
tttgtactagtacgtgcttcactagtcgctaatgaatcggttgcttttgtttcgattgactgggttaaattggagctaatgttcttttctgaggatgacgtgtttgattgtgttgacttagaggttacattcgaagacttattttga

SEQ ID NO: 1304 - DNA, 207 bp, S.epidermidis
actgtaatagttagtaagatgattgaacgtaaaatcatattagatccatctaaaccagtcaatcgttcaataccagctgagatcatcggcacgcctagagcgagtgatgttgcagcaccaccgagcaaaccgaaaataaataaaatatctacgatttttcctcataatttatccgtatgtccttttaaaattggtcgacaagcttga

SEQ ID NO: 1305 - DNA, 144 bp, S.epidermidis
atgaagccagttaacgataatggaattcgcttagcacctgctgagaacagaatcaatggtattgctgtaattgcacctgaaaatagtagccaaaatgatgatatatttaatccaaatgttatgtgttgttgctgccataggtaa

SEQ ID NO: 1306 - DNA, 141 bp, S.epidermidis
tttgtagcagtagattctgttgatgcaaatgttgagggaatcacagtcacagaaagaacagatgtaactagtatagaacttaaagttttaaatattttcatctctatgattactccttatataaaagatggaattttttaa

SEQ ID NO: 1307 - DNA, 132 bp, S.epidermidis
tataataaagtaaaagctcaacgagctgaaaatcatcaaaaaaaatataaaaaagacaatttctacattatttcaatagaaattgtctttatttacttatcctggaactttctgtcccagccactcttttaa

SEQ ID NO: 1308 - DNA, 948 bp, S.epidermidis
aaagataaagtaggtgaagttgaaatgaataaaaataaagtgattgtaattggatcaacaaatgtagataaatttcttaatgttaaaaggtttccaaaacccggtgagacattacatattaatcaagctcaaaaggagtttggtgggggcaagggagccaatcaagccatagcagctagtagattagcagcagatacaacatttatcagtaaagttggtaaagatggcaatgctaactttatattggaagatttcaaaaaagcaggtattcatacacaatatattttaacttcagaaagtgaagaaactgggcaagcatttatcactgttgatgaagcaggacaaaatacgattcttgtttacggtggtgcgaatatgacattaagtgcaactgatgttgagatgagtgtggatgcgtttattggtgcagactttgttgtagcgcagcttgaagttccatttgaggcgatagaacaagcatttaaaattgctcgtaaacaaaatatcactactgtattaaatcctgcaccggcaattgaattgcctaagtcacttttagagttaactgatataattattccaaacgaaacggaagcagaattattaacaggtatttcaatcaataatgaaagtgatatgaaagaaacagcaacatattttctcgatttaggtatatctgcagtattaattactttaggggagcaaggcacgtattgtgcatatcaagaacaatacaaaatgattcctgcgtgtaatgtaaaagcaatagatacgacagcagcaggagatacatttataggtgcttttttaagtgagttaaataaagatttgagcaatttagaatcggctattcgacttgcaaatcaagcgtcgtctctaacggtacaacgaaaaggagcacaagcttctataccaacacgtaaagaagtagaggcagaatataattaa

SEQ ID NO: 1309 - DNA, 3561 bp, S.epidermidis
gaagtgaaagtttcagatgtactcattgatgtggacgtgcttgatgaatctgaaatgcttgtacttgatgattcacttaccgatgtactttcacttgttgattcactctcgcttgttgacgttgatgcactttctgatgtcgatgtacttgttgaatctgaaacgcttgtacttgatgattcacttaccgatgtactttcactgtctgactcactcacactcgttgatgtggatgcactttctgatgtggatgtggacgcactgtctgatgtcgacgtactcgttgagtctgaaatgcttgtacttgttgagccacttaacgacgtacttgcgctatcggagtcgctctcgctcgttgatgttgatgcacttgctgatgtcgacgtactcgttgagtctgaaacgcttgtacttgttgagccacttaatgacgtacttgcgctattggagtcactcacgctcgttgatgttgatgcacttgctgacgttgacgcgcttgttgaatctgaaacgcttgtgcttgtcgactcacttaacgatgtactttcactgtttgagtcactctcacttgttgacgttgacgcactgtcggatgtcgatgtacttgttgaatctgaaacgcttgtgcttgtcgattcactcaatgacgtacttgcacttgttgattcactctctcttgttgacgttgatgcgctttctgatgttgacgcgcttgttgaatctgaaacgcttgtgcttgtcgagtcacttaaggacgtacttgctctgtttgagtcgcttacactcatagatgtagatgcactatctgatgttgatgtactcgttgagtctgaaatgcttgtacttgttgactcacttaaggatgtacttgcactgtccgagtcgctctcacttgttgacgttgatccactttctgatgtcgatgtgctcgttgagtctgaaagactcgtacttctcgagtcacttaatgacgtacttgtactgtttgaggcactcacactcgttgatgttgatgtacttgtcgattctgaaacgctcgtacttgtcgagtcacttaacgatgtacttgcactgtccgagtcgctctcacttgttgatgttgacgcactgtctgatgtcgacatactcgttgaatctgaaagactcgtacttgtcgattcacttaatgacgtacttgcactattcgagtcactcacactcgttgatgttgacgcactttctgacgttgacgcgcttgttgaatctgaaacgcttgtgcttactgattcacttgatgacgtacttgcactgtccgagtcgctctcacttgttgatgcagatgcactgtctgatgtcgatgtacttgttgagtctgaaacgcttgtacttgttgagccactcaatgatgtgcttgtactgtttgactcactcacactcgttgatgtggatgcactatctgatgtggatgtgcttgttgattctgaatcacttgtgcttactgattcacttgatgacgtacttgcactgtccgagtcactcacactcgttgatgttgatgcactgtctgatgtcgatgtactcgttgaatctgaaacgctcgtacttaatgattcacttatggatgtgcttgtactgtttgactcactcacactcgttgatgttgatgcactgtctgatgttgatgtacttgttgagtctgaaatgcttgtacttgttgagccactcaacgatgtacttgctctttccgagtcgctctcacttgttgatgcagatgcactatcggatgttgatgtacttgttgagtctgaaacgcttgtacttaatgagccacttaacgatgtgctggcactgtttgagtcactcacactcgttgatgttgatgcactgtctgatgtcgatgtactcgttgaatctgaaagactcgtacttgtcgagccacttaaggatgtacttgctctttccgagtcgctctcacttgttgacgttgatgcactgtctgatgtcgatgtactcgttgaatctgaaagactcgtacttgtcgagccacttaacgatgtacttgcactgtctgactcactctcactcgttgatgtggacgcactgtcggatgtcgacgcgcttgttgaatctgaaacgcttgtgcttatcgactcgcttaatgacgtactttcacttgttgagtcactctcactcgttgacgttgatgcactgtcggatgtcgacgtactcgttgaatctgaaacgctcgtacttaatgattcacttatggatgtacttgcactttccgagtcgctcacactcgttgatgttgatgcactgtcggatgtcgacgcgcttgttgaatctgaaacgcttgtgcttgtcgactcgcttaatgacgtactttcacttgttgagtcactctcactcgttgacgttgatgcactttctgacgttgacgtacttgttgagtccgaaagacttgtgcttgtcgattcacttaatgacgtacttgtactgtctgactcactctcactcgttgacgttgatgcactgtcggatgtcgacgtactcgttgaatctgaaatgcttgtacttaatgatccacttaacgatgtgctggcactgtttgactcactctcactcgttgatgtggatgcactttctgacgttgacgcgcttgttgaatctgaaacgcttgtgcttaatgattcactcaacgatgtactttcacttgttgagtcactctcgcttgttgacgttgatgcactgtcggatgtcgacgcactcgttgagcctgaaagactcgtacttgtcgattcacttaatgacgtacttgtactgtctgactcactctcactcgttgacgttgatgcactgtcggatgtcgacgcactcgttgagcctgaaagactcgtacttgtcgattcacttaatgacgtacttttactgtttgattcactctcgctcgctgacattgatgcactgtcggatgtcgacgtactcgttgaatctgaaacgcttgtacttgtcgattcacttaatgacgtacttgcactgtctgactcactctcactcgttgatgtggacgcactgtcggatgtcgatgtacttgttgaatctgaaacgcttgtgcttgtcgatttacttaatgacgtacttgcgctattggagtcacttacgctcgttgacgttgatgcgctatcagacgtcgacgtactcactgattctgataatagtttacttgtgcttgctgattcgctcgcttttattgatgcgctatcagacgtcgatgtgctcgttgagtctgaaatgcttgtacttgttgagccactcacacttgttgatgttgacgcactttctgacgttgacacgcttgctgaatctgaaacgcttgtgcttgtcgattcacttaatgacgtacttttactcgttgactcactctttcttgctgactctgatgcactatcagatgtcgacgtactcgctgattctgataattgtttacttgtgcttgctgattcgctcgcttggattgacgtactattcgacgtcgacgcacttaacgactctgagagactcttacttgttgataatgattga

SEQ ID NO: 1310 - DNA, 1344 bp, S.epidermidis
aatattgaagtgaaaattgttcggcataagttaggagattcttccatgttattgtttatcatagaaatcataatcatgattctagcgatattattaggattaagaactgctggtgcactgggatgtggcatctttgctatagtagcgcagcttatcatgatatttggattccagttacctccaggttcagcaccagtgacggcagtgttaatcatattatctattggtatagcaggtggtacgttacaagccactggtggtattgactatttagtatacattgcatcacgtgtgattgaacgctttccaaaatcaattatatttatagcgccaatgattgtctttgtctttgtttttggaattggtactgcaaatatagctctttcacttgaacctatcatagcgaaaactgcacaaaaagcacgaattcagcctaaacgcgcattaactgcttcggtacttacagccaatttagccttactttgtagcccggcagcttctgctacagcttatattatttctgtattagcagggtatgaaatatcgatgggcaagtatttaagtattgttttacctacagctttaattagtatgttaatgcttagtacattttgtacatttgtaggacgaaaagaacacgtgcgtgatgagtcagaacgtttagttcagatgccagaagtcgaaatcaaaaatgacttttcattaaaagtaaaaataggtgttatctcattcctattatgtgtcatgggtattttaacgtttggcatatttcctaatctcatgccgcaattcaatgtgaatggagatgtagttaaagttgagatgactgaaattgttcagttctttatgtatctcagcgctacaatcaatttattattaataaaaatcaatacttctgatattctgtcatcgaatattacacaatctgcaatgggagcactttttgcagttcttggcccaggttggttaggtgcaacaatatttaatgctccacataacttaaaaatattgaaaaatgatattgggtcaattattagtgaagtaccttggcttgttatcatacttgtttctgtagttgcaatgattgtcatttctcaaacagctacagcatcaattatggtgccgatagttatgagtttaggtatacctcccatctattttgttgcgatggtacaaacattaaatgtgaatttcgttattccagctcaaccgacactattatttgctgtagaactagatgaaacaggtagaacaagacctacgagctttatgataccaggattttttgttataacagtatccgtcattacaggatttgttattaaaaccattttaggatattaa

SEQ ID NO: 1311 - DNA, 126 bp, S.epidermidis
gctatacgagtgaggaacataaagttttattcaacctttgttctacttcttttatttatacataacaacttattctatacgctttttcaagagtttattgaaattgataactctcatatcctttag

SEQ ID NO: 1312 - DNA, 843 bp, S.epidermidis
gtatcatttttaagatttgagcaatcaagactatataagcatcgagaggatgatactatgtttatttcaaaacaagaattatatgaaaagttacaatatgttacgccaagaacgtttgcctacttgaatgaaatagattattataacttattaatgataattgaagagcatcaaatatctattccaccgattcatcaacttcgaaaaacattgcgaggaagtaaaattatgaagcctaagaatcgcgtagacaattgttatattcatttaaaggatgaaattccgacccctattaacaatgaacaattaagtttcctgcatttttatccacgtcagcaaatacatttaattttgagtgcttattctagaatgaaaagtctaaagttacaatctcaaaaacattgtttaaagctcaaattccccttagatcagcattctattcgtaaagaaattacaccacctcaaagctctgataaagacaatgatattttaatttgtctattacaaaaattaatcaacgaaattaccaaatgtcaagttcctgtttctctaaagaataattctttcgaaataaaactaccaaactatatcataaaggttgatttaaactatcacgaacagcaagaccatttatatccattacaatatagcatccacgcatggcatagagatttccaatatctcgaaatctcaaataccttcacaataccgtctttgaatgatcttattttccatatacaaaagctttttttacttatatttcaattacctgaacatctcgcgagacaagaatattcattgagtcaatattatttttactcgcaatgccatacaaaaaattaa

SEQ ID NO: 1313 - DNA, 750 bp, S.epidermidis
ctaaaattggtaagaaatggtttggtcaagatgtttctaaacctgaataatgaacaacaacatgcattagatgcagccaaacaagcatttggtccaatgttagagggattggtgaaatactcaatccctattactttggtcactttcattctaggtttaatcattgcattgtttactgcacttatgcgtatatcaaccagtaaattgcttagaggtattgcgcgtgtctatgtatcaattattcgtggtacacctatgattgtacagttatttattattttttatggtataccggagcttggaagattggtaactaacaatgctgataatcaatggacacttgcacctgttattgctgcagtcattggtttatctttaaatgttggtgcttatgcttctgaaattatacgaggaggtatattgtctattcctaaaggacaaacagaagcggcttattctataggtatgaactatagacaaactgtgcaacgtattatcttaccacaagctattcgtgtatctataccagcactaggaaacacatttttaagtttaattaaagatacatcattacttggatttattcttgttgcagagatgtttagaaaggcacaagaagttgcttcgacaacgtatgagtatctaactatttatttgttagtagctttaatgtattgggtcgtatgttttatcatctcaattatccaaggatggtatgaatcacgcattgaaagagggtatcgctcatga

SEQ ID NO: 1314 - DNA, 189 bp, S.epidermidis
ttaagaaaggttttaattagtttgaattttaaagtatttctaattatcatttttcatgattttcttatttattatgaacacggttttatgtatagccgtttcaaagaacatgctgaacaatcatcacatttatttatattaaaatcacatttaaagccatttccaccatttcgatatacatatgattaa

SEQ ID NO: 1315 - DNA, 411 bp, S.epidermidis
agtgtgaaggtgatgaaattgaaaaaggaaattaatgtagtaggtgctattatatattctgataacaaaatattatgtgcgcaaagaagcgaaaatatgagtttacccttaaaatgggagttcccaggtggaaaaatagaaaatggggaaaccgaaaaagacgcattaataagagaaattaaagaagaaatgaaatgtgatttaattgttggtgataaggtaacaaccacaacttatgagtatgattttggaatagttaacttaacaacctataagtgtgaacttaacaataaaaaaccaactttaactgaacataaggaaataaaatgggtaggaaaaaatgaactagataaattagattgggctccagcagacgtacctgctgtaagacgtataatagaggagaattag

SEQ ID NO: 1316 - DNA, 210 bp, S.epidermidis
attattgaggtgatgactatgagaaatgctatagaagaattaatcttctccgatgtaagtagttatgacatctatgtaaacacaggcgttaaccaagggttggttggagacataaaagatggatatttgacgattgattctatcccatatattgatgctgaaagattatactattatagtttagagcgcaaagccctcgttacaagttga

SEQ ID NO: 1317 - DNA, 345 bp, S.epidermidis
gttaaagaggtaggagtcatgttcattcaatttaaaagacttttgattggtagacctaaaagaaacagagacttaaaaaacgagaaaatttcaaaatttaaaggattagctatcctatcatccgatgcattgtcatcagttgcatatggtcctgagcagatattaattacattatcggtgataggagctgtggcatcttggtatacgctgcctattgccggagcagttttaatattattaacagctctaattttatcttatagacaaattatttatgcttatccaaaaggtggggagcgtatattgtttctaaaacaaatcttggtgagaaatggggattgctag

SEQ ID NO: 1318 - DNA, 1722 bp, S.epidermidis
acgttggaggttgaaaatatgaaaagtgcccaagcacttaaacagaatttaacatcgttagacggtcaaaagtacggtgcgtataagcaaataaaagacctatacgaatttaatttatttaaactacgtattaatcatatccaagctgatccatttgcgccaccatctaagatgagtgttgttatagatcgccaacaagcaaaatttcctgattctttattaaattctgaactgaaacaacgggctgtgagtgattacttaacgcgcgtgtttcataagcagattcaatcaatagtagcccaagataaaaaagtaagtaaaattcaaattgatagttgtggccaagaaatcttagagcgtaccgcaatagtaattaagaatcatcaaattgaagcacgtattgaagttggattaccagcacgaggacgtaccatattaggtagaatagcaagacatacacttattaatgtattacctcaaatagtagaacatgccttatgttatcgcaacattaatggttcacaattgcaacaacaagttgaattaatgatggatcaagaggagattagacaacagttagtaaaacgtgaccttgttgcatttgtagcaaatggtgctattttaccaagaaaaagtggtgtttcagatctccctatgaataacgctattgaatttaaaagtcctaaacaatatgagattgtaatgaaactatcgagtggcaaagttattaagggtatgggtattcctaaaggcattacactaatagttggaggcggttatcatggtaaatcaacattacttgaagcgttagaacgaggtgtatataatcatattgctggtgatggtagagaatatgtgattacaaatcaagatgcaatgaaaattcgtgctgaagacggaagaagtattcaaaatgttaatatccagccatttattgatcatttgccaggtgaaaaagatactacacatttttcaactgaaaatgcgagtggtagtacgtctcaagctgcaaatgtcatggaagctttagaatcacaagcatcattgttactcattgatgaagatacatctgcaacgaatttcatgattcgtgatggtcgtatgcaacgtttaattgctcccgaaaaagagccgattacacccttttctaataaggtaaaagcattatatgacgaccataacgtgtcgactattctaatcgttggaggttcgggagattattttgacgtggcagatcaagtattgatgatggatgaatatgtgttgaaagatgttacgcaacatgctaaagacattgcgcagtcagatggttatcaaagaaggctttcttctcactatcagttcggtcacattccatcaagaattccgttgagagcgagttttaatcaaaaagggaaacgtgatcgctttaaagctaaaggattgaatgtagtaacgtatggtaaggaaactattcatatttctggcttagaacaacttgtcgatgacagtcaaacacaaggtttagcgatgatgttaagttatgtaaaaaatgaattgctagatgacaaaagtacgattgtagaattgaccaatagtttgtatcaacggattgagaaacacggattagatgttatatcaaatcatcaggggcatcctggtcatttagcgctacctagaaagcaggagtttattgcgacacttaatcgatatcgtagattaaaaataaagcaaagggaataa

SEQ ID NO: 1319 - DNA, 1002 bp, S.epidermidis
attgaggaggttggcacattcatgtttaaaaagattgctactataataggttcgacattatttggtacagttttattcgcaaaagtgaaagaaaagcgtagttataaaagttttttacaagagaaaatgattagaatatcaggaatgaaaaagacatttgaaagtatagatgacgcgaaaaaagctttgaatgagactaaatatcaaacttcaggtaaatataatggaacaacatatgaatttaagcataaagttcaaataagagattattatggttctttagtctatgttgttaatgatcatggtcttccagatcaacgcacggtcttatatgtacatggaggcgcatggttccaagatcctttggaaaatcattttgaatatttagacttactcgttgatgcgctcgatgctagggtgattatgcccgtatatcctaaaataccacacagagattatcgtacgacatttgaattattaacaaaaatatataagcgattattgactaaaattgatgaacctgaaaacttggtcatcattggagattcagccgggggacaaattgcattagctttcgcacaaatgttaaaaaaagagcaactcagtcaacctggccatattgttcttatttcaccggtgcttgatgcgacatttaagaatccagaagcaagaaaatatgaaaaagaagatccaatgcttggaattgatggcagtaaatatcttgtagagttatgggctggtgatgcaccactagatgactataagatgtctccaatgaatggtgatttagaaggcctaggacatattacacttactgtaggaaccaaagaaacattatatcctgatgcagttaagttctctcacatgttaaatgataaaggaataaagcatcagtttatcccaggttacaatttatttcatatttatcccttattccctatcccagagcgtcaacactttttagaacagcttaaaaaaatcattgtcacaaaagagttataa

SEQ ID NO: 1320 - DNA, 465 bp, S.epidermidis
gtggccagggtaggataccatcttacttggaaaatgatactgggtctttttcctaaagaagataaagtcaaggcattggatgctttagaacgtgtaaacattttagataaatatgaccaacgctctgaccagttgtcaggtggtcaacaacaacgtatatcaatagctagagcgttatgtcaggaaccaaccattatattagcagacgaaccagttgcttcattagatccattaactacaaaacaagtgatggatgacttaaagaaaatcaatgaagaacttggtattactattttaattaatttacactttgtagatttggcaaaggaatacggatcgagaataattggtttaagagcgggagagctcgtttatgatggacccgcgtctgagacaaatgacgaagtatttaatcatatatacggtcgctctattaagaacgatgaaaaattaggggtggaataa

SEQ ID NO: 1321 - DNA, 147 bp, S.epidermidis
tttagtttattggtatttattaaattatacgaaagggcttatttttttaagtattttggcgagactcttgagggaacaggacaagctgaagactacaggctgaagctgtcccctaagaaagcgagccaacaatacgaagtattgtaa

SEQ ID NO: 1322 - DNA, 1425 bp, S.epidermidis
aatttcttattcctcatgcaaatgaaattgggatggcacaacgtactattggtgaaaggaggcatttattatatgagtaaatcatatgacttaatcgtaataggagctggacctggtggctatgtagctgcaatacgtggtgcgcaacttggtaaaaatgttgcagtcattgaaaaaaataatgctggaggcacgtgcttaaatgtaggttgcatcccctctaaaacgttgttagaacacggcgagaaagcacacagcatacgagttgcaaacgattggggaatcacaacgaaagacttaaaaattgattttactcaatttgtccaacgaaaaaagaaagttgtacaaacacttacgggtggcgtgaagcagttgttaaagaaaaataaagttacttatattgaaggggaagcacgaatttctaaaaacttaaaagtggacgttaacaatgaaacgtatcaagcgaaagatataattttagcaactggcagtcagccgttcattccaccaattgatgggttagatcaagtcaattatgaaacaaccgatacatttttcgatttagagaagctaccaaaacagttagcggttatcggtgggggtgtgattgcaacagaactcgcatcctcaatggctgatcttggggttagagttacgataatagaagttgcagatgacattttattaactgaaatcaacgaaactagagaaatgttaaaagcacatttagataatcaaggtattaagatactgacgaaagcaaagataaaacaagtaaaggaatcgaaaataatattagatgggcaagatgatgttagctttgatacccttcttgttgcaacaggtagacaaccgaatacgcaagttgcaaaagatttaaatttggaaatggatggtaaattctttaaagtcaatgaacattatgaaacgagtcaaaaacatgtctatgctataggagatttaattaaaggatatcaacttgcacatgcagcaagtgcgcatggcattcatgttgtcgaaacaataatgaacaaacagccgtcacttgtgcgtcaagaagatattacgcgttgtatatacacaagacttgaagcagcatcagttgggttatcagaagagcaagctaaagaggctggttatgatgtgaaagtgactcaatcagcatttcaagggaatgcaaaggcgttaatcaaaggagaaaatgaaggatttattaaacttgtcgttgataaaaagtatggagaggttcttggtgcttttattgtaggaccacatgctacagatataattggagaacttttaagtgtcaaagcatcagagggtacgattcatgaactttctcaaattattcaaccacacccggctttattagaagcaataggtgagagtgcagatgcattttttgattctgcaattcatatgtag

SEQ ID NO: 1323 - DNA, 483 bp, S.epidermidis
atactattattattactgtcattaaataaatacattttttgggagaaagaaatgaaattcaaaaaattattatctcgtattattatcgctacaatgattacatttactggaacactctcatatcaagctattgaacaaacgcatatttcccatgctgcacataattattatggtaaaaaacaatgcacttggtgggcatttaaacgtcgtgctcaattaggtaaacctgtatcaaatcgatggggtaatgctaagaattggtatagcaatgcacgtcgatctggttatgcaactggacataagcctcgaaaatacgctgttatgcaatcaacgagaggctattatgggcacgtagcagtggttgaaaaagtatataagaatggaaaaatcaaaatttctgaatataattataatgtgccattaggctacggcacacgcattattagtaaatcgtctgcacgaaactataattatatttattaa

SEQ ID NO: 1324 - DNA, 1260 bp, S.epidermidis
gagtgtctattaactatgcttagcgcacaacaatttttaaaagaatttaataatgttgaatctctagatgaatctttgtacgagatagtgagtcagatttgtgaagaagttaaattacagggagataaagctttaaaaaattataatttacaatttgatcaagtggaaactgagaagcttgaattagagcaaagccaactaaaaaatgcatacgacatgctagataatgaaacacgagatgcattagagcaaagctatcagagaattaaagtgtaccaagaaaatattaaggtaaaacaggaatcatctcaacaaactgaatgttatgaacgataccatcctatcgaacgtgtaggtatttatgtgccgggaggtaaggctagctatccgtctacagtattaatgactgcaacacttgctcaagtagcaggtgttaatgagattactgttgttaccccacctcaaaatagcggtatatgtcaagaggtgttagccgcttgttacattacaggcgttcatcatgtttatcaagtcggtggagcacaaagtattgcggcgctaacttatggcacggaaactataaaaaaagtcgacaaaatcgtaggtccagggaatcaatatgttgcttatgccaaaaagtttgtattcggtcaagtaggcatagaccaaatcgcaggaccgacagaaatagccttgattatagacgaaagtgctgacttagacgcaatcgcttatgacgtatttgcacaagcagaacatgatgaaatggcttgtacttatgtgattagtgaaaatgaaaaggtacttaatcaattgaacactataatacaagagaaacttcagtatgttgaacggcaagatatcatatcacaaagtattgctaaccatcattatctaatattagctcaagatactgaagaagcatgtttaattatgaacacgattgcacctgaacatgcatctattcaaactcgagcacctgaaatgtatatagataaagttaaatatgtaggcgcactttttttaggtcatttttctcctgaagttattggggactatgtggcaggtccaagtcatgtacttcctactaatcaaacagctagatttacaaatgggctttctgtgaatgactttatgacacgacattcagtcattcatttatcacaaaaaacatttaacgaagtggcagaatcagctgagtatattgcacatatagaatctttatttaatcatgaaaaatcgattcacgtacgccgataa

SEQ ID NO: 1325 - DNA, 225 bp, S.epidermidis
ggtgagatattgagcttttacgaatttatgcaaaatttcctaggtgatgacacgccattaggtgaattggttgattggattaatcaagatatcaatttccctaaagacgtgacgagccaaaaagaaatcttgacatattttcgaaatcatccatgtccggaaaacataccagtgacgagtatcaaacgggcactagctgttttcaaccaattcactaaagtataa

SEQ ID NO: 1326 - DNA, 138 bp, S.epidermidis
caatacgtattaaaaaatcatctacatgtagataaaatgaattggctgattctgataattaatataatagcacagaagataaatattttgtctaaaaattctgaaaaattaacaaaaattattttcctcagtgattaa

SEQ ID NO: 1327 - DNA, 369 bp, S.epidermidis
gaggaatctttaatggttttacgttatgctacaaatttaaaactagctaaagaattatatgatgcaagtaaacctaaattaaaaggcgatcaaggtatgattgatactttcactaatacatttggtttaccggaaaactcagttaagttagcaggtggcgttgaagctgcagctgctggtttatttgctgctagttttttaaataaaaatatttcacgcttaggctcacttgcagcaatttcagtacttggtgttgcagcttacaaacattttgaagcagggcatggtaaaaagggtgcacaacatgctttagacttattaggtttatcaacacttagcttattagatactttttcttgtaaaaaataa

SEQ ID NO: 1328 - DNA, 201 bp, S.epidermidis
agcaattcattgatttgtttagcttgcccttccgtaaaaggactattggtaacacttaagttcaatcttatccacctcttatactttgttattccgatatttgtcattgtttatatatgtctatttttgaaagttattaattatatcttcaattctagtatgtaccatttgttattttcagtaaatgtaatactcaattga

SEQ ID NO: 1329 - DNA, 153 bp, S.epidermidis
tctgaatcattgctattcgaacatcccacaagagcaattgacatcacaattaataaaattccccaaaattttttcatattctatctccttttaatttttatatacagagaaataacaattaaatattacttagttttaaattgctatttataa

SEQ ID NO: 1330 - DNA, 255 bp, S.epidermidis
ggtacaccattagaattagtttttgtcaatactttaggacctaaaccttgtttcgctaaaccaaataaaattctactattagaatatattccgctatttgttgcagatgctgctgctgttaaaacaacaaaattaactatgccagcagcaaagggaacaccaattagtgtgaataatttaacaaacggactactatcaggatcaactttaaaccatggaatgacagacatgattacaagtaaaccacctatataa

SEQ ID NO: 1331 - DNA, 147 bp, S.epidermidis
tttgttacattcaatcatcgaatattactcactgaactgggcctttcttctagaactgttcttcaaacatctattaatgtcggtatatggtgtgttgtttgcatgtataattggaattcctattggtattttcatagccaagtataa

SEQ ID NO: 1332 - DNA, 510 bp, S.epidermidis
gttaacacatttgctttagggagtgaggatatggaaacggtatattttgctggtggatgtctatggggaactcaagctttttttaatacgattccaggagttattcaaacagaagctggaagggcaaatggaacgtcgaaatgtttagatgctccttatgatggctatgctgaatgtgtgaagatacactttgatcctgcaaaaacttcaatacttatgctgatggattatttgtttgaaatgataaatccttatagtttaaatcaacaaggtcaagacaagggtcaaaaatatcgaacaggtgtgtatagtgaaagttcgaagcatttaaatgaagcaaaagactacattaagcgcagggaagacgcgaaacaagtaatggtcgaagtacaacctctaagtaattatgtgaagagtgcagaagaacatcagaatcatcttgagaaatttccggaggattattatttatgtcatgttcctccagcattgcttaataaatacaagaaataa

SEQ ID NO: 1333 - DNA, 327 bp, S.epidermidis
attcagacattatcgtggcttaatataagaaaagtaacagctcaacgaggtgaaaatcatcaaaaaaattataaaaaagacaatttctatattatttcaatagaaattgtctttatttacttatcttggacctttttgtcccaggctcatttgtatatttatatcgttttttggatgaatcgtatgatggctatcactacaatgacaatcattgaaacgaaagataagattttgaaatgcttactttttgtttctttattagattctccattttccatcatttcctgtagttctcgttctatctcaagatctaaatcagttttttga

SEQ ID NO: 1334 - DNA, 129 bp, S.epidermidis
attcagacattatcgtggcttaatataagaaaagtaacagctcaacgagctgaaaatcatcaaaaaaattataaaaaagacaattcctatattatttcaatagaaattgtctttttttacttatcttga

SEQ ID NO: 1335 - DNA, 954 bp, S.epidermidis
agttttcaattcatttcaccctcaatttcctttattattagcaatagtataatgaatcgtaaaaagaaaggaaagaataaagttatgacaattgccattataggcccaggtgcagtgggtacaacgttagcttttgaattaaaaaaagttctaccagatacggaactcatcggccggcaagataaattaatgacctatttcccagaaaatacttctaatggaagtaatgttaaagtgacttcatttaatcatattaatcaaacttttgatgtcattatcatagcagttaaaacacatcaattggatgacgtcattaaacaattacctaaaatcactcatgacgattcgctcattatcttagcacaaaatggctatggacagcttaataaacttccatatcaacatgtctttcaagcagtcgtctatattagcggacaaaaagttaacaacaatgttcaacatttcagagattaccaactatatattcaagatagcacactaactcgtcaattcaagcaaatggttcatccttccaaaatagaggtggttttacaagaaaatattgaaaaaagcatttggtataaattattagtgaatttaggtataaataccatcactgctattggacaacaaccagctaaaattttaaaatctcctcatattgagtcgttgtgtcgtcgtatattagttgatggtcttaaagttgctagagctgaacaaattgactttgaagatcatatcgttgatgatattttaaatatttataaaggttatccagacgaaatgggaacaagtatgtattacgatgtcattaacaagcatcctcttgaagtcgaggccatacagggttatatatataaatgtgcaaaaaaacatcatttagagacaccctatctagatatggcttatacatttttatacgcttatcaccttgaatacacacaaccagattga

SEQ ID NO: 1336 - DNA, 132 bp, S.epidermidis
tcacctcaatttaaatataaacacattctgagaattcatttaagtgatatggaatacaattacaatattgtaagtttcgatacaaaaatactaatgattaaccacttaatgcttgtactaatgcgtatttaa

SEQ ID NO: 1337 - DNA, 186 bp, S.epidermidis
aaaagacaatttctacattatttcaatagaaattgtctttatttacttatcctggaactttctgtcccagccactcttttaataattacaaaatttttaaatactatgttttgttatagagatgttggtatgttttacagttttgaaaaaagattatacgtagccattaacaaagtgaccgattaa

SEQ ID NO: 1338 - DNA, 804 bp, S.epidermidis
ttatttaaatttttaggaggatatttaacaatgaaaaaaatcgctacagctacaattgcaactgcaggaatcgctactttcgcatttgcacaccatgacgcacaagcagcagaacaaaataatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactacagtaattacaacaattacaacaactatcaatcaaacaacacgcaatcacaaagaacaactcaaccgactggtggtttaggcgcaagctattcaacatcaagtagtaatgttcacgttacaacaacttctgcgccatcatcaaacggtgtatctttatcaaacgctcgctcagcatctggtaacttatacacttcaggtcaatgtacatattatgtatttgacagagtaggtggcaaaatcggttcaacgtggggtaacgcaaacaactgggcaaacgctgcagcacgttctggttacacagtaaacaattcgcctgctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 1339 - DNA, 162 bp, S.epidermidis
tttcctttttcaatttcatcaccttcacactttaataaatttattttaattttaacaaatgtatatgtgtttatacatccaaactactgcgaaaaatgctctgcttatgtatataaaatttattctttaaacaagtcgtggtttacatacttaatatattag

SEQ ID NO: 1340 - DNA, 138 bp, S.epidermidis
ctacgcttttctttcacttttgcgaataaaactgtaccaaataatgtcgaacctattatagtagcaatctttttaaacatgaatgtgccaacctcctcaatctataaccattttaaaccatcagcgtctaaacgttga

SEQ ID NO: 1341 - DNA, 213 bp, S.epidermidis
tggccgaaattcttggggaaccagaatatccaagttcatcaaactgcaaacaacagatttcttaaagaaagttgttatttactgggaaataatataagtatgggtactttgagacaagaatcatgtgactcttgtctcagtttcatatttttgggtaaacatttaacatatagcaatgataaccaatacaaatttaataagtatacaatctaa

SEQ ID NO: 1342 - DNA, 168 bp, S.epidermidis
aaatgtgaattaaggtggtatttaaatagactatcaagatgtgtgtcgtttgtttcccttcatataatggaggttgaaagaagcaattgtatagctattttaatgaaagtagagggtgtgattgtaaaatcagttattcacatatatgacaacatggaattatgttaa

SEQ ID NO: 1343 - DNA, 1533 bp, S.epidermidis
gcgattacttcaaatatcactaaaaaaggatgggttttaatgacaaatattaacgtaagaaattatatagatgaaagttacggcttgtttattaacaatgaattccaagctagtgatagtggggaaacattaactgtttctaatccagctaatggtgaagatttagctaaagttgcacgcgctggtaaaaaagatgtagataaagctgttcaagcagctcatgatgcatttgatagttggagtaagatttctaaagaagaacgtgcagattatttattagaaattagtcgacgtattcatgagaaaactgaacatttagcgacggttgaatcactgcaaaatggtaaaccctatcgtgaaacatcaacaattgatgtaccacaagcagccaatcaatttaaatattttgctagcgttttaacaactgacgaaggttcagttaatgaaattgatcaaaatacaatgagtttagttgttaatgaacctgttggagttgttggtacagtagtagcatggaacttcccaattttattagcatcatggaaattaggaccagctttagcagcaggtaatacagtagtaattcaaccatcatcttcaacgcctttatcattaattgaacttgctaaaattttccaagaagttcttcctaaaggagtagttaatgtcttaactggtaaagggtctgaatcaggagacgctattttccatcatgaaggtgtagataaattatcatttacaggttctactgacgtgggttacggtgtagcacaagcaggtgctgaacgtatcgttccgacaacattagaactaggtggtaaaagtgctaatattatctttgatgacgctaatttagagcaagtgattgaaggtgttcaacttggtatattatttaaccaaggtgaagtatgtagtgcaggttcaagattattagtacaatcatctatttacaatgaattgttgccaaaattgaaagaagcatttgaaaatattaaagttggcgatccatttgatgaagatactaaaatgagtgcgcaaactggaccagaacaattagataaaattgaaagttatataaaaattgctgaagaagatgacaaagcgaacatcttaactggtggtcatcgaatcacagataacggcttagacaaaggttacttctttgagcctacaattattgagattaacgataacaaacatcaacttgctcaagaagaaatcttcggtccagttgtagtagttgaaaaattcgatgatgagcaagaagctatcgaaattgcaaatgattctgagtatggtttagctggaggtatcttcactacagatattcatcgtgcattaaatgtagctaaagctatgagaacaggtcgtatttggattaatacttataatcaaattcctgctggtgcgccattcggaggatataaaaaatcaggtattgggcgcgaagtatataaagatgctatcaaaaactatcaacaagttaaaaatatctttattgatacaagcaaccaaactaaaggtttatattaa

SEQ ID NO: 1344 - DNA, 159 bp, S.epidermidis
ttgttatattcttgtaataataaattttgctattattacaactttagctttgatgagtttaatctatcttttaaatatttagccaataaagaatatttacttgatgtaaatttaatcttagatatcgttaagattgttcataaaattgataaaaaatga

SEQ ID NO: 1345 - DNA, 135 bp, S.epidermidis
tatacacattcaataaagcgtttacaatactttttgaaaattttacataaaaaaactcgactacttagagtcgagtttctaaaaatgtattattataagaaacgtttagctgctacagagattggtgggatttga

SEQ ID NO: 1346 - DNA, 204 bp, S.epidermidis
ttaaaggaattaaatactactttcggtgacaagcaacgtggtcaagtgactaatgaaatactaaatgaatctaaaaaagatattcctaacagctatatcacatacaactctcaaatagatggtgtgaataataaagtaagacattttaatgttacaccagaatctatctatttaattgattataaattaagtaaaaaagaataa

SEQ ID NO: 1347 - DNA, 141 bp, S.epidermidis
aatactaattctatagcctttttagaatttatcattttagccctctatttctctgataaaatcatttattctaatacttcatcatcttccctcatattgattgtgctcaattttaataatagaattaaagtaaattattaa

SEQ ID NO: 1348 - DNA, 267 bp, S.epidermidis
acagactactcatcaattatttttgatgctttaaccgtagataaaaaaggttgcttatacacacccaatcactctcaatatgtcgaagaacgtggcgtctatcaagacgtaatggacaccttaaaacctatttggtataccgatgctgaactattaataaatgatttaattactgatagcatcccacaattaaacaataaatatacaaataaaaataatcagtcatttgaatatattagtaaacttatttcaaatcaattgaaataa

SEQ ID NO: 1349 - DNA, 1023 bp, S.epidermidis
ttcaattcatcattagaggagtgtagaaatatggtagaaaaattcaaagcttttgtagtcgatcaagatgacaacggtattgtttcaaatagttataaagaactaactaaagatgacttacctgagggtgacgttttaataaaagtacattattctggcataaattataaagacgcactagccactcaggaccataacaaaatagtaaaacaatatccgatggtccctggtatagatttagcaggtaccattgaggaaacaaatgctccaggctttgaggttggagataaagtcatcgtaacaagctatgatttaggtgtaagtcattacggaggcttcagtgaatacgcacgtgttaaatcagaatgggtgattgaattacctgaagatttaacattggaagaagctatgatttacggtactgctggctatacagcaggtttagctatagaacaacttgaaaaatcaggtatgtctattgaaggtaaagaagtgcttgtacgaggtgccactggaggcgtcggaacgatttcattactcatgttaaataacttagggtatgatgttattgcaagtacgggtagagatgacgccgaagaaaaacttaaaaagcttggtgctaaagaagtaattggccgtttaccagaagataatagtaaaccattagagaagagaacatggcaggcagccattgatccagttggtggtgaaaacttaccgtacatcgtcaaacgattggataacaacggaagtgttgcattaattggcatgactggtggtaacaattttgaaacaaccgtctttcctttcattttaagaggagcaagtataattggtatcgattcagtatttactccaattaaactaagaaaacgtgtttggagaagacttgcaaaagacttaaaaccacaacaattacatgacatcaaacatgttatttcattcgatgaaatcccaaaagccatcgatcaagtcatcaatcataataatactggacgtattgtcattgatttcaatgtttaa

SEQ ID NO: 1350 - DNA, 888 bp, S.epidermidis
tttgaaatgtcagctcaagatccgcgcaataaatttaaaactgataattatgaaaaacaagaacaagaagttccaggtatacaagctaaaatgtcaccacaaccagattgtggggaagattcttatcatggccaccatcgattagatggctttaaaatactagtgactggtggcgattcagcaattggacgtgcggcagcaattgcttatgctaaagaaggtgcagatgtagcgattaattatttaccaagtgaacaacaagatgccgatgatgtaaaacagattattgaaaatgttgggcaaaaagctatcttaattcctggtgatattagagatgaacaattcaactatgacatggttgaaaaggcttatcagcaattaggtggtttagacaatgtaacgttggttgctggtcatcaactttatcaagatgaattatcggagtttaaaactcaagattttaccgaaacgtttgaaacgaatgtctatccggtattttggacagtccaaaaagcgcttgagtatttacaaccaggaggctcgattacaacaacatcttcagttcaaggttataatcctagtccaattcttcatgattatgctgcaacgaaagctgcaattatatctttaacaaagagtttttcagccgaacttggccctaaaggtattcgtgttaactgtgttgcacctggaccgttttggtcaccacttcaaattgtcggtggacaaccacaaagcgctatacctacttttggacaaaacacaccgttaggacgtgccggccagccagttgaatgtgctgggacatatgtgttattagcctctgatgatgcaagttatattaccggtcaagtatatggtgtgactggtgggactcaaatagattaa

SEQ ID NO: 1351 - DNA, 204 bp, S.epidermidis
ataagccagtccagtgattacgttcgacaccttaatcattggactggctttttcatatctatcaatttaaataataatcaatataaattcgctatattgattaaaaataatttattgcgtttcattagaactattgagatgataactgcttttgcatttaaaatcttaatttacttattagggtttgcattaacaggatattaa

SEQ ID NO: 1352 - DNA, 216 bp, S.epidermidis
gtcctacttcctttctctaaatttattcaaattaaaatctgcaaaaaagtgcatattaaaatacaccattcattatttattgaaaatacttctttcctcaattttaagctaatgttagaaaaatacctttattttactttaatatctccattttcattgattaatttcactttattatttccattttcaactttactattatataacacacgatga

SEQ ID NO: 1353 - DNA, 480 bp, S.epidermidis
tttgccatgttatggcatttaatttttatgattcctacaattattggttactcttttggaatgttctgtttaatatcaagtgaaacttttaaaagtaaaggatttctcttgttgggggtaggaatttttatcttttctttaatttatattttgatttatagtttagttacattaatacctaatgttgcgatattatcaagaagattccatgatcgctcaatgacgatgactcttccgattattttttatgttttcactgtcattgtatcaggttttaattatttaccaaatatagataattcagcggtattaatatttatgggaattatctgcttaatctactggattgggtcgatattaatattagtattgacttgcttagatagtaaaacagagtctaataaatatggaccaagtccaaagtacaatcgtaacgagacaaatttccatggtgataatgctaatccagttgataaataa

SEQ ID NO: 1354 - DNA, 141 bp, S.epidermidis
gtgttgacgttattgcaaatatcttgtaacgttaaacacaattcaataacttatcaagagaagtggagggactggcccaaagaagcttcggcaacattgtatcatgtgccaattccagtaaccgagaaggttagaagataa

SEQ ID NO: 1355 - DNA, 969 bp, S.epidermidis
ggtatcaaaacaatgttactttttttatgttttctaatcgaattattacttattgttttattatatacgaagcaatcgtttactcttaatttatttagtttcatcttatataacatcattggttttgttatgatgacttatcatatggtaactgtatcaataccatatgatatgtttatcattgtaattgtagcaatgatactgttgttgattaaacatcgttatattttcaagttgcaaacaggacgtttttttattttacaacttagtcatcatttttatactgtggggctatttgctgtgagttgtttatatataagtactattcccctaattatcattaatagcttagctttatgggccgctaccattgcatttagtacaatttattcatttatcggatacttatcttggtctacagcttttgaaaatcatcaatattataaacacgtaaagttaattatggtgcttggagctggaattttctctgaagaagtgactacgcttcttgctgcaagacttgataaagctttatctgtttatcattcacaacggactaaacctatcatcattgtaagtggtggccaaggtcctgacgaaccaatttcagaagcacttgcgatgaaaagataccttatagctcacaacgttccggaaaaccatatatttatggagaatcaatccacgaatacacgaaccaatttcttatactctaaatctatcattcattcgatgatgcctacttcaagtcagatgttgtgtgtaacaagtcaatttcatgttttaagagcgcttaaatttgctaaaaaagctcatctttctttcgatggtattggaagtcgtacaccataccactttttggcacaatctatgattatagactttttgggtttaatgtatcaatataaaacaatacttactatttatttcgctatgttgttttggcttgcaatactacaaaccatataa

SEQ ID NO: 1356 - DNA, 141 bp, S.epidermidis
tttacaaaaacaaataagagtgaggctaagaatttacctaaatttctggctagcgttttattttatagtcgtgattttgtcactttaataaaaatgaatatgttttataatataatcttaaggaggattttttatgcgtag

SEQ ID NO: 1357 - DNA, 633 bp, S.epidermidis
atgtctgaaacattacaaaaccaaagacaattcaactctcaatttgaacatcaagagatccatcgtggaaaaagatatggtaaaaagaaacgctcatgggtaagtctcattattcaagttttcgttttagtattaactgctattactggctatagtatgcttaaacaacctatatttaaaatttcatttgtaaatgaaactataaatttccatcaattaagaaattttcaagatacagttacgcaaatcggtaatttgaatttaggtaatattgatcaattacaacagtctgtcgataatctcatcattatatttaatattttctttgtcctatgtctgattagtttgtttataaccgtaattacaattatttttaatcgcacagcactcaaagtagtcaatatattacttttagctattatgctagtcattacattgtatttcagttatatcatacatacaattgctcagaaaatttccgaatctctaaaacaatattatttaacagtatcaccagaacaagtattaactgaagcagatgcgattcacaatgcactgatactcattggatgtagtattgcgttattgattgtaagtttgtttttccgtaatcgtttaccacgtattaaataa

SEQ ID NO: 1358 - DNA, 477 bp, S.epidermidis
atgaacaagacatttaccgtaacccgaactgtgacagaagatgctatagataataataatcatatgcatgacgcatattataatattatttttagcgaggtcattaataaattcaatgaggttcatggtttatcatggtcagagagagaccgtctacaatatacagtttttactgttgaaacacacactacttttttacatgaattaacacttggtcaagaattcaatatagagctattcctttataattacgatgacaaacgaactcatttctttctgagaatgttaattgataatcaagaagttgttgcaaccaatgaggtcatgatgttaggaatagataggacacaacgtcgtgctgcaccatttccaaaacattatctgaatgctatacaagattatgctcataagcaagaaaaaattgaatggccaccacaattaggccactcaattggaataccatataaaggagaataa

SEQ ID NO: 1359 - DNA, 2184 bp, S.epidermidis
agagaaaggacgtatagtatgaataaactgacaattattgtcacgtattataatgcggaggaatacatcacaggttgcttagagagtattaagcaacaacgtacacaagattttaatttgattattgtgaatgatgggtcgacagaccaaagtaaaaaattaatggatgaagctattaaagactatgataaaaacattcgatttatcgatttagatgaaaatagtggtcatgcacatgcgcgtaatattgcattagaagaagtagaaacaccttactttatgtttttagatgcagatgatgaattagcttcttatgcaatcacgttttacttagaaaagtttaataatactgatggtttaattgctccaatacattcttttactacacaacgtccgcaatttgttgatttagatcgagtaagggttgaatactttaatgccaaagagaatattaattcatttttaagaaaacagtcagcttgtaacattatttttagaacagctattgtcagggcgcatcatattcgatttaatgaaaatttaaatacatatgtggattggtcatttgttcttgaatatatgaagtatgtaaataagtttgtacgtatttttaacttcccattttatttccgtggggaagtctatgatccatttgaaacacttacattaagtgaacaaaattttgatattttatttaaagattacgtcaacagcttttatgatgccattaaacgagcaacaaatccaaaagttagagaatttattgtcactaaaatgggaaataaaattgctaatgaatttgaaccaactcgatatgatattaatgaacgctatcaaacacataaggatacgcttgttgaattatcgaaatttttacatgtacatttagttaaaaaccaaaagctaataaataaaattgaaacaattttgttaatgaataatgaaactgataaagcttttaaagttaatcaatttagaaaaacgttgcgacatgttaaaaatattgttctaagaagaaaaaataaagaacgttcattgtatgatttaacagataaagaagataatgttaaaccgaaaacgattgtctttgaatcgttcggtggtaagaattacagtgatagtccaaagtatatttatgaatatatgcaaaagtattatcctaattatcgctatatatggtcatttaagaatcccgataaaaatgtcgtaccgggtagtgctgaaaaggttaagcgtaattcagcagagtattatcaagcatactcggaagcaagtcattgggtatcaaatgcgcgtacaccactttatttaaataaaaaagaaaatcaaacgtacattcaaacttggcacggtacaccattaaaacgtttagcgaatgatatgaaagtggtacgtatgccgggtactacgacaccaaagtataagcgtaattttaatcgtgaaacatcacgttgggattatttaatttcgccaaatagatattcaactgaaatatttagaagtgctttttggatggatgaagaaagaatattagagataggttatccaagaaatgatgtattagttaatagagccaatgatcaagagtatttagatgaaattagaactcacttaaatttacctagtgataaaaaggttattatgtatgctccgacatggagagacgatgaatttgtgagtaaaggaaaatatttgtttgaattaaaaattgatttagacaacctttataaagaactcggagatgattatgtgattttattacgcatgcattatctcatttctaacgcacttgatttatctggttatgaaaattttgcaattgatgtttcaaactataatgacgtctctgaattatttttaataagtgattgtttaattacagactattcatcagtaatgtttgattatggtattttaaaacgccctcaatttttctttgcatatgatatagacaaatatgataagggattacgaggattctatatgaattatatggaagatttaccaggacctatttatacagaaccatatggcctagctaaagaactaaagaatttagataaagtgcaacagcaatatcaagaaaaaatagatgcattttatgatagattttgctctgtagataatggtaaggcatctcaatatattggggatttaattcataaggatatcaaggaacaatga

SEQ ID NO: 1360 - DNA, 1500 bp, S.epidermidis
aaaagggggactgtgtttgttatgaatactcaacatagcaaaacagatgtcatcttaataggtggcggaattatgagcgcaacattaggaactttactaaaagaattaacaccagaaaaagatatccaattgttcgaaagattgagtcaacccggcgaagaaagttcaaatgtttggaataatgcgggaacaggtcattcagcattgtgtgaattgaactatacgaaagaaggtaaagatggttcagtagatattactaaagcaattcatattaacgagcaatttcaaatatctaaacagttttgggcttatttaatacgtgaaggtcatattgaaagtccagataaatttattcaatcagtgccacatatgagctttgttaaaggggaagaaaatgttaaatttttaaaaagtcgagtggcgagtttacagaaaaatgtattatttgaaaaaatgaaaatttctcaagatccagaaaaaattaactcatgggttcctttaatgatggaaggacgccaatcagatgaagcaattgccatcacgtatgacgagacaggtacagatgttaactttggtgctttgactaaaaagttaatagctaatttacaacaaaaaaatgttggcattaattataaacatgaagttttagatataaaaaaattaaataatggtaactggcaagttgtggttaaagatttaaatacatcaaatgtaatgaattatgaatctaagttcgtcttcatcggagctggtggtgcaagtttacctttattacaaaaaacaaagattaaggaatctaaacacattggtggtttcccagtaagtggattatttttacgatgtaaaaatccagatgtcatacatagacatcatgcaaaagtctacggtaaagccgaggttggtgcacctccaatgtcagttccacatttagatacacgatttgttaatggtgaaaaatcattactatttggaccttttgcagggttttcgccaaaattcttaaaaaacggttcatatttagatttagttaaatctgtgaaacccaataatatgataacaatgttaagtgctggcgtaaaagaatttaatttgacgaaatatttagtttctcaattaatgctttcaaatgaagaacggatcaatgatttgcgtgtattcttaccagaagcgaaagatgaagattgggaagtaattactgcaggtcaacgtgttcaagtaattaaagatacagataagtctaaaggtcaattacaatttggtacggaagtaataacatcagaagatggttcacttgctgcattattaggtgcttcacctggtgcttcgactgctgttgatatcatgtttgatgtcttgcaacgttgttacaaatcagagtttaagtcatgggaaccaaaaattaaagaaatggtcccatcatttggtttaaaattgtcagagcatgaagatatgtaccattcaataaacgaagaagtaaaaaaatacttgaatgtaaagtag

SEQ ID NO: 1361 - DNA, 204 bp, S.epidermidis
tatgctgatgcacatgtcacacttaatcctaatgaaagtgaacctgaatcatatgataagtatgatgtaagggtgcctgttgagcaaaatgatcatacaatgaaagtagaattagatgtgccaaagggattaaacgttgagagtgttaaaactattgaaggttttaaacatcattttttaaagataaaaagggaacattactaa

SEQ ID NO: 1362 - DNA, 171 bp, S.epidermidis
attttctattttcggcacgcgttttcattttctgtagttttttctttcgatcaggtgaaagataaggatttcgaagtgcatgatagattaatcttaaattatttcgctcattatagaatagatgatttaagtctttcacagatagacgtgtgtttgattctgcctttttaa

SEQ ID NO: 1363 - DNA, 171 bp, S.epidermidis
ttgtctcgggctatattattgtttaaattttatttatcaactggattagcattatcaccatggaaatttgtctcgttacgattgtactttggacttggtccatatttattagactctgttttactatctaagcaagtcaatactaatattaatatcgacccaatccagtag

SEQ ID NO: 1364 - DNA, 1989 bp, S.epidermidis
gggggtcattttatgacagcgaccttcattattatatatattgtagtagcgctcatactcattggttttattaatttctttttaattaagcgtaaaagaaaaaataaagacaaaagagtggaacaacgttcgacaatagattctaagagagaaagcaatcaatctaaatttaaagcaagcgatttagaacaaacaactaagtcaaatactgatccaacgcaatcaaacgatattgaagatgaaaaacgaaaaaatcactttgactcagaaatagataatgcatctcaatttatcaatacagatagtaaagaggatagaaacgcgttaagccataagaaccaagaggaagatgacgcatcgaacgatgtgttgaaccctatcgatccaaattctactgaaggtagagttaatgaaagaattaaaaatcaagagtctaactttatttttggtaaaggtataactagaggtaaaattttagcggcaatgttatttggtatgtttatcgcgattctaaaccaaactctattaaatgtggcattgcctaaaataaatacagagtttaatatttctgcttcaactggtcaatggttaatgactggttttatgttagtgaacggtatattaatacctattagtgcttttttatttaataaatattcttatagaaaattatttattataggtttagcactatttacattaggttccttagtttgtgcaatctcatttaatttcccaattatgatgagtggacgtgtattacaagccataggcgcaggtatattgatgccgttaggttctaacgttattgttaccattttcccacctgaaaaacgcggtgtggcaatggggacaatgggtattgcaatgatattagcacctgcaatcggtccaacactttcaggttatattgtgcaaaattatgattggaatgtaatgttttacggtatgttctttataggtattattgctatcgtaattggtctattttggtttaagttgtatcaaagtacaacaaatccgaaagcagatattcctggaattatttatagtacgattggattcggttccttattatatggtttctcagaagctggtaataaaggatggggctcaactgagattgtaacaatgtttattgttggtacggttttcattattttctttattttaagagaactaagaatgaaagcgccaatgttgagcttggaagtattaaaatatccaacttatacacttacaactattatcaatatgattgtgatgatgagtttatacggaggaatgattttacttccattatatttacaaaatcttagaggattttcagcattagactctggattattactattgccaggtgcattagtcatgggagcattaggtccggtggcaggtaaattgttagatacaatcggtattaaaccattagcaatatttggtattggcattatgacatatgcgacatgggaattaagtaaattaaacatggatacaacatatctccatattatgtggatatatattgtgcgttcatttggtatggcatttgtaatgatgccgattataactgcaggtatgaacgctttaccaccacgtttaatttctcatggtaatgcgtttgttaatacaatgagacaattagctggttcaattggtacagctattttggttacggtcatgacgacacaacaaacaaatcatctttctgcttttggtgaagagttagataaaacgaatcctgtcattcaagaccatatgcgtgaacttgcccaacagtatggtggtgagtcagcagcaatgaaattattactcgaacatgtcaataaacttgcatctgtagaaggtgtaaatgatgcatttattgttgctacaattattagtgcgattgcactgatattaagcttgttcttacagggcaagaaaaaggctcaattatcagctgaaaaagcaaatgctgaagattatccttcgcaacaagataaataa

SEQ ID NO: 1365 - DNA, 666 bp, S.epidermidis
gtcaaacatttacggttaatcggcctacctcataaaaataaaaatacatatgtaaatctcattttaagggtgtcattgatgaaagcatatctatataaattcatgccattgctcattttcgtcataggactgattatcttttacgtttttaatgattatcccacattgatacatgtcatagtgattattgcttttataacgaatggattgaaaaatgtatattttgttaataataatattagaaatcatatgatatgggtgagccctaaactcgatcgtatccttggtatgatttcgggcatactatattttggtatttacgtggttggctttataaagcaacagcctttatggatagtgatgcttattctagtatcaacagtgggtactgcggttttattagaaacaaaattacatattacatcacttcaattagaggagacgttatcatctgaacggataaaacgtaaagtaatatcaagacataaagcacaacgtcttaagtgtatattttttactgtgattgttgtagtaatcatttcaatgctcatatcattatatttaaagttgatggttatttttggacttgcagtaacgatttttatcttagcatcaataagtgtggctattttcgaaaaatactttactattattgaaaatatgtaa

SEQ ID NO: 1366 - DNA, 168 bp, S.epidermidis
tcttgtctttatcaatattttactgttattctaaattgtttgatactcaacttaaaaataaaatacagatggtgtgtatcaaagagtcattataaaactgtcaacaatcataagattgttgacagtcaatatatactatggggcatattttatttctttgacgattga

SEQ ID NO: 1367 - DNA, 219 bp, S.epidermidis
gtacatcttctaaggtcatcaattttagctcttttgcatctttcatgtgtcgttgctctcctcttcataaaagtatctaattatattctacatgagattcaaatttttaacatacctcattttttatttcatattaatcatttcattttattgttaaactatttatatcaacacttgataataacttataaattaaaaggtcgtgatatacatgattaa

SEQ ID NO: 1368 - DNA, 1026 bp, S.epidermidis
aagggagattatgtaatgatatctaaagttgaacatcaaagacacggtttagatttaattaaaattgataatgacgatacgaaaattgtatttacaaactatggtgcaagaattgtttcttggaaataccatgataacaatatcgttttagggaatgtagtagaagcggatgaattttattttgaagaaccttttaattttggtgctacgataggtcgctatgcgggtagaattgaaaatgcatcatttaaattagatgatgatacttttcaattagaatcaaatgatggtcaacatcatttgcatgggggcagtcatggattaaatagacgtatttttgattatgaaatagttgatgatattggacaagtaaagattatattcacaacaacgattaaagaagaagaggacaattatcctggagatatgatggtaaaggttattcacacttatgatgccaatcatcgatggtccgtacaatatgaggcaaaatcaacaaaaaaaacagtatttaatccttcaaatcatgtttattttaatttgaatcgtgataacaatgttgtctataaccactgtataaatagttcagcattaaaaatgtatatgttaaataataaacatattgttaaagaggggcaatctcttgatttacatcgattattggatacaaataaagtctatttaaaagatatttttgaaagtgacaatgaaactttgcaacaacaaattaatcattataatggcattgatcatcctttcgaatttggaggaaatgagcttaccattgataattctgaatttgaacttaatattaagactgatatgcctcattttgtaatgtttacgtttaatgatccacaagtttggaacaatgattttaatatttataaggcgcattctggattttccatcgaaactcaatatatgcctaatgatataaatatgtacggcgccaaagctcagtctattttagaggcagatacattatttacatctaaaacaagttttcaaattcatgaaaagtag

SEQ ID NO: 1369 - DNA, 156 bp, S.epidermidis
tataaaatctatcaatccattatacgggaaagtaggttagattatgaaagagatgaagaatggcaatgcttgggcattaattcctttattgttatttgtcttactatttctaggtgttggtattattttctggtgattttaccactatgccattaa

SEQ ID NO: 1370 - DNA, 150 bp, S.epidermidis
attgatagatatgaaaaagccagtccaatgattaaggtgtcgaacgtaatcactggactggcttatttatacattttaatactaaaaataaagagtaatactaaaatcaaacttttagaatgcgaatcattaacacaggatttattttaa

SEQ ID NO: 1371 - DNA, 333 bp, S.epidermidis
ggaggtagatatatgaatgtacagtttaagaaaggtgctttagaattaattgttctgctaattattaaaaaagaagatcagtatggttattcacttgtacaaaatatctccagatatatgaccatagctgaaggtacagtttatcctctgctaaggcgtttggttaaaagtggggaactgagtacgtattatcaaccttcaactgaaggtccgtctcgaaagtattatcaattaactcaacagggggctgcgagagttaatcaattagaggaggattggaaattgtttacggaagctgtagaacatttcattgaggagagtgagaatgaatga

SEQ ID NO: 1372 - DNA, 150 bp, S.epidermidis
tgctttctgtatacccagttatcatgtacgtttaatcatagaaaatctgaaatcacttcaatttataaaattatgtcaataaacgttgaacgagctgaacgaaatattgaggaactttttccaaaatacgctcatctggatgatatttag

SEQ ID NO: 1373 - DNA, 186 bp, S.epidermidis
actcgatcgtatccttggtatgatttcgggcatactatattttggtatttacgtggttggctttataaagcaacagcctttatggatagtgatgcttattctagtatcaacagtgggtactgcggttttattagaaacaaaattacatattacatcacttcaattagaggagacgttatcatctga

SEQ ID NO: 1374 - DNA, 975 bp, S.epidermidis
tttataaagtatgagggggtaagaaagatgacggtgaccgttagatttcaatctttatcgcaacctcttacattagtttcaaatgtgaaagagattcctaaagatgcaacgattatatggtatgattttgaaaatgccactgatgaagaaaatgagtatttaaaaaatcattttgatttcaattacttagaaatagatgatgctatcaatggtgacccacgagttaaatatatagaatatgacgcgtatcaatatatgatatttcatagtattattaatgatgattactcaccaatctcactaagtgtatttttagaaggtaatgttttagtgacataccatcacaaacattttccatcattaaagcgtgtggctcaatacaatgcagaaaatcatgatagtgaattagattgtgcagacatcgtcattcatattctggattgtatggtggataaatattttaactttgtttatggtattgaagataaagtgtataattttgaagctaagcatgtcgatgaccgctatagtaagagcgttatggaaaatgtctttcaattacgttcggatttaattaaaatcaaacgcgtattatttccgatgcaagaagttgtagatacaatgaaacaagaaggaaatataattaaagatgccaaacatagaatgtatattcaacatattgatgatcatcttattaaacaaagaagtgttattcggacttctcaagaaatgacgaatgagattcgtgaaaattatgaatcattcacctcatttaggatgaatagtataatgcagatacttacgcttgtatctgttatattctcaccactcacttttattgctggtgtatatggaatgaactttgaatttatgcctgagttgaaatggcattatgcttatttcgtgtgcttaactttaatgctaattataacaataatattaatcatattctttaaaaagaaaaaatggttttaa

SEQ ID NO: 1375 - DNA, 132 bp, S.epidermidis
aaatgcaatcaatatatacagattaggtttatatttttaataggtaatgatagttattatagtgacattcaaacatacaacctaaattttataagatgttgtcgatttaatataaagagaaaggacgtatag

SEQ ID NO: 1376 - DNA, 126 bp, S.epidermidis
ttggggaaccaaaggattttccgaatcacatttttccaccaaatttttttggaaatgggatttcataatggcttaggaatgaatttaatttttaacttttttgaaagatcggagaggcgttttttt

SEQ ID NO: 1377 - DNA, 1164 bp, S.epidermidis
tggaggttacatacaatgaaaaactctagattttctgggttccaatgggctatgatggtctttgtatttttcgttatcacaatggcattgtccgtgatactcagagattttcaagcgactatcggagtgaaacgttttgtctttagtattaaagatttagctcctttcatagctgcaattgtgtgcatattagtatttaagcacagaaaagaacaattagcaggattgaaattttctatcagtttaaaagtgattgagcgtctacttttagcactcattctaccacttatcattttaatgattggcttgtttagctttaatacttatgctgatagtttcatcctattacaaacttcagatttatcagtatcattattaactatattaattggtcatattttaatggcttttgtagtggagtttggtttccgttcttacttacaaaatattcttgaaacaagaatgaacacattttttgcgagtattgtcgttggtcttatttattcagtatttacagctaacacgacatatggtgtagaatacgccggataccatttcttatatacattcatgttttcaatgattattggtgaattaattagagctactaatggtcgtacaatttatattgcaactgcttttcacgcatccatgacttttgctctcgtctttttatttagtgaagaaacaggcgaccttttctcaatgaaagtcatcgcactttctacaacaattgtgggtgtttcatttattattattagtctaatcattcgtgctattgtttataaaacgacgaaacaaagtttagacgaagttgatcctaataattatttatctcatattcaagatgaagaaccaagtcaagaagacgcctcttcaacttcaaatcatgatgtatcatctaaagatgaaacaaagcaacaagatattgataatgacaaacatcaatcaaagaaacctaataagagtgacgatgcacttactacttctaattataaagaagacgcctcttcagttaataaagaaacggatacaactcacaatgataacattaaagatcattcaacttataccgaagatagacactcatctgttgtcaacgatgttaaagatgaaattcacgaagttgaagatcataaagccgacacagataaatcacattaa

SEQ ID NO: 1378 - DNA, 687 bp, S.epidermidis
gagcgtaaacatatgattaattgcttaatcgtagacgatgataaaaagttattgcaatatgtttcaagtcatttagaaagagaaagtattcaaacacatactttcacaagtggagaagcatcactagattttcttgaaaataaaaatgttgatattgcgatagtagatattatgatgagtggaatggatggttttgagctttgtcagactttgaaagatgattatcatattcctgtcataatgttaacagctagagatgcattaagtgataaagaacgtgcatttctaagtgggactgacgattatgtcactaaaccttttgaggttaaagaattattatttagaattaaagctgtcttaagacgatatcaaattaatgctgataacgagttacaacttggcaacttaatattaaatcagtcttacatggaaattactgtgggttcaaaaacgatgaatcttccaaacaaagaatttcagttgttatttttattagcctctaatcctaaacatattttcactcgagatgatattattgaaaaaatttggggcttcgattatgaaggagatgatcgtactgttgatgttcatattaaaagattacgtcaacgtttatctaaattgaaatcatcagtatcaattcaaactgtaagaggtcaaggatatagggtggaccaaaatgtttaa

SEQ ID NO: 1379 - DNA, 711 bp, S.epidermidis
agaggagagcaacgacacatgaaagatgcaaaagagctaaaattgatgaccttagaagatgtacttagtcaaattgaaaatggtatgacaatcggaataggaacagggagcacaattgaattattaattccccaaattgctgaattaattcagcaaaagaattatacaattaccggcgtctgtacttctaataaaacagcatttttagctaaagaattagctatgaatatagttgatgtaaatgatgttgagaaaatcgacttagcaatagatggcgctgatgaagtagacagtgcgcttaaccttattaaaggcggtggtggagccttatttagggaaaaggtcatagatgaaatggctgaccgatttgtcgttgttgtagatgaaagtaaactcgtcaactatttaggagaaacatttgcattaccagttgaagtcgataaatttaattggtaccaagttgccaaaaaaattgagcgtacttatgatattcatgtaagcagaagagttaatgaagatgtaccgtttataaccgacaatggtaattacatattagattgttcattgcaaaatagaattcctgcttatgagctacacgaatttttaattcatttaactggcgttcttgaaacaggatatttcctcgatattgccgatcaagtaatagtaggaacacaagaaggcgtaaaaatattaaataaagaaacttag

SEQ ID NO: 1380 - DNA, 438 bp, S.epidermidis
aaaacggagcaaaatttttatatgaaaggaggggtgttggttttaaaaataatgtctaaacatagtgctacgttagttattatgtttttaataactttattgcctatttttcaatatcaagcttctgcacatgcgactttagaaaaatcaacaccacaacagcaaggggttattaaagacaaaccagaagcaatcaagttagagtttaatgaacctgtgaacaccaaatactcgagtgtgaccttatttgatgataaaggtaaaaagattaaagaccttaaaccaataacaactggatggtctcagacagttgtattttcatctgagcaaattgttaatggcacgaatactattgaatggcatacggtatctgcggatggacatgaagtcggagatacgtttgaattttcagttggaaaagtgaggctaaagatgtag

SEQ ID NO: 1381 - DNA, 405 bp, S.epidermidis
ataatgactaagattcactttgaagcacccagtcccgaagattactgtaatttaagagctaatgctggaatgagtagtaaatcgattgaagcggcaataaaggggcttcctcatgcatgttttaatgtgaccctttatgagaatgatatgttgattggtatggggcgagtgattggggatggtggtacagttttccaaatcgtcgatattgctgtgaaagatatatatcaaggtttgggtcatggaatgacaattatgcatgaaataatgaagtatattgagagtgttgctgaagaaggtacatatgtgagcttgatagcagattatccggcagatcaattatacgagaagtttgggtttaaaagtactgagccttattcaaaaggtatgtatatcaaatattaa

SEQ ID NO: 1382 - DNA, 201 bp, S.epidermidis
acaaaatataaatgcttgcctcaatcaataacacagaaaacaaaaattaacatacaatcttacattttcggagttcagcacaaatcagttattgaactaactttattacaaattggaggactcaatgaatatgataagattgtatgtcattcatgtctttacaactctaatatgtattgtttgtgtaacttaatcacttaa

SEQ ID NO: 1383 - DNA, 186 bp, S.epidermidis
atgaaatataaaacaactttcaaaataaaacctccttttaccccagctaaagacctagctattttttcaaaaattattactaaaacactaagtaaacttttgcttaaaaaattagttaatgtcttacatcaattagataaattgatattaacgtttataacaaaattgaatttaaacaaaatataa

SEQ ID NO: 1384 - DNA, 135 bp, S.epidermidis
aaacgtcataaaatgcatttgcttttgcatccaatgacgttttttagttatttaaacattgaaatcaatgacaatacgtccagtattattatgattgatgacttgatcgatggcttttgggatttcatcgaatga

(The sequence listing continues in the following parts.)

The invention claimed is:

1. An isolated nucleic acid comprising a nucleotide sequence encoding an *S. epidermidis* polypeptide of SEQ ID NO:5607.

2. A recombinant expression vector comprising the nucleic acid of claim 1 operably linked to a transcription regulatory element.

3. A cell comprising a recombinant expression vector of claim 2.

4. A method for producing an *S. epidermidis* polypeptide comprising culturing a cell of claim 3 under conditions that permit expression of the polypeptide.

5. An isolated nucleic acid comprising a nucleotide sequence of SEQ ID NO:1835, or its complement, wherein said nucleic acid encodes an *S. epidermidis* polypeptide or a fragment of at least twenty amino acid residues.

6. A recombinant expression vector comprising the nucleic acid of claim 5 operably linked to a transcription regulatory element.

7. A cell comprising a recombinant expression vector of claim 6.

8. A method for producing an *S. epidermidis* polypeptide comprising culturing a cell of claim 7 under conditions that permit expression of the polypeptide.

9. A probe comprising a nucleotide sequence consisting of at least forty contiguous nucleotides of a nucleotide sequence of SEQ ID NO:1835 or its complement.

* * * * *